United States Patent 7,368,527 (HADDE71 POLYPEPTIDES) - sequence listing, part 6

SEQ ID NO: 9789 - DNA, 38771 bp, Homo sapiens
  misc_feature (29356)..(30880): n equals a,t,g, or c
gaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagtttgggacaggaagtggagaagtagtaaatcgataggttgggactccgtggaatgagggtaaggggcccagagtggatgtagaaagcagagaggggtgaaagatgcttttgaaggaaggtggcttggttggctttgcgttgatttgacatcctgggatggtagtactcatttttctttctttttttttttttttttgagacggagtctcgctctgtcgcccaggctggagtgcagttgcgcgacctcggctcactgcaacttctgcctcccgccttcaaacagttctcctgactcagcctctggagtagctgggactacaggcaggtgccaccacgcccggctaatttttttgtatttttagttcagatggggtttcaccatgttggccacgctggtctcgaactcctgacctcaagtgatccgcccgcctcggcctcccaaagtgttgggattagaggcgtgagccactgtgcccggccggtagtactcattttcttttgctctttttgaatgatattctagccctcacctccttgcttccaattggtttaccaggattctgtggtatagtagtctaagcagaggaaagtttcgttccttgcgtcattccacatcccaagacaagttactgggcagatgagaaacgtagttatgtagcctagtctgcccacactttttgtaagggcttcgtgtttcaattcattagtatccatagtcacctctctctaatatccacctatgatacactgtccagacctggttattatttaaaacttttacatctgcatttttatctatcattcatctctttccccacatgtaatagaaccagcagttctctatcttaaagccttgggcagtgttcttcctcctcctttctcttacccgttagaactaattgaataggcccagaagaaatcgcattggtttagaagtcaggccaggattttaatcttcgttctaaatacacttttttttttttttttttttgagatggagtctcagtctctaccaggctggagtgcagtggcacgatcttggctcactgcagcctccgcctcccgggttcaatcgattctcctgcctcagcctccagagtagctgggattacaggcctgcgcctgtaatctattaaaagaatagaaaacatgattatatcctactaatgggttgaaactgtattattcattcaagaaggtttttttcttctataactaagggtgtctcatggacttagttcttggtcatttgttctttgtgctctctgtgacattacttcaactattcaatttcaaaatctacatcccttttttcgcagactttttggagccatatatctcaagaatgttgctagacatatacattccagtgatacataaaaacttaaccttccaaaacttgtatttgtatataacagtttgtttttagactttttactgaccaccctaatgctccttgggactccaaattgcaacttggaattatttcttttagctgctacagatgtagtccacttctttaacatcaaacttctgatgtcttttccagtgtacagagagttgttaggatagtgtctgtcagtcattcccatcctgccctgcttactccagaattatttttggctttgtgcttgatacattaggattctgtggtttacaaagcagcttcatatataatcactgccctttagtgtctcagctcccaattttcctcaaaatttcctttcttcgtttccactttttcttttttgtttcttttttgagatagggtcttgctctgttgcctgggcaacagagtgcagtggtgtgatggttcactgcagcctctacttccctggctcaagcagtcctcccacctcatcctcctgagtaactgggactgccagcaaatggcactgcgcctggctaatttttttttttttttttgtgagacagggtcccaccgtgttgcccaggccggtctcaaattcctgggctcaagtgatccttccacctcggcctcctaaagtgttgggatcacaggcataagccaccacacctggctactttgtcttgattccatctgtacctttgctcatgccagtctttcttttttcttttttttgagacagggtcttgctggagtgcagtggtacagtcttggctcactgcaatctctgtctcctgggctcaagccatcctcccaccttagcctcccaagtagctaggactacaggcatgtgccaccatgcccagctaatttttgtatttttagtagagatggggtttcgccatgttgcccaggctggtcttgaactcctgaccttaagtgatttgcctgccttggcctcccagagtgctgggattacagccgtgagccactgcatctgcccccatgcccgtcttaaaactgggaataacccctcttccttttacttctgagagttttctttgattaaactgcctcctgcatcattagttttcacatttcttttttttgagatggagtctcgctctgttgcccgggctggagtgcagtggcgctgcaagctccgcctcctgggttcatgccattctcctgcctctgcctcccaagtagctgggactacaggcgcctgccaccatgcccggctaattttttatatttttagtagagatggggtttcaccgtgttagccacgatggtctcaatctcctgaccttgtgatctgcccgcctcggcctcccaaagtgctgggattacaggcgtgagccaccacgcccggccttcacatttcttgttcagatttgcagctcttcacttagtgcatgtttggtgtacgcaaactgagggtggtgactcgatattttgcacagtacctacttactgctcctgtaataaacacagcattcagccttgctaactactaactcctgcctagttccaggatgtctcattggccttgcctaacagccacaggttttttaattaaatccagtgtattagtagataatgtgaagtcacaggttgtgcccttcctcctgtttccctctcagaccattcactggggagtgcaaataaggctgcacagtaatcccccgaagggcttgctgggctccacccccagtgttcctggtttagtaggtctagggtgggcctgagaatttgcctaacaagtttccaggtgcagctgctgctggtagtttggggaccacacttgaagaaccacggggctaggtaacagaagcttatgctgttctctcgtcatgttccctgttcttcaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccagctacttgggaggctgaggcaggaaaatcacttgaacccaggaggtggaggttgcggtgagctgagatcccgccactgcattccagcgtgggtgacaaagcaagacgccttctccaaaaaaaagtttcccctttggccccaaatgaagacttggctggcagcagaggcacagctggaagcatcgatcttccacctccctggcttttccattctctgctctggggcaaaggagtgctgtgaaaagggagacgagtagtttctgcaccagtcccgcacaggccacctgcaagacaagaggagtttggaaggctggttagttactcctgtaattcctggtctatagcccttccagatgtttcctagcatgcctcaataagtcacagtagtcattgcccatactgtgttccttagtagccaggctaatccttggaattcaccccagatttctaatactattgtttttttccagtctgttgctctattctgtaacctggtggtagttttagtttagctgtattaacttaccagggaaatggattattccatcttctttaacttctctttccttggcaccattgctttgtgaatataaggcaatatgaatagtaggctcaggaagaagatgtggccaaggaaatagatggatttatacacctgtggagagagaggccactaaggtagacaggcctggagtgtcctttgcaacctttgaggttgcagtgagtccctcccagtctcacaagcaggccttcacttgccttaagccatttgtcccacgtgaagaggcagaaggcagtcatggagtaacccatgaagagccagtggatggtctgttgcaccaaatagtagaagggctggaggacagtaatggcggccagcttgctcagggtggggctctcttgaatgagcctggcagcctggggagggaggaggagctcatcagcatcttgtcccttatattccccttcacccccaccctggaggcctacctgtctttccacaataacaatgaggaattccatctggaagcagaccaggtatcctgagtgcaggccgtgccagagggccaggaatagcaacgagagaccctgagagagttctttatttccaaggaacttgagtcgtttgaagatgtagctggagaaaagggtgggtggggcgaccctcaaactgactggtccttgcatcccgccacctgcctctgggtcctcaccctgaggattggattggagtgctggtgggttcccacgtgtagcccccagagggtacaggaggcagtgctgactgattacttttagagatggaaagcagacccaaggcggagctggagaccgtgtgcgcacgagccacttggttcagcagcagtgactgaggctgatgctgagatcagtggtgaaccagacactctactcaagctgcccacactctagtggtggggacaaacaagtaaagctgttgataaacagggcagtggaggacataagtccattggcagagctggagtaacacccaggtcttaacgcacttttatatcttgcctttttttcaaatatgacagtaatggtttttttgggaggggggtataggtgggggtcaaagtcagtgtgagcgacagggggttctgcccagatgggaaagacgcataggggtgacatggtacacccctgccctccaatctgggaagacagtggaaggaaggaaccagggtccaggctccccaccagcagctcaccgggccacccaggcgttggtgttgatgttgaatgaggcaatggtgccagtgaagcgggggtttgtttcaaagagccacaccttcatgttggcacaggcatcccactttgccttgcccttttcttcaaagccattgaagcccaggcccgtcaaaatgcatactccttcctgagagggaatagctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgctccttcatttcttggttgaattgatgctgaaacacaggatggacaagttctcagtgaaggaattcttctggcaattaaactttttttttttttttttttttaccattttaatttttattttctagagtcagggccttgctctgccactccggctagagtacagaggcatagtcattgctcgctgtggccttgaactcctgggctcaagcgatccccttgccttggccacctgagtagctgggactataggcatgtaccaccttgcctggataatttttttttgtagagatggggtctcactatgttgcccaggctggtcttgaactcctggcctccagtgatcctcctgccttggcctcccagagcgttggcattacaggcatgagccactgtgccctcctgcatttcctactgataaatatttttgagacaggattttgctatgttgcccagaatggagtgcagtggtgtgatcaaagctcactgcagccttgacccacctcccctggactcaagcaattctcccacttcagcctcctatgtagcttggactacagatgcatgccactatgtctgataatttttgtatttttttgtagagacagagtctctctatgttgccaggctggtctagaactcacgggctcaagtgatcctcccacctcggcctcccaaagtgctgggattatagaggtgaaaccactgtgcccagcctctatctacctacctacctatcaacctgcctacctacctatcaatcataaatatatttcatatatacatgaaaataggctttaaaggcagaaatgtgactggttcaggcaaaatcctgtggcataaatgtggatttttatgtttgtactagtgttagaatggataactggaagaaccctaaactaaaaagggcccactcctggcacagagtgcctgttacaacagtccagggcctgcatgactcaggtctctatgccagggtcatgctggagaatgcagctttcagaagagtcacttcagagtgagtgaaatacctacacaaacatctggaccaagaggggcaattacctgtttggtatctttcctggtatgtcaatcagctctccctgcaccagcttcatgtagtgattcattgagaactggggccctaccaagaaggccccatagaagtaggagaaaccagcaacttccagcagggaaggaacaccacgtatggcatatttctgttgctcagaggacaaggaattctatgccaagaagagaatgcatggttcaggatagccttgaatctccccacaagagccactttgagtgttccccacctgtgtgccccactgactggggttcttcaaatagccttctctttgggggatgacaaatagttgcttcttgtggaaatgcgtatgtgtgtgcatagctggctgttgctgctttagcaaatgccttgctggcattgatctctggactttgtgcaagagctggatcctgggcaaattagatttgttgatccttgctcagtgctatctgaaagggagattgcacaggctggggaatgagggagaggctccgctctggaatttgggttcagtcttttgttaacaacttttttcttccctttcattaagtcttgaacctctctgccgatgaatgggtacttacctgatctttccctccgtcaaagtagtcaacagccaaacctgagcagagagagaacggatgggtagggtggtgggagaggacactgaggatgtggcctgtagactgagtgcagccagaagtgtatggcggggggcggagggggggtgccgaggaagtttttagtgagatgggggagggacctacatgtaaggaaggcaggcagtgaccatcactcaccaatcagcttcaaagtcagaacacaatgtggcattgtccacttgatatcgtagttgccggtggcagtgtaatagtatccagccagaaggtaggcctaggagaggcagaagtatttattctagcatcactactatttcttctccttgctctgaaattcaatgttctctttcctttttcctttctcctcatcccatcattaaaagccttaataaattcctacaaatggaggtgctgaaaacctgtaatgggaagagcgttgctcaaggcttcttggcaaaatgagggctaaactgagatgagaatttagatgctgggaccacaggtgcatgccaccccacccggctaatttttaattttttttgtttcaccatgttgcccaggctggagggctaatttttgtattttttttgtagagatggggtttcaccatgttgcccgggttagtctcaaactcctgggctcaagcaatctgactgccttggcctcccaaggtgctgggattacaggtgtgagccactttgcctggcctaggcttaggttctttaactcattctaagttgcttttctgtcttgccttgaagtgactctgctcctggatagtgggttaaaccaaagagcctaatggcacagtatgcaaagggttagctggtggcccttccttgaggcaggcaaagagttaccattacaatctgtggatggaacacttgggcctgtgataagccacctacctgaagtcatactgctaagtgctgggagaggggttagaaattaggtctgctaatttctataccacagtcccctgcctacccctgtcccctgaaccgctgtcagctgtagcctgagctgctaagggaaagacgtttaccatctggaagcaaaaggtagtgaggacggcagtgatggtgcggcccattagtcgaaggatgaggaactgaagcacaatacacagcagggagtggtagagctggtttcctggatgcaagaagagagaatttagcctggtttttacactcccaccgtcctgagacttccaatcacaacgtaatatataaagaaaaaatgttggcatcaggatcttttttttcagaataacctcatgttttggaggagaggatggaaattatttattaaaataaaaaagattattagggtgttattttatttcttttctttttttgtttgtttttttagagatgcgacttgctctgttgtccagacttgagtgcagtagctcaatcatagctcactgcagccttgaattccgggctaccacacccagcttgttactgtatttttgaatgtctgaagtgaagaatgaatctaagtggggactgcttggctcggtcattcagttacatccacagcacagagaaactgaggattctttgttgatgaggtatggcaagggtaaccaccctcaaaatgtttttatctgacagaagaatgtacataaaagaaaaaaaggaaaagttaagctgtgttcctcttcatacaaccctctttgcaagtgggagcattataacttccctacctattagattctctcaaggaaattttgttcaagtctgttccttccaggttcccactaattgcggtgtcactgctaatttagtttactcaccaaagttaaaataagcaattgagaggcctgtaaaggtatggaagaggtggatgaggtaggtctccttgtagaaaaggtaatgccgataaaacaaagcaaaggggtaacctagatgggggaaaagataagaagagtgttatttgtgcctggtgccatcccagtttggtttggaagtttatctggcatgaaacgcagcccagagggagagagaaaaaaaaaacaacatacattatatggatggcaacagagaaggcaataacggtatccccaagaaccaaaagttttttgtaaatacaaattttgaactaaagatattaatatttgattgaggcaatataaagctgggtcctaagactaggtttcatttatagcttatgaactattgccagacattttctcttacttgaattttaaaaaatgatacaaggaagctaggcatggtggctcccatgtataatcccagcactctgggaggctgaggcaaggggattgcttgagccgaggagttcgacaccagcctgagcaacatagcgaaaccccgtctctattaaaaaacaagatacaaagatttgagcgtacccatctatgctccagaaacactcatttacactttgtgatctatcttgctagcactgtattatcagattatgaggaaaaatataaattaatatcaggctaaatactggaattgctgactgcatatatagcagttacaagttatgtggagatactcctcacagtctgtaatctgggcatcaaccaagttataaaatccatttaagtatactaaaaaaatgtcttctaaagccatgattcagagtatagtccaaaggccatgagtgaaccacagaggatcttctgatgggtcatgaactgattatacatggccaagggttgcttattgaattaaaaacggtcaataaaatttggtattcctaaactaaaattagcacattccatggctttactgcagactcaccttcagtgttctatctagaggtctggcggccatgcctggcaacatccccactgcactagtgcatatgtggaggatggggatctctcaactgctttttggaaagacattctgcctattctttcattgattattctcttgagttggtcatggtttatactttctgcaattcttgcttttatttttatttattttgagacagggtctcttgctctgtcacccaggctggagtgcagtggcacgatcatcgctcactgcagccttgacctcctgggctcaagtgatcctccaacttcagcctcttgagtagctgggaccacaggtgcttgccaccatgcctggctattttgtaatttttgtggacatgagttctcactatgttgcccaggctggccttgacctcctgggctcaaggaatcttcctgccttggcctcccaaagtgttgggattacaggcgtgagtcactgtgcctgatgaattgctgcgattcttgcttttaaattatgtaactgcagtttttatcatgggcaatacagtttactgtgagtttgcttaactctaaaacgcttagaatagtatcatacagaaataaattgctcaattatttgttaaataagtaaatgcacacaatcatgttatatgttggtttctgtccttctagtcatttttcccccatacattaaaaaaaaaaaaaaaaaaaaggctgggcgcggtggctcatgcctgtaatcccagcactatgggaggctgagacgggcggatcatgaggacaggagatcgagactatcctggctaacacggtgaaaccccgtctctactaaaaatacaaaaaaaaaaattagccgggtgtggtggcgggcgcctatagtcccagctactagggaggctgaggcaggagaatggcatgaacacgggaggcggagcttgcagtgagctgagatggcaccactgcactccagcctgggcgacagagcgagattccgtctcaaaaaaccaaaataaaacaaaacaaaaaactgtactggctggtgcagtggctcacgcctgtaaaccaaggcactttgggaggctgaggtgggtggatcacttgagatccggagtttgagaccatactggccaacatggtgaaaccccatctctaccaaaaatataaaaaattagctgggtgtggtggcgggtgcctgtaatcccagctactcgggaggctgaggcaggagaatcacttgaacctgggaggcagagtttgcagtgagctgagatcgtgccattgcactccagcttgggcaacagagcgagactctgtctcaaaacaaacaaacaaacaaatgccatttgatcttcctggtgccaggatcaactggtgtttttttttttttttgagatggagtttagctgtttttacccaggctggagagtgcaatggcacgatcttggcagctcactgcaacctccggcccctaggttcaagcgattctcctgcttcagcctcccaagtagctgggattacaggtgcccgccaccatgcccagtgaatttttgtatttttagtagagacggtatttcaccatgttggccaggctggtctcgaactcctgacctcaggtgatccacctgccttggcctcccaaagtgctaggattacaggcgtgagccaccacgcccggccaactggtgtttttttttttaattgctgttcccataataggctaggctcttaaatttatagcttcatgcaagtatagttgacccttgatcaacacaattttgaacagcaagggtccccttagacttccctctgcctctgccactgctgagatggcaaccctttctctttctcctcctccttgcctgctcaacctgaagatcatgaggaggaagacctttatgctgatccacttccactgaatgaagagtaaacatattttttcttgcttatgattctcttaataacattttcttttctatagtttactttatggtaagaaatacatatataacacaaatgacatacaaaatatatgttaatcaacttgtttatgctattggtaagtcttctattagtagttaagtttttggagagtcaaaagttatatgtggccgggtgtggtggctcatgcctgtaatctcagcactttgggaggctgaagcaggtggatcacgaggtcaggaaatcgagaccatcctggctaacatggtgaaattccgtctctactaaaatacaaaaaattagctgggcatggtggcacacacctgtagtcccagctactcaggaggctgaggcaggggaatcgcttgaacctgggaggcagaggttgcagtgagcagagattgcagtgagcagagagagccactgcactccagcctggtgacagagtgagactctgtctcaaaaaaaaaaaaaaaaaaaaaaaaagttacacctgtcggccgggtgcggcagctcacacctgtaatcccctactttgggaggcttaggcgggtgggtcgcctgagatcaggagtttgagacgagcctggccaacatggtgaaaccccatctctactaaaaatacaaaaattagttaggcgtggtgcaggcacctgtaatcccacctacttgggaagctgaggcaggagaattgcttgaacccaggaggcggaggtggcagtgagctgagatcacgccattgcactccagcttgggcaacgagcaagattctgtctcaaaaaaaaaagaaaaaaaagttttatgaggatttttgactgtacaaggggtgggatcccataggacctgcgctgttcaaggctcaactgtaattaattctacagatatcttatggattactggctcatgtattcattcaccaagtgtttagtaaatgcctgctatatgccaggtattctgtttatgaagcacgtaattgggtaggaggtggcatgtgatggttcgttttctagctggctgagatgatgggatataggatcactagctctagggaggtggagacatctatgaccctttcaggtagatcaatgagcaaggaaataggatcaagtctcatatatttcacatgggcagaaatttggcagagacagaacaccaggttagcagcaaatattgctaagaactagagccaggaactagaaagtatatagactaaatgtcaatgccttcaatcttttgctttatttttacttttgttttagtaacggggtataaataaaaaaatataaaacagtagataattatctagagcactcataaataagttctaggtagctaagtttctctctttaagcatgaaaacccttaaccatttggaatgctcgaaattaaaaaacaccacacatattactctgcctctttaagttgaatctaatttaacattttctaggtgtctggatcgtatctattccagagtaaagtcatgatggctttatgacgttctgaggtatgtgaaattgtctgcctgactctaacaaggcctacactgtcctgagttctgagttcttgtgtccacttcttatagcctgtctgtccctttccttgctactctgggatcaacagtcacctcttgaacttttggggtgcttggcaatagttcctctccctactcctaatttacggcaggccttagaaaccataaccttattttaaaggtgtaaaaaaaaaaagatttaagacaaaagcaaggggcttgggtgctttccttatggacttaggcctggtaacatctgttctggccacttagaggccttgtgtgctatttcttgttttcaggtgcgttttgcaggaggggacgttgttgagttccaaacaggtgaggtattgcacactagcaaacacatgagaagaaggcggaggaattgggagaaaaataaaaagaatgcagcaggccaggttagcaggaacgttaagacggtgacggagaacagcaaagcctggaagcaagccgccgtggagaaggaagaactgtgctgaggtgagttgctgtgacaacccaggctgattttgagtatgtaaacaccaaaccttgttcttggctgccgctcagctcagcgggctttggagcctggctgcccagccaccacttcagggatgtgctgtttttagggagggtgtgaccctacaagatgtttctgagccttaatgcttttttgtgggagccaatgcttaatatggtggctagagttacctgaagaatctataaaaaatgaccgaagccccttctgctcaccctcccactcatcagagttggcttccgtgggtctgagtgggaaggacttccacttttaacagcatgagacacggttctgacagccccactaacatccgaatgcaggccgcagtgctcagtcctgaggataaaattctcagcttggagattggggttgatgccttacctttattagcaccagatgggtttgtaacaacccagaggtttgtaagaacttgttggccgggcgccgtggctcacgcctgtaatcccagcactttgggaggccgaggcaggcggatcacctgaggtcaggagtttgagactagcctcaacatggagaaaccctgtctctactaaaaaaaatacaaaattagctgggcgtggtagtgcatgcctgtaatcccagctactcgggaggctgaggcagaattgcttgaacctgggaggtggaggttgtggtgagccgagatcacgccattgcactccagcctggcaacaagagcgaaactccatctcaaaaaaaaaaaaagaacttgtttggcagcactgtaactgttccttctttttgattgtttgtttaaagcagggacttcagaaatttattagcaggcgaaggatgatgacctttagtacactccaaacctgaggatcttctactagaatgggacctttataatccctaatgctagggacattcaaaatgcgtgttttttttttttttttttgagacagagtctctgtcgcccaggctggagtgcagtggtgcaatctcggctcactgcaagctccgcctcccgggttcacgccattctcctgcctcagcctctccgagtagctgggactacaggcgcccgccatcacgcccagctaattttttgtatttttagtagagacagggtttcaccgtggtctcgatctcctgacctcgtgatccgcccgcctcggcctcccaaagtgctgggattacaagcgtgagtcaccgtgcccggccaatgctgtggtctttcaagcagctgctgggatacatttaatttgtacaagccctcttcaggggttgtagtcaagcacagggagtggatagaactgtattattcagtctctggacttcactcagttccaagtgctgtttgtgtcagggaccagatctatcacaacgtgcattgttagcgggaacgttttcttatttcctgtacaatagttgtgagattacttattaatcctaaagttgtgaggtttcatctgaagaaacagaaatggactgtttccattaagtctggtaaatttggctgggagtggtggctcacacctgtaatcccagtgctttgggaggctgagacgggagaatcactggaacccaggagtttgagaccagcctgggcaacatagcaagactctgtctctacaaaaaataaaaaaaatagttgggtggggtgggtggtgcgtgcctgtagtcccagctacttgagaggctgaggcaggaggatcacctgagtctggggagacagaagctacaatgagctacgatgatgccactgcactccagcctgggcaacaaagttgttttttttgagaccctgtctcaaaaataaataaataaataaataaaaataaaaaaaatataagcggggcacggtggctcatgcctgtaatcccagcacttcgggaggctgaggcgggcggatcacgaggtcaggagatcgagaccatcctggttaacatggtgaaaccctgtctctactaaaaatacaaaaaattagccgggtgtggtggcgggcacctgtagccccagctactcgggaggctgaggcaggagaatggtgtgaacctgggaggcagagcttgcagtgagccgagattgtgccactgcactccagcctgggcgacacagtgagactccgcctcaaaaagaaaattaaaataaaataaataaataaataaataaataaataaataaataaattgagcaccccaaacaacttttgttaatgtgggaactatatatcaatgtctactgtgttagaaaataagactaaaaactgggtgtggtggctcactcctgtaatcccaatgctttgggaggccgaggtgggtggatcacttgaggtcaggagtttgagaccatcctggccaacatggtgaaaccctactaaaaatacaaaaaccagccagacatggtggcaggcgcctgtgatcccagctacttgggaggctgaggcaggagaatcgcttgaacccaggaggtgggggttgtagtgagctgagatcacgccactgtgctccagactaggcaacagagcgagactccaaatcaaaaaaaaaaaaaaaaggaagaaaataaaactaaaaaaaaagtaaaagatatgattaattcagtaaaaatattaacagtaaaactactacacattatattaatataaataacatactttaaatgtaaaccactatatttcccaaaacaatcaaagaaataaagccatctaatgagaagaatgccactgttttacattttcataaatttatggcctctgtctgacttaatagaagatgactggattctcaaatctgcttctgcatttaatctgttgtaatatgttagtttggttaaaatatacaaagaaaatctggctttacacagacagagaaagtatctgcattttcagataattttggatattctttagcgctacatcaaaacttgacaagtagtagtttcttaacagttaggaacttttgttataataaaacccattggcttctcttgcactttgaatggatattttaccatgcatgactttgtaacatcacacatagatcactgcaaaatactggttccctgttgttaggcagatcttctaaatactgacatatttcattagaatacatatcaaaaaatcatattccttaaatttcaccattgatttcagcagaaaagtctgtatatattgaaaagtggtcaagctcatgggagtggatacaagttttccaaaattctaatttttacttgaaagtgtaaattttatcactggctacaaatattgtcatttgtttaccttgaagtgacaggctcacttcatacagtttcaagagactgtctgccagatgcctaagtctaaaaccatagtttgtctatcattctttcaagtaaaaatggtggtcggtgaaaaaagaagctgctaaatcaatatgcaacttgaataatcgcccaaatgcttttccttgtgacaaccaccgtactctaccagtgtgcagcagaggcggtttatgcatatttcccatttcttcaaacaagtttaaaaagatgtactcaggatcaggcatggtggcccacacctcccagcactctgggaggccaagacgggtagatcactttaggtcaggagttccagaccagcctggccaacatggcgaaaccccgtctctactaaaaatacaaaaattagctgggtgtggtggtgcataccagttaaaaaaaaaagatttattcaaggactgacatttgatacaattaacaatatttagcctgggcgacagagtgaaaccccatctctaaaaacaaaacaaaacaaaacaaaaacaaaaattagccaggtgtggtggtgcacacctgtagcctcagctactcaggaggctgaggtagcatcacctgagcccaggaagttgaggcggcagtgagctgtgatgcccccaccgcactctagcctgggtaagaccctgcctcaaaaaaaaaaaacaaaaaaaatttaccacttcatcaacgattcttaagtgaaactggctctgttttgattgtgagtgcatggcagtaaagaatgcagtgaccactggtacagtttggtgtcaccgtcctgatttgtgctaaggcgccagcagttttaccaccattttgcaacatcagtgcaagtgtcaacatagggaaaagacaaatacatcttagtagtatcatgaaaataatttttaccccaaagagattccttaaagaagtctcaggaacttttaggagtagtctatggactgcatgctgatatggaatgatttgttttaatctttcatcttctaatacccaaatccactagtctttcctttctccctggtttccttgactgccctgctgtgttttcaatctttttgaaacttctctttcactggtttcattggttttgaatacagttatctcttggtgtccatgaaggattggttctagtactcgcagcagacaccacagatgctcaagtcccttatataatatggtgtagtattgcatgtaacctatgcacatcttcacatacactttaaatcatctctggattactcataatacctaatataatgtaaatgcaatgcaaatagctgctatatagcatattgttttttatttatatttttattattgtattattatttagcttagaatccatgaatgtggaacccacaaatatggagggctgactatacacagtttcctggatttttttctactgagatataatttaccataaaattcacccttcaaagtgtaaaatgtaatgttttttagtatattcaaaaggttgtcgccgggcatggtggcttatgcctgtaatcccagcactttgggagccggaggagggcagatcacgaggtcaggagatcaagaccatcctggccaacatggtgaaaccctgtctctactaacaaaaaattagctgggcgtggtggtgcctgcctgtagtcccagctactcaggaggctgagggaggagaattgcttgaacccaggaggcagagattgcagtgagctgagattgcgccactgcactccagcctggcaacagagcgagactccatctcaaaaagaaaaaaaaaaaaggttgtgcagccatccccactatctatctaatttcagaatatcttcatcacctcaagtagaaaccccatacatgttggcagtcatttcccattctctcttaactcccagagcctggcaaccattcatctactttatgtctctatagattggcctattctaggtgtttcatataaatggcgtcaggcaatgtgtagacctttgtgtctggcttatttcacttagcatgttttcaaggttcatccatgttgtagcatgtatcagtacttcattcctgtttatggctgaataatatcccgttgtatggatactctgcattcttttttttaacatttaaaaattttttatagacaaggtctcactatgttgctcaggctggtcttgaattcctgagctcaaatgatctgtccacctcagcttcccaaagtgctaggattgcaggcatgagccactacgcccagcctggatactctgcatataatctacccattcatcagctgacaaacaactgggttgtttccactttaggaacattatgaagaatgctgctacaaacattcatgcattttgtagagacagggtctcactatgttgcctaggccggtcttgaactcctggcctcaaatgatcctcctgctttggcctcccagagtgctgcaattacaggtatgagcccatgtacaagtttttgtgtgaacatatgtttttatgttttcaattctcttgggtatatacctaggaatggatctcctggatctttttcttttttttccctttgggacagagtctctctgtgttgtccaggctgaagtgcagtggcatgatcttggctcacggcaacctccgcttcccaggttcaagtgattctcctgtctcagcctcccgagtagctgggattacaggtgtgcaccaccatgcccagctaatttttgtattttcagtagagatggggtttctccatgttggccaggctagtctcgaactcctgacctcaagtgatcgacctgccttggcgtcccaaagtgctgggattacaggcgtgagccaccgggctgttgcccacgctggagtgcagtggcatgctcacagctcactgcagcctcaactttctaggttcaagtgatcctcccacctgagcctccctagcagctgggactacaggtgtgcacaggaccggctaatttcttgtagagttggagtttcaccatgttgctcaggctggtctcgaactcctgagctcaagcaatctgcccgccttggcctcccaaagtgttgggattacaggcatcagccactgtgcttggccaatgttcactcttactttctgtgcttacttctggcatgggttggctgactacaatttgaatagacccatctttccgtttctttcaccgaaggcattttttctggctcctagatgttgctgacccccaggatccagtcttggccctccactattcttgctacactgcttctttggaaactcatctactctcaagtaacttaatataatctttatgccaaagacagatccacatctttagttctaacttctttttcagttccacatttcctacttccttgctggacagttttaatttgatatttcattaccatctcaaactctgtataactaaggcataaatttctccctaaatcagccttctctgggctttttttttttttttaaattaacagtgttaccattctccaggtcacacaacattcaaaagtgtgttttcctgccagggcatggtggctccacgtctgtaatcccagcactttgggaggccaaggcaggcggatcaccaggtcaagagttcaagaccagcctgaccaacatggtgaaaccccatctctactaaaaatacaaaaattagccgggcgtggtggtgcatgcctgtaatcccagctactcaggaggctgaggcaggagaatcgcttgaacccaggaggcggaggttgcagtgagctgagatcgtctcactgtactccagcctgggcaacagagccagactccgtctcaaaaaaaaaaaaaaagtgttttccttcttcatattggttctctgttatctagtcatgaaatcctgttgattcctcctttccagtctctctcaccatcactgtcaccatgaccatcaccactccctttttcctctgctgatttgcagttaaaacccttatggatctcacccttaaatccttgcaatggcctcctacctgatctctgcctgcaccacgtcttcccagcagtcctataccggggtaatcttccttcagctcctgctcagaaaccatcaatagctcccagctgactactcaacagagtcagcaatcctgtctgttctaccttcaaaataaatccaaaatctgaccacttctctccgcctctactgcttcccctggtctgagttgccactatctctggattattattattaatatatcattattatattcaatgtattatcattatatacttgcctcctgactgatctcaccctgcctttgcctcccttcagtctagccttaatgaagcatctagagggttctattcaacttaagtcagcaggtcactcctctgctcaaagccctctcaaggcctctattctcactcagatcaaaaggctgattgccagcacccgcaggttctgtccctctgcccgggccccactgtcctctgactcatctctcaatctggcctctacccttctgctccagccccaaagctttcccttcctggaatgttaagcaggtccagccttggtgccttcacatggtaagttccttgcctggaaggctctttgcacagataagctcaaatccttcctacacctcaggtcctttgtaaaatgtcaccataagtatcagtgaggacttccctatcttatctagaagtgtatacaacactacccctccccaccctgtaaccctcccccatcacacacttcttgttcttctttcctgctttttctatttttcttctcagtacttattaccttttgacataccatatatcttacttttcagtctttcaaagcagggattatcatctactttagtccctaccgtaccccagtgcatagtacagttcctggtacacaaaatttctcaaaaagtattagctgaatggccgaacaatgagtgaacaagtgctctgtactctaggcagtcaatacaatatttattaagcactcactatgtggttagcattgcattaggcattgggggaatatggtagaattttaagaggtgctttctattcttaaggagcaaaatcaaacaatgatgttctatgctaagggctaactgtatggaatagccaatgttgtagaggttaaagagaaatcaatctcgaccacagtggtcgggagaagtagttcttgaacagagaagagatgacggcattccaagggaggataatgtagtaaagacacagcggtaggaaggagcatggggcattcactccaagagactgggctaatttcaagggaggaaaaatattgtaacaaaatggatgggaaagtgaaaaaccaggcagagtctgaaattgataaatgggaaaaaaaaaatcaattgactaggtgtaggagaaggaaaaggacaaattaaagatgtttatgccactgatataatggtcttcaggtcttcaaacctttttgctggcatagctcctagaagaattttgaaaaactgtatatcctcctttcacattttaaagttgccatctaaaccttatgtttttatttctttatttttttattttcttgagacagtacttcactctgttgcccaggctggagtgcagcggcacaatcacagctcactgcagtttcaacttcctgggttcaagtgatcctcctgcctgagcctcccaagtagctaggactataggtatgtgccgccatgcccccaaaacaacagcaaattatgtgtgtgtgtgtgtgtgtgtgtgtgtgtgtgtgtgtgtgtgtgtgtgtttcaagacacagtctcactctgttgcccaggctggagtgcagtggtgcaatcttggcttactgcaacctctgcctcccaggttcaagcgattctcctgcctcagcctcccaggtagatgggattacaactgtgtgtcaccatgcatggctgattttcttttctttttttttttttgagatggagtttcgctcttgttgcccaggctggagtgcaatggcgtgatctcggctcaccgtaacctctgcctcctgggttcaagtgattctcctgcctcagcctcccaagtagctgggattacaggcaggcgccaccacacggggctaattttgtatttttagtagagacaggatttcaccatgttggtcaggctggtctcgaactcctgacctcaggtgatcctcctgccttagcttcccaaagtgctgggattacaggcgagagccactgcacctggccgcatggctgatttttgtatttttagtagagtagggtttcaccatgttggccaggctggtcttaaactcctgacctcaagtgatctgcctgcctcagcctcctaaagtgctgggcataagccaccatccctagtcagtgtgtgtgttttgaggcagggtcttgctctgtcgcaaaggctggagtgcaatggcacagtcatggctcactgcagccttgatctcctgggctcaagtgatcttccgacctcagacccctgagtagctgagaccacaggaatgtactaccacattcagataattttaaaattttttgtagagatggcatcttgctatattgcccaggctggtcttgaactgctgggctcaagcaatcctcctgcctcagcctcacaaagtattggcattacaggtgtgagctactatgtttggccgtgtgtgtgctttctaatgcctattgaaggtgtgttttaagtgcttatggcagatgtctgccatgcaatctaaatggcaaaccaatcagctggatcagtcttacttacaacacacctggcctgtccctcaacttttctattctttcaccaaaatggaagttccttatgttagagaacttacagagaaaaggaagacaaaggaaaataggaaggagagttaagctctgcctgacactgtctacttaagtgatgggtaactgattaggttcagtgcttagaacttcatataatgagatacaaaatctcattactgacccactctgccagctagaagagcacttgtagatcatggacatttaggtggggatatagccacctttgatcctttctgttcactagattaagccttgttgctagtacaggcaggagccaacataccttccacactccagcaatcctgtacaccttgggctgagtcatatgctgaacagttattcatgaatacagattcttacttagaactgaagaattacctgctccaaacccttcattaggtagataagagactaaggtccaaaggggataactggcatgcccaaggttaacagagcagagctcaaattagaatccacatcacctgatttccattctactattcttgccacatgccttggcacttggcagtgacctgggagtgaatcactaataaccagctgtgtgctcttttaaagctacagctctattattctttgatgtccagataacaatctatgctccagcacctgtttatagacataagcacacccatttttatgtttgcttatcctcctattgaaaaatattttaaaagttcattttaatgctaaatttaggtgtactttctttgttaatctaattcttgagcactctgcacccttcagcagttcatttctgaaagttacctccacctaaatagctcaagcattgtgacagctgtgatacaggactcatggaaactgggacaagtgatcaaaaatgtctgagggaggaacaatagaggggacattttaaaggtaagctattggatagttgttacctgtgagaaagaaagaaaaagggttaggttaagaaatgttagttttttactctctcaacccagccaaacaacctaaacttgaactgtcccaaaggcctaccaaaattctttaatttcttcacttaagctgagtgctcttaataagcaagacttctgaggtgtagtgctagtgattaatgttatacacacccgttggctgactggtgaaacctgctgcaataactaaaaattattctataaaaatgtatagacagagagaatgttaaagctaaaagaggccgttgactcatttctttgttttagtagaacaggtgcaacagattgaggcactttaagacatctaaatggctttactagcaaagataaaaatcacacttgcctgtactcagggaattttatcacattctaattctttgtaaatcagtgaatcccctggtgcaacttctagccagattatctgggctttggaatcagaattatctagtttaaaatttagctctgcagcttgggcaaattacttacattctttttttttttttttttttttgagacagagtctcgctctgttcctcaggctggagtgcagtagtgcagtcttggctcactgaaacctctgcctctcaggttcaagcaattctcctgcctcagcctcccaagtagctgggactacaggcgtgtgccaccatgcctggctaatttttgtatttttagtagagatggggtttcaccatgttggtcaggctggtcttgaactcctgacctctggtgatccgcccgcctcagactcccaaagtgctgggattataggcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaagcgaaaatatttgcaaaagtagcatacatgtacttccttcaggccacttaaaatacttatgcatgtctaaatattttatataagcatacctacacctaacttcttaaaaattgagtattctttttttgagacggctgtcgcccaggctagagtgcagtggcgcgatctcggctcactgcaagctccgcctcccgggttcacgccattctcctgcctcagcctcctgggtagctgggactacaggtgcccgccaccacgcctggctaattttttgtatttttagtggagacggggtttcaccgtgttagccaggatagtctcgatctcctgacctcgtgatctgcccgcctcagcctcccaaagtgctgggattataggtgtgagccactgcgcccggccgaaaattgagtattcttttaatggattttaagatataaaatctcaggctcagaaatttgagccacctaggggtgagaaattttggcctttgcccgcttcgaactgacttaactaaattaaatctatagaaagtaaaaaataaaggtctgtgaatgtacccagtactctcaggaagaagcatatttgccatgaagctaaaaaagcttcagtttcactccccttccaaggctctggggggtggggtgggggcgggagctagcaacgtgctcacatggtcatatatttttgtaaaacttatagaagatatttttgtattctttttcttaaagaagatatccaagattgtataagcttcagatcccagaaatcctagatttaaaaaaaataatcaaccaccaccccaacaaaattaggcacatgcctgaaaattctgctgctactgccagaattctgcgggtaggggcttcatccaaggtgttcctaataataggcagagtccccagattagttccggtgaggcttttgggaggggttatttggcgcggtgttggtgttggtaggatcctggctgtgaggctgaggcaggcctgaggagggctggggctgacaggtaggcagagttggctgggatgtgaggtgcaaggggtggtacttcggaaacaaactttgaagaggagaaggggcagcaagactgtgagtctggactttgtgatacactgtcacccctagtttagtgtgcctggttagggagaatcaagcagcatggaacccctcttcctttttcactaacatttttctgtatagtggttgaaacccagtgttaagagactgcatgacattggaaaagaaggggaggagaaaaagagtccatatgaggcaagaacagaacgcagccagaattagggcaggcagggaaaggaagggagtgagatgtgggagtcgggggggagttgaggtaacctgcattttatatgctagagctacgtattttagatgcaggggcaactgtttcggtccaggagtggaaaggactgtagaagcaatctagcacagctgtttctcacttgggaaaactgaagccctcagaggcagagggaggaatggggagcggccaggccaggacaggactcagcccccagttcctcttctcaggcgtccgattccttctgatctttctctcctgccctctctgttactgcttcctcctgttcttacccttatatacacttgaagttttatccccattttttatgcttatgggattgtacactttctggttctctctcaagtccaaccagtatgtggtaacctgtctcttcccacttcatttgtggcactggtttgcagtggacaaaaggtccgtgctcctcttctaacctaatctggactgggttgcccaaaggttgccctgccacactgccaagtgcctaattagctgttttctctccaacccctccaaacacttatcatgagtaatttctcttgtctttagagttgccaaatctaatctctgtaaatacaaatgtggtgagacttcttctcaggagtttcagcaaatgaaacaataaactcttttttaccctgctaagattctaaagataaccatgagaatactcctaattatccttataaatttgaataagtgtggttgttgggttctctcaccctttttatatcccttcaaaagaaaatacaagtttgaattctataaaatatttttctggccgggcgcagtggctaacgcctgtaatcccagcactttgggaggctgaggtgggtggatcacaaggtcaggagttcaagaccagcctggccaacatggtgaaaccccatctctactaaaaatacaaaagttagctgggcgtggtggcgggcgcctgtaatcccagctgctcaggaggctgaggcaggagaatcacttgaaactggaaggcagaggttgcagtgagctgagatggcaccactgcactccagcctgggcgaaagagtgaaactccatctcaaaaaaagaaaaaaaaaatttctaatatttatggaatgcactctcttatataccaacatacatttgtagcattttttttccttcagagtatgaagaaatcagtaaaaatgggcaaagcacaaatgacaactaatggattttgttaagtcctatgtgtcactttaagaacttgaaactggctcaaataaaaaccattttatttggttattaaaatgagacttaaaaacttaaaacaagattttaagtgatcttaaaatgtcttatcctacagaagattttagaggcaatgtagtacaaaaagctcttccttttctctgaagaatttattgagtgctttgggagtagggtgagttttttttttttttttaacatatgtttgattcaattaagcaaaaatattgtttcatgtctcactgaactgaatacattctactatccattggttttcaatgttcacttatttattttattttagtagagactgggtctcactgtgttgtccaggttgggttttcaaattttatgtctaacacagtgtgctaaatacaactgagtttcataagccatttttcccacttctgtacatggcactggtctcaacctgtatcatgcataagaattacctaggatgcggccgggcgcggtggctcacgcctgtaatcccagcactttgggaggccgaggcgggtggatcatgaggtcaggagatcgagaccatcctggctaacaaggtgaaaccccgtctctattaaaaatacaaaaaattagccgggcgcggtggcgggcgcctgtagtcccagctacttgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaaaaaaaagaattacctaggatgcttattaaaaatgcagattcccaattcctgaagggaggtcatgccttggcatcttacttagcgaatcagtgctatacagaaagtatgagagactggttcatatcaaagaatattgtgaaactctacactatatttgtgaagatatagaaaacccgttttatggctaaaaatcatcattttactactactaagcttcattattagtagatggagtttttttaaagggtcatttttcacaaagaaaaatttgttttgtcttttaacactttaggactgttacttcatagtttatccggggcagagaacaacagcgggttactctcaaacctgctctggagtttcagactagcagctgacatttttggggacctttctttaagcttgacattgtaaacactttgtatgtattaacccacttaatcctcaaaacaaccttgatgagtaggtatccttatcttacggaagaggaagctgaagcacagacagggttagtgacttacctaaggtcacagtgctggaaggtagcccagctggaatttgaacccagacagcatgtgggttcagagtgttttcatttttaactactctgctatattaccctctctagttttcagtattcatattagcacctcagccttccccagatgactacaaatcccatacatatgtgtatacacacatacccagggtcattcatgaaatctgaaacttcgggtgttcaatttgactttatagaaccttctacctctcctggctgatagtatctctttctcatttcacaaattaaacttcctataacactaccttaaacatgccacccctgctcaaaatactctggtggcttcctacgatctataagatgaaagctaacttccttagcttgccattcaaggcccttcacagtctttccagtcttactgtttattctatccctacttgagcacaaagcatttttttctttgatcatgcatagtccttctttcttcatttttttaagtgtacaattcagtggattttagtatattcagtgttatgcaaccatctccactatctaatgccagaacattttcatctctgctatctaatgccagaacattagaaaccctgtaccgcatagtggccattcccaattcacccttcctcttatcccctagcaaccaccaatctattttctgtctttacgaattagcttattctgggtatttcatataaatggaatcatacaatatgtggccatttgtgtctggcttgtttcatgtcacaatttttcaaggttcatctgtgtcgcagcatgtgatcaggatttcattgttttcttatggctgaataacattccattgtgtggatataacattttgtgtattcattcaatttgtcccaattggtggacaactgggttgtttccacttttggctattataataaagctatgaacatttgtgtacaagtttttgtgtgaatctatgctttcagttcccttgggtgtaaccctaggaatggaattgctgggtcatatggtaactgtgaactttttgaggaactgacaaactattttccacaagtggctgcaccattttacattcccaccagcaatgcttgagggttccaatttctccgtatcttcaccaacatctgtttgtgtgtttttgattattgccatcctagtaggtgtgaaatgatatatcattgtggttttgatttgcatttccctaatgactaaagatattaaacagcttttcacgagcttattggccatgtatatgtctcttttagagaactgtctattcatatccattttgtaaactgggttatctttttattgttgaattctaagagttctttagacatctgaatactagacttatgatttacaaatattttctcctattctgtgggatagctttttactttcttgatagtatcctttggtgcacaaaagcttttaattttgatgaagtccaatttatcactgatcataccagctggaaatctacttttttctatgtcagcatctcaatattacttgatgatctggggagaatttttgaaaatataaaaataatatacataaaattttgatataaaacaagagggccaagacttgaagaaatctggagcttctgttgagacgatgacctggggtcccaatgattactgttaggatcttaatgtacttagtggaaaggttgagaggcgctggcctacggcaggcactcctacagtaagactgaacctaaactgacattggtcagtttacttgggaagttgaccatatgttttttgtttgttttctcccaggctatagtacagtggcgtgatcttggctccctgcaacctctgtcttccaggttcaagcagttctactgcctcagcctcctgagtagctgggattacaggtgtgtgctaccacacccagttagtttttgtatttttagtagagatggggtttcaccatgttgcccagggtggtctccaactcctgacctcaaatgatccgcccaccttggcctcccaaagtgctgggattacaggcgtgagccatggtgcctggccgatggtatacattttaaaaataaatgtatgctatctaggagttcccatgttttgctattatttcctattctttcagagcaccaatagtcaatgaagaattaaaagtgaagtcagattatcctttagctaaagaatggggatttctagtagtacggttcaatatttttggtcagggccccatatgtttatactccaactttaatcaatcttttccacttctgactgagggatatgctgtaggaactttatgtgtactatttcagttggcctctgctggcttataaacagtagttgatatttagggacagtaatccagagtagtgtccaagtccatctgagtttagaattgctaccacagcagaaattggaaacctcgagagttataagccatttaccacatctacatggatgccacttctccttaaagcatatacaaatatatagagatcggaactttaaccttctgggatctaatatcttcctaagatttgcatacagaatgtacacatggatcttctattatagcaaattcttttttttttgagacggagtttttgctcttgttgcccaggtggagtgcaatggcgcgatctcggctcactgcaacctctgcctcccgggttcaagtgattctcctgcctcagcctcccaagttgctgggattacaagcgcctgccaccatgcccggctaattttttggatttttttttttagtagagacagggtttcgccatgttggccaggctggtctcaaactcctgacctcaggtgatccacccaccttggctttccaaagtgctgggattacaggtgtaagccaccgcgcctggccagcaaattcttaattgcctgtaaaattactatctcactatgtattattttcggaagcagatatgaccgtgtacagttttcttataaaagtgccatagcaacatgaatactcagtactgacaagcatctttaattgacaaaagctttttttttttttttttttgagacggagtctcactctgtcccccaggctggagtgcaatggtacgatctcggctcactgcaacctccccctcccaggttcaagcgattctcctgcctcagcctcccgagtagctgggattacaggcgtgcaccaccgtgcccggctaatttttgtatttttagtagagacagggtttcaccatgttggtcagaccagtctcaaattcctgacctcaggtgatccacccacctcagcctcccaaagtgctgggattacaggcatgagccactgtgcccggccatgacaaaagctttttatttttaatttaatcttagcctatggttaaagtgaagcatttaaatagcctacttgatgacttcatgtgagccaagaacaaaacctgggtctgataatcttctacctactctctgacaaactgtccctacaattataatgcaatgacatttctatgagcagcctctattactaacagttattatacacttggttcttatacagaatacttcattcaagatgtccagagcttcatctagctcactatcttcaaagcttctgcttgcaaagggaggaacttacaccatcagtccattttaagccaaaaggaaattcttacccagaaattaattacttatcctttttttagtgtgttactctccacacccccttcctgttttgaaagcagggagaaataatgatgtatacagtatcttctgaactatacaaattacagataagctttaaaggtctctaggaagctactactgtttcaccataagaactccaagtgggccctaaatctcctggtccttgacttcagccactgctaggaaaatgtcaatacacacacactcctatcttaaaaactctgtgcttgagaagaaggatggtttgctttgatattagactagctttccctggcagctgcaactagggaacctaatttttgttaaagctacaagtcac

SEQ ID NO: 9790 - DNA, 143 bp, Homo sapiens
gggactacaggtgcccgccaccatgcccagctaatttttttgtatttttagtagagacagggtttcaccgtgttagccaggatggtctcgatctcctgacctcgtgatccacctgtcttggcctcccaaagtactgggattac

SEQ ID NO: 9791 - DNA, 303 bp, Homo sapiens
cttttttttttttttttttgagacggagtcttgctctgtcatccaggctggagtgccgtggtgcgatctcggctcactgcaagctccacctccctggttcacgccattctcctgcctcaacctcctgagtagctgggactacaggtgcctgccaccacgccctgctaattttttgtatttttagtagagacagggtttcaccgtgttagccaggatggtctcaatctcctgacctcatgatccgcctgcctcggcctcccaaagtgctgggattacaggcgtgagccacggcgcccggccaga

SEQ ID NO: 9792 - DNA, 319 bp, Homo sapiens; identical to SEQ ID NO: 7787

SEQ ID NO: 9793 - DNA, 157 bp, Homo sapiens
gggacgacaggcacctgccaccatgcccggctaatttttttgtatttttagtagagacggggtttcaccgtgttagccaggatggtctcgatctcctgacctcgtgatccacctgtctcggcctcccaaagtgctgtgattacagcggagtcaccac

SEQ ID NO: 9794 - DNA, 263 bp, Homo sapiens
tttttttttttgagaccgtgtctcgctctgtcacccaggctggggtgcagtggcgccatctcggctcactgcaagctccgcctcccaggttcacgccattctcctgcctcagcctcccaagtagctgggaccacaggtgcccgccaccacgcctggataattttttgtatttttagtagagatggggtttcactgtgttagccaggatggtctcgatctcctcacctcgtgatccgcctgcctcagcctcccaaagtgctggg

SEQ ID NO: 9795 - DNA, 182 bp, Homo sapiens
cccgagtagctgggactacaggcgcccgccaccacgcccggctaattttgtttttgtatttttagtagagacagggtttcactgtgttagccaggatggtctcgatctcctgatctcgtgatccgcccgcctcggcctcccaaagtgctgggattacaggcgtgagccaccgcgcccggtct

SEQ ID NO: 9796 - DNA, 294 bp, Homo sapiens; identical to SEQ ID NO: 7791

SEQ ID NO: 9797 - DNA, 130 bp, Homo sapiens
caccacgcccggctaacttttttttgtatttttagtagagatggggtttcaccatgttaaccaggatggtctcgatctcctgacctcgtgatctgcccgcctcggcctcccaaagtgctgggattacagg

SEQ ID NO: 9798 - DNA, 252 bp, Homo sapiens
ttttttttttgagatggagtctcgctctgtcgcccaggctggagtgcagtggcgcgatctcggctcattgcaagctctgcctcccgggttcacacgccattctcctgcctcagcctcctgagtagtctgccaccatgcccggctaatttttttgaatttttagtagagatggggtttcactgtgttagccaggatggtctcgatctcctgacctcgtgatccgcccgcctcggcctcccgaagtgcttggat

SEQ ID NO: 9799 - DNA, 155 bp, Homo sapiens
tgccgccacacccggctaatttttttgtatttttagtagagacagggtttcactgtgttagccaggatggtctcgatctcctgaccttgtgatccgcctgcctcggcctcccaaagtgctgggatgacaggcgtgagccactgcgcccggcctca

SEQ ID NO: 9800 - DNA, 306 bp, Homo sapiens
ttcttttttttttttttttgagacggagtcttgctctctcgcccaggctggagtgcagtggcacgatctcagctcacggcaagctctgcctcccggattcatgccattctcctgcctcagcctcctgagtagctgggactacaggcgcctgccaccacgcccagctaattttttgtatttttagtagagacggggtttcaccgtgttagccaggatggtctcgatctcctgacctcgtgatccgcctgcctcggcctcccaaagtgctgggattacaggcgtaagccactgtgcccagccggaagg

SEQ ID NO: 9801 - DNA, 1575 bp, Homo sapiens
ggagtcttgctctgtcgcccaggctggagtgcagtgatgtgatctcggttcactgcaacttccacctcccggtttcaagccattctcctgcctcagccacctgagtagctgggattataggcgtgtgccaccacatccagctaatttttgtatttttagtagagacggggtttcagcatcttggccaggctggtcttgaactcctgacctcgtgatccacccaccttggcctcccaaagtgctgggattacaggcatgaatcaccatgcccggacttttttttttttcttttttgagatggagtctcactgtgtcacccaggctggagtgcagtggtgcgatctcggcttactgcaacttccacctcccaggttcaagaaattctcgtgtctcagcttcccacataactgggattacaggcacaagccaccatgcccgactaatttttttttttttttgtatttttagtagagacggggtttcactatgttggccaggctagtcttgaactactgacctcagaagatccacccaccttggcctcccaaagtgctgggattacaggcgtgagccaccgtgcctggacttcttgttgttttttgtttttttgttttgttttgttttttgagacaaggtctcactctgtcactcaggctgaagtgcagtggcgtggtcacggctcaatgcagccttgacctcctgggctcaagcagtcctcccacatcagcctcctgagtagctgggactacaggcactggccaacacatctggctaacttttgtattttctgtagagatggggtttcaccatgttgcccaaggttgtctcaaatcactgggctcaagtagtgctctcacctcggcttcctaaagtgttggttttacaggtgtgagcccctgcctcttttttttaaattgaaactttctgttgaactcacacatttgggttctttaaatgtgtgtttttatgagtaaatttaatgggaatgaaagcataattgatcttttttttttttttgtatttgaggaatgctttatttccaggcaataaaatgctatttctcatctctgtctctcttagattacagcaagatggaaataccaaatccccctacctccaaatgtatcacttactggaaaagaaaagtgaaatctgaatacatgcgacttcgacaacttaaacggcttcaggcaaatatgggtgcaaaggtaaaaaataattcccaagtgaaagtttatatatttcaatatactgacccagtgtaaaggggttggaatttttttttttttttgagacagagtctcactctgtcacccaggttggagtgcagtggcgtaatctcagcttactgcaagctccacctcgcaggttcacgccattctcctgcctcagcctcccgattagctgggactacaggcgcctgccaccacgcccggctaattttcttgtatttttagtagagatggggtttcaccatgttagccaggatggtctcgatctcctgacctcgtgatccgcccgcctcagcctccctaagtgctgggattacaggcgtgagccaccgcgcctggccca

SEQ ID NO: 9802 - DNA, 279 bp, Homo sapiens
ttttttttttgagacggaatcttgctctgtttgttgcccaggctggagtgcagtggcgccatctcggctcactgcaagtccgcctcccgggttcacgccattctctcgcctcagcctcctgagtagctgggactacaggcgcccgccaccacgcccggctgattttttgtatttttagtagagaaggggtttcaccgtgttagccaggatggtctcgatctcctgacctcgtgatccgcccgccttggcctcccaaagtgctgggattacaggcggggg

SEQ ID NO: 9803 - DNA, 287 bp, Homo sapiens
ttttttcttttttttttttttttgagatggagtcttgctctgtcgcccaggctggagtgcagtggcgcgatctcggctcactgcaggctcagcctcccagattcacgccattctcctgcctcagcctcccgagtagctgggactacaggtgcccgccaccacgcccggcaaattttttttgtatttttagtagagacagggtttcaccgtgttaccaggatggtctcgatctcctgacctcgtgatccgcctgcctcggcctcccaaagtgctaggattacaggcgt

SEQ ID NO: 9804 - DNA, 296 bp, Homo sapiens
tttccttccttttttttttttttttttttttttgagacagagtcttgctctttcgcccaggctgggctgcagtggcgctgtcttggctcactgcaagctgcgcctcccgggttcacgccattctcctgcctcagcctcccgagtagctgggactacaggcgcccgctaccacgcccggctaattttttttgtatttttagtagagacggggtttcaccatgttagccagaatgatctcgatctcctgacctcgtgatccgcccgcctcagcctcccaaagtgctgggattacaggc

SEQ ID NO: 9805 - DNA, 281 bp, Homo sapiens
tttatttatttatttttgagatggagtcttgctctgtcgcccaggctggagtgcagtggcgcaatctcaactcactgcaagctccacctcccgggttcacgccattctcctgcctcagcctcctgagtagctgggactacaggcgcccccccccacaccctgctaattttttgtatttttagtagatacggggtttcactgtgttagccaggatggtctcgatctcctgacctcgtgatccacccgcctcggcctcccaaagtgctgggattacaggcgtg

SEQ ID NO: 9806 - DNA, 296 bp, Homo sapiens
cctttttttttttttttttgagatggagtctcgctctgttgcccaggctggagtgcagtggcgcaatctaggctcactgtaagctctgcctcccgggttcatgccattctcctgcctcagcctcccgagtagctgggactacaggcacccaccaccacacccagctaattttttgtatttttagtagagacggggtttcaccgtgttagccaggatggtcttgatctcctgacctcgtgatccgcctgccttggcctcccaaagtgctgggattacaggcatgagccaccgcaccc

SEQ ID NO: 9807 - DNA, 134 bp, Homo sapiens
cccgccaccacacccggctaattttttgtatttttagtagagatgggatttcaccgtgttagccaggatggtctcgatctcctgacctcgtgatccgcctgccttggcctcccaaagtgctgggattacaggcg

SEQ ID NO: 9808 - DNA, 254 bp, Homo sapiens
tttttttttttttgagacggagtctcgctctgtcgcccaggctggagtgcagtggcgcgatctgcaacctccgcctcccgggttcatgccattctcctgcctcagcctcccgagtagctgggactacgggcgcccgccaccacgcccggctaattttttgtatttttagcagagacggggtttcactgtgttagccaggatggtctcgacctcctgacctcgtgatctgcccgcctcggcctcccaaagtgctg

SEQ ID NO: 9809 - DNA, 240 bp, Homo sapiens
ttttttttttttttttgagatggagtctcgctctgtcacccgggctggagtgcagtgacacaatctcggctcactgcaagctccgcctcccaggttcacgccattctcctgcctcagcctcccaagtagctgggactacaggcgcccgccaccacgcctggctaatttttttgtatttttagtagagacggggtttcactgtgttagccaggctggtctcgatctccggacctcgtgatc

SEQ ID NO: 9810 - DNA, 236 bp, Homo sapiens
gtctcgctctgttgcccaggctggagtgcagtggtgcaatctcagctcactgcaagctccgcctcctgggttcatgccattcttctgcctcagcctcccgagtagctgggactacaggtgcccgccaccacacacggctaattttttgtatttttagtagagatggggtttcactgtgttagccaggatggtctcaatctcctgacctcgtgatctgcccgccttggcctcccaaa

SEQ ID NO: 9811 - DNA, 3905 bp, Homo sapiens
ggagacttgctctgtcgcccaggctggagtgcaatggtacaatctcggctcaccacaacctccgcctcctgggttctagcaattctcctgcctcagcctcccgagtagctgtgactacaggtgtgggccaccacgcccagctaattttttgtatttttagtagagatgaggtctcatcatgttggccaggctggtctcctgaccttgtaatccgcctgcctcagcctcccaaagtgttggaattacaggtgtgagccaccgcacccacctgataacttttcttgaaagccattccatcgtgttattactaaaagctgaaaccttagatagaatactttacattttctttttctcttcctactttgtcttctttagagaggaagccagtttagcagcaaaagcagtcacgttagaatcagaagacctgagctggagtttagctctgtcactcataagcgatgtggtctcagggggccctgcagccactctgagttttgcctctcacacgaggagggtgccgccttcatgatgttgtgtggagatgaaatgaaatgacatagatgaaagggcttagcacatagtgggggctttccataaatgccagcttcactgccactcaacgactccacgctgtcacacgtcacctctacactgcagctgctcccatctcttctctttggctccgccctctccctgagctctggtaccctgtctcccactgtcaactggacatctcccgccggcatctctaattagacacatgcaaactggacttaccatctcacccaaaaaccagtgtctgctctcaagtttcccaacttcatccttaacgtaaaatcactggcaatcccgtgcccccgtatttcttccccctttctgcccctacaacccatccaggccctcctcaagccaagagccttgcagatgcctacacgtcttaaacactccccaatccaccctgcttgcagtttgcaaattcatctttttccaaccagacttgtcacatcaaaccctgaacaaagatcttcaaacccttttttgccctgaagcctggtacataggatcgaagaagagcaaactccaccgggtgtggggatgacaggaggcccacacagcctcagtgtacaaagtgctgagcaatttcatatcactgccacatagaagaaaagctcttgggatgaatggatcataaaacacagtattgttaaaagcagctactgagaactggaaaatttttcaccaaatttctttgcatagtatttaacaactatcatctaaatctgccacaacccccactccaatgcgttaaactgtaacaatcattgacattaaaccactttacatgttgtataatcttaaactcattcaacaaatgctcaagcctttagtatttatgtcaacggcaaatctggtcaatcccagacttattcttaccattttgttcatccaattcattcccaatttcctgccccatttgtttttggcgacttatgatagaggaaagggcatcaaggcctgcgtcctgttctgaaagaaaaaagaaaaataattaactagaaactagaagaaaacaacttaaagtccataagtatacccaggcatataacacaagttgacatataaatcagtcaggaaaaaaaagagaaaagagttaacattattggaacaaaatttaaaaactaaacacctacctgacaccttaaactaaaacgatttccaaaagaattaagattttaaatatgaaaaacaaagtaagatttggaaacatgaacatttaaactttctgatacttaatatataaagagcatgtacaaatcaataagaaaaagactgaatatcccaattttttaaatcagcagaggatacaggcaagaacttcacaataaaaaagaaaataaagttttaacatcgctactaatttttttaaaaatacaaataaaaaactactttttttggcttatcagatgtataaggattaaaaagaatgacaatacctaaggttaattaaattgtgacgatctagaagctcccaagtactatgtaataggtgaataagttttactgacggccgtatttctcaagtgtagactgtgcccacctttttacctgccaattctaagtctaggaatgtatgtaagaaaatattcagatagcatgtaatgatggatatacaaggatattccctgaaacatttgtttcttgtgccagatatcaacttagtgcctctcagcaacaaattccctctttttggctgctctatgaagatgaaccagctgggcacagtggctcatgcctgttatcccagccactttgggaagccaaggcaggaggttcacttgaagccaggagttcaaaaccatcctgcatcaaaaagtaagatctcacctctagaaaattttctttaaaaaattagccaggcagccagtcgcggtggctcacgcctgtaatcccagcactttgagaggccaaggcgggtggatcacgaggtcaggagatcgagaccatcctggctaacaaagtgaaaccccgtctctactaaaaatacaaaaaaaaattagctgggcctggtggcagacacctgtaggcccagctactggggaggctgaggcaggagaatggtgtgaacccaggaagcggagattgcagtgagctgagattgcgccaatgcactccagcctgggtgacagagtgagactccgtctcaaaaaaaaaaaaaaaattagctaggcacgatggcatgtacctgtagtgtcagctacttgggaggctgaggtgagaggattggttgatcatccaggagttcgaggctgcagtgagccatgatcacgccactgcaccccagcctgggtgatagagagaggctctgtctctaaataaaaaataatttgaaaattttttaaaaaagaaaatgaaccaaggctgcttgaatactttttcctttgtcagagtttttgcttcctggctccagcctgcaatcttggcaggctccttcagcaactgcaactccttcagtgcctggccccttcagtgcacagtggccagcaatacccagaaccagcaacttctcccagcacaccccctcctcgggcaggtttataacaagagcgcctccagggaggttcttccccatgaagagtttcccccagcatcccagagggcagatctccaggaggttctgacagcagggcaccacgggggcttctgtgaaattcagggaccctcagctgagccttctcttagccctaggggcgtgggctcctccctggacattctgtctcagcctgagacttggtgattgcaccttatccctgctagttctgttttgagagttcttttgacctcttgttagctaatccctcgttactctaatccctgttaaaattaataatttacattcaactttccctgtcaaatttctctctcctgatcagacccatagtgatatacttataatagtgaaaaattagaaagtacctaaatgcccaaacacagagatgtttataaatttatagtatatccacatagtaaaacactgtatagccactgaaaatcatattgtttatctatattttgatgttgaaagaagttcatatgttttgtttttttttgttttgtttttttgttgttgttgttgtttttgagatggagtctcactctgtcgcccaggctggagtgcagtggcgcgatctcggctcactgcaagctccacctcccgggttcacgccattctcctgcctcagcctcccgagtagctgggactacaggcgcccgccaccacgcccggctaattttttgtgtttttaatagagacggggtttcaccgtgttagccaggatggtctcgagctcctgacctcgtgatccgcccgcctcggcctcccaaagtgctgggattacaggcgtgag

SEQ ID NO: 9812 - DNA, 275 bp, Homo sapiens
ttttttttttttttgagtcagagtcttgctctgtcacccaggctggagtgcagtggcacaatctgggctcactgcaagctccgcctcccagcttcacaccattctcctgcctcagcctcccgagtagctgggactacaggtgcccgccaccatgcccagctaattttttgtatttttagtagagacggggtttcaccatgttagccaggatgatctcgatctcctgacctcgtgatccacccgcctcagcctcccaaagtgctgggattacaggc

SEQ ID NO: 9813 - DNA, 264 bp, Homo sapiens
tatttttttgagacagagtctctctgtgtctcccaggctggagtgcggtggcgccatctcggctcactgcaagctctggctcccaggttcacgccattctcctgcctcagcctcctgagcagctgggactacaggtgcccaccaccacgcctggctagtttttttgtatttttagtagagacggggtttcactgtgttagccaggatggtctcgatctcctgacctcgtgatccgcccacctcggcctcccaaagtgctgggat

SEQ ID NO: 9814 - DNA, 163 bp, Homo sapiens
gggattactggcacatgccaccacgtccagctaatttttgtatttttagtagagacggggtttcaccgtgttagccaggatggtctcgatctcctgacctcgtgatccacccgcctcggcctcccaaagtgctgggattacaggcatgaaccaccatgcccgg

SEQ ID NO: 9815 - DNA, 261 bp, Homo sapiens
tctcgctctgtcgcccaggctggattgcattaacgcaatctcggctcactgcaagctccgcctcccaggttcacgccattctcccgcctcagcctccctagtagctgggaatacaggcgcccgccaccatgcccggctaattttttgtatttttagtagagacggggtttcactgtgttagccaggatggtctagatctcctgacctcatgatccgcccgcctcggcctcccaaagtgctgggattacaggcgtgaggcac

SEQ ID NO: 9816 - DNA, 282 bp, Homo sapiens
ttctttctttttttgagacggagtctcactctgtcacccaagctggagtgcagtggcacaatctcggctcactgcaagctccgcctcctgggttcacgccattctcctgcctcagcctcccgagtagctgggactacaggcacccaccaccacaccctgctaatttttttttgtatttttagtagagatggggtttcaccgtgttagccaggatggtctcgatctcctgacctcatgatccgcctgccttggcctcccaaagtgctgggattacaggtttaa

SEQ ID NO: 9817 - DNA, 297 bp, Homo sapiens
tttccatttcttttttttttttgagacagagtcttgctctgtcgcccaggctggagtgcagtggcccgatctcggctcactgcaagctccacctcccgggttcacaccattctcctgcctcggcctcccgagtagctgggactacaggcacccgccaccacgcccggctaattttttgtatttttagtagagacagggtttcaccgtgttagccaggatggtctcgatctcctgacctcatgatccgcccggcttggcctcccaaagtgctgggattacaggcgtgagccaccgcac

SEQ ID NO: 9818 - DNA, 277 bp, Homo sapiens
ttattctttttttttttttttttgagacaagtctcgctccatcacccaggctggagtgcagtggcgccatctcggctcactgcaagctccgcctcccaggttcacgccattctccttgcctcagcctccggagtagctgggactacaggtgcccgccactacgcccggctaatttttttgtatttttagtagagacggggtttcaccgtgttagccaggatggtctccatctcctgacctcgtgatccgcccgtctcggcctcccaaagtgacttat

SEQ ID NO: 9819 - DNA, 273 bp, Homo sapiens
  misc_feature (256)..(256): n equals a,t,g, or c
ctgccactttttttttttttttttgagacaagagtcttgctctgtcgcccaggctgaagtgcggtggcgcgatctccgctcactgcaagctccgcctcccgggctcacgccattctcctgcctcagcctcccgagtagctgggactacaggcgcccgccaccacgcccggctaatttttttgtatttttagtagagacggggtttcaccgtgtttgccaggatggtctcgatctcctgacctcgtgatccgcccgnctcggcctcccaaaaga

SEQ ID NO: 9820 - DNA, 279 bp, Homo sapiens
tcttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccagaatggtctcgatctcctgacctcgtgatccgcccgcctcggcctcccaaagtg

SEQ ID NO: 9821 - DNA, 292 bp, Homo sapiens
tttattttttgagatggagtctcactctgtcgcccaggttggagtgcagtggcgcaatctcggctcactgcaagttccgcctcttgggttcacaccattctcctgcctcagcctcccgagtagctgagactagaggcgcctgccaccacgcctggctaattttttgtatttttagtagagatggggtttcactgtgttagccaagatggtcttgatctcctgacctcgtgatccgcccgcctcggcctcccaaagtgctgggattacaggcgtgagccaccgtgcccggcct

SEQ ID NO: 9822 - DNA, 320 bp, Homo sapiens
gacttcgttttcttttcttttcttttcttttttcttttttttttttgagacggagtcttgctctgttgcccaggctggagtgcagtggtgcaatctcggctcactgcaagctctgcctcccgggttcacgccattctcctgtctcagcctcctgagtagctgggactacaggtgcccgccaccacgcccggctaatttttttgtatttttagtagagacggggtttcaccgtgttagccaggatggtctcaatctcctgacctcgtgatccgcccgcctcggcctcccaaagtgctgggattacaggcgtgagccaccat

SEQ ID NO: 9823 - DNA, 274 bp, Homo sapiens
ttttttttgtttgagacggagtctcgctctgtcacccaggctggaatgcagtggaccgatctcggctcactgcaagctctgcctcccaggttcacgccattcttctgcctcagcctcccgagtagctgggactacgggcgaccgccaccacgcccggctaattttttgtatttttagtagagaaagggtttcaccgtgttagccaggatggtctcgatctcctgacctcgtgatccgcctgcctcggcctcccaaagtgtgggattacaggcat

SEQ ID NO: 9824 - DNA, 300 bp, Homo sapiens
ttaatttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcaccgtgttagccaggatggtctcgatctcctgacctcgtgatccgcccgcctcggcctcccaaagtgctgggattacaggcgtgagc

SEQ ID NO: 9825 - DNA, 287 bp, Homo sapiens
ttttttttttttttttttttttttgagatgaagtctcgctctgtcgcccaggctggagtgcagtggcgcaatctcggctcactgcaagctccgcctcccgggttcacgccattctcctgcctcagcctccggagtacccccgattacaggcgcccgctaccacgcccggctaattttttgtatttttagtagagacggggtttcaccgtgttagccaggatggtcttgatctcctgacctcgtgatccgcccacctcggcctcccaaagtgctgggattacaggcgt

SEQ ID NO: 9826 - DNA, 322 bp, Homo sapiens; identical to SEQ ID NO: 7795

SEQ ID NO: 9827 - DNA, 140 bp, Homo sapiens
ccgccacaacgcccagctaattttttgtatttttagtagagatggggtttcaccgtgttagccaggatagtctcaatctcctgaccttgtgatccgcctgcctcagcctcccaaagtgctgggattacaggcgtgagcca

SEQ ID NO: 9828 - DNA, 4727 bp, Homo sapiens
tggagtcttgctctgtcgcccaggctggagtgcagtggcatgatctcgactcaccgcaacctccacctcccgggttcaagcaattctcctgcctcagactcctgagtagctgggattacaggggcgtgccaccatgcctggctaatttttgtatttttagtagagaccgagtttcaccgtgttggccgggttggtctcaaattcctgactttgtgatccacccgcctcggcctcccaaagttctgggattgcgggtgtgaaccaccacgcccagcctcattttcccttctgatggtcaggccttctgttagttgccactccctgaagtgtgctttttaaagggattcctccatgattcctgacaatactggcaacaagatgcttttacaatgtaactttctggtgtgcctccccatgggtggcccagtgcaggccggtgctcatggtggatggtgcttgctctccaggaacatgctggattatgctaataaactactcctttcttgacaaagaacatgtatttcttcctcatttccatcttcctctttctactctctattcagactaccaggtgaacctgtttggaaaatggtatatttcagtcaagtttgttgaaaatagtctcaagattttcagctttccatttgccatcatcatgatacttaacctgttatttatttatttacttatttatttatttttttgagccagagtctctctctgtcgcctaggctggagtgcagtggcacgatcttggctcattgcaacctccacctcctgggtttaagcgattctcctgcctcagcctcccaagtagctgggattaaaggcgctccccaccacgcctggctaatttttgtattttaatagagatggagtttcaccaccttggcaaggctgttcttgaactcctgacctcaagtgatccacctgcctcagcctcccaaagtgctgggattacaggcatgagccactgcgcccagccttaacttgttttagataaattattggtttcatttttcaaacagaaaatgaaacttcaacaagctaaagaatagtgcatgacttgtaccattgacagtggttccatggctgcctccaacaacctcccaggccccttcctgagccatcacaggcatctgaaggcaccgtctttaccccttggtcgcaagagcaaaatagagtggatgcagcctctgtattcatgtggctgaataggaaagtgaaaacaaattccagggactgaaatggaattgcttgtaggaacaatttgatcaatttattttagcgtagtgattctcacctatgacctatcatccaaatgggtatcctgtgacttcctttgttgttgaataatggttttgagggttccgtttcaattggcaacatagcagttccagaatgtttgcaatcaaaatggccaatttccattcaaatgtcaattactatgggtgaggaaatcagcattacatcacagatgtgtgagcacctacacaaagcctgcaaatgctggacagggaacctcgtgcaaataatatggcagtattggcaggaatgatggaggaatccctttaaaatgtacacttcaggcagcagcagctaacagaaggcctgaccatcagaagggaaaatgcacatgcagatgaatgtgtggcagcactgggatcctccagatatccagttgattatgagaactatgactatctgcatagtcagagtcattctttggaatcagacagatgtgtatgggctggagtatgtacatattagggccataacaatgtaagtgcccgtcgagttcttgactgctgcctagatagagctgatttattgagatacagaaattgcagtagagaaagaatttaatgcacacagagcctgctagacaggagacaggagttttattatttcctcaaatcagcctccccccacaattaaaaaattagaaggctggggttttttttagagatagtttggtgggcaaggggctggggaatgctgactagtcaagtcggggatgaaatcatagggaccaaaactgtcttcttgtttttcattcctgagtgggatcacataaatagttaaaccagtttactggtctgggtggcaccagctggtccatcacaatgcacagtctgaaaaataccacaaacatcagttttaggtgttacagtggtactagttatccgtaggagcaattggccaagtttggaaccttgtggcctctggctgcatgactccctagccataaattctaatcttgtggctactttgttagtttaacgaaggcagtctggtctccaagtaagaacggggtttgttttggggaggggctgttatcttcttcgttttaaagttgaactataagctgaattcctcccaaagttagttaggctgggcccaagaatgaaccaagggcaacttagagcttagaaacaaaatggagtcagttaggtcagatttctttcactgtcataattttcctaggtcagacttttctgtcataatttttgcaaaagtggtttcattaagtgaataaaaccctttgaaattcagttacctatgaactggagatgatacttctgcttctcatgtttgctgtgagaattcaacaaggccacatatataaagcacctaacacagggtctgagacataccatgcattcccttttctggtcttcagctcactgtgtttagaaaataaatacagttttacctacacttgagcatattgggtggctaacttgtcacctaacatccatccgtagatttagaccgtacaggtctctgttactaaactagggcaagtgagtattcatgtgttaatgtttcattgtcggaataactttggattgcatttggcaattaggattcaagtcagagaattatcaaccattgatcaccagttttctctgaaatagtctgaaaactggtgacgagaagccactcaccatttgctactaacagctcaaaggtgaagaatattccattaaataaagcactaaagaagataagcctctcctcaggcgacaaagggccaaccccaaatgaagtccatgctgcgggtcttaaggtcatctgctcataagaaactggtcacttctggtgtgagttaagatgaatggagagagaattggttcccagagaccacagtgaaaaaggttaagaacataataaagaccgtaagttccccaaatagtgaattgtgtttctcttcttcctaaatacagaaaggaagggtgctacttttcactctgagacagatggagctactaggtaaagcatcattattgctgtttcagtctctatttgaaacatcatttcctgggacttagatcaacaaggatctcaaaactcagacaagaattttttattttaatcctgtgttttaggacagggtccccaacctttttggcaccaggcatctgtttcgtggaagacacttttttccacagatgggcgattgggggaggggtatggtttggggatgaaactattccacctcagatcatcaggcattcgactctcataaggagtgtgcaacctagatccctcacatgtgcagttcacaataggatttgtgctcctatgagaatctaatgctgccactgatctaacagggggccaagctcaggcagtcaggttcactcacctgcagctctcctgctgctgtgtggcccagttcctaacaggccacggactggtcccagaccacagcccagggattgaagactcctgttctaggataggcaaagtaaaatgaacaaatgttagccatgtgtaaggtacttaaggaaaaatcgtaagtttgcagcaaacaaatcatgcccctcaggttgtctgagagactctgattttatgtgtcacctaatccttattggcaacatttgctatttatgaagtttaggaaggatgaactgagtttgccttgcactgagtcactagacagtttatctttccggagctggagggaaatgagagacgacaactggctcccttttttacaagtgtggaggctgaagcccaggcaggtgagttctgctgagagtgacaaagctcagctcgggactgtcacctgtaccacgcggcctgacagaggaggcaagctctatctgaccactgtgaaaatatgcatctgtatctgacggctgttaaaacgtgcacatcccaaagtaacgaagagatgagaggcaaataacagaaaggaaaactaacttgccaaaatacgttagtcagaggtttaataaccataatataaaaagaatgctatgataagaataaatccaaccctcaaaaaaacaatgatgcagattacttgtgcttggaaataaaaaatgtaaatgaaaacaataatgagctttctctttggtctgtctaatgagctgattagcaggtgcctgagttgtgaggccattcaggtatacaggcaccaacaggtacaagtacacaggtatgcagaaaccgagggttttttttttttttttgagacagagtctcgctgtgtcacccaggctggagtgcagtggcacgatcttggctgactgcaaactccacctcctggattcaggccattctcctgcctcagcctcccgagtagcctggactacaggcgcccgccaccacgcctggctaattttttgtatttttagtagagacagggtttcaccgtgttagccaggatggtctcgatctcctgacctcgtgatccgcctgccttggcctcccaa

SEQ ID NO: 9829 - DNA, 270 bp, Homo sapiens
gactttgtgtttttgtttttgttttttcgaggcggagtctcgctctgtcgcccaggctggagtgcaggggcgcgatctcggctcactgcaagctccgcctcccgggttcacgccattctcctgcctcagtctcccgagtagctgggactacaggcgcccgccaccacgcccggctaattttttgtatttttagtagagacggggtttcaccgtgttagccaggatggtctcgatctcctgacctcgtgatccacctgcctcggcctccca

SEQ ID NO: 9830 - DNA, 301 bp, Homo sapiens
tcttttttttttttttttgagacagagtcttgctctgttgcccaggctggagtgcagtggcacaatctcggctcactgcaagctccgcctcctgggttcatgccattctcctgcctcagcctcccgagtagctgggactacaggcacccgccaacacgcccggctaattttttttgtatttttagtagagacggggtttcaccgtgttagccaggatggtctcgatctcctgacctcgtgatccgcctgcctcggcctcccaaactgctgggattacaggcgtaagccaccgtgcctggcc

SEQ ID NO: 9831 - DNA, 301 bp, Homo sapiens
gatttttttttttttttttttttttttgagacagagtctcgctctgttgcccaggctggagtggagtggtgcgatctcagctcgctgcaagctccgcctcctgggttcacgccattctcgtgcctcagcctccagagtaactgggaccacaggcgcccgccacgacgcccagctaattttttgtatttttagtagagacggggtttcaccgtgttagccaggatggtctcgatctcctgaccttgtgatccgcccgcctcggcctcccaaagtgctgggattacaggcgtgagccaccggg

SEQ ID NO: 9832 - DNA, 307 bp, Homo sapiens; identical to SEQ ID NO: 7796

SEQ ID NO: 9833 - DNA, 263 bp, Homo sapiens
tttgttttttgagacagagtctcactctatcgcccaggctggagtgcagtggcgcggtctcagctcactgcaagctctacctcccgggttcacgccattctcctgcctcagcctcccgagtagctgggactacaggcgcccaccaccacgcccagctgatttttttgtatttttagtagaagtggggtttcaccatgttagccaggatggtctcgatctcctgacctcgtgatccgcctgccttggcctcccaaagtgctggg

SEQ ID NO: 9834 - DNA, 5775 bp, Homo sapiens
gccacgcgatccactgggcttctgggcacagaagtgcctcaacaggcacaggcaggctccccacagccacaaggaaccctgctgccaaggaagcagctcctgttggggtcatcagatttttaatctggctcagcaaagccatggctgtccagccttaaaaaaatgggtgatgtgggagaaatggagggtgtgtgaagagcacagctgggcctcgagaactcagggccagccttcccagcttgggtcctgtttcggagcccaggccttgcttccccttagccgccccagccagattcttttgcgccccctgctggcacacacaaagacagacccaggagcgcacatgtgaacgtgcgcatgcttgctgccagttacccagttcatgaacacgtgaagccttgacttcaggttaagtaataaaaatttattgagaattcctgggttggtgtttatctcctcccagccttgagggagggaacaacactgtaggaaatcactgagaaatcacgcactgtccccaacagccccagttaacacagggaggaggaaagtaattccccagaaaaggggctagtcttcagtcttccttaatccaagaggggttcagggaaccggtgtgggggaccatcgcatgatactggggcggggtagggctgtgctggacccctggctggctcctcaaaaactggagaagcagatccacttcctctgggggtggagttcttggtgactaggctcatttcttacccttgatgaggctgtcactgtaggaaaaaaaagatagataatgacattattaggggacataaatgtgagaggcaggacactctaggccattccctctacgaccctcctaccctgattgagggtttgtcttcggggaggtgggaaagggggtagggtaggaggcgggtactggagaaggtggcctgcaggaccccacagaagcaacaacagcttaccttcccctgtggtgccagatcgccagatgaacaagaaacagagaagagaaatgcacatgttaattgacagcttcaggccccactcagctttgaaccctcctttgctcccaagagaaaagataaacagggttgacagccaggaatctcaggctcatgaaaggaggaggcatgttctcatggccactgctatttctcatctcctttcctaacatccctccattcaccagaggagtttgagggctcttgagtaagaaaactgagtatcatctttcatcactttttggttagatgaaaactttataattaaagtgctttttatgtgaataatcctatttgatctcataaaatcaatcctatgagatgcaagatagaaactgtcaaccacccccttttctaattttggttcaatgtctctgagccatatgaatagctgtagcaggctccagagcccaaacaaccagactcaggtcccacgttcttggtgataccccacagtgtggccacatctctcacctggtgaaactttcatcctgtaggttcagcacaaggttgtcagctgtgagatagatacgattctgtgatgtggcgatctacagggcaggaaataagacagatgcttgcattaagcaaagacctcaattccgacccctgcaattcagcagctacttaacatggaacacatgcagattagggcaggggtgcagcaatgagtaacacatggtttctgctcgcacttagggatccagagcgctgagcagcagctatgattagaacaaaaggtcagggaacccagaggaatcattcttgacaggaggagtatcggagaagccaattttttatttatttatttttgagacggagtcttgctctgttgctcaggctggagtgcagtggcatgatctcagctcactgcaacttccgcctcctgggttcaagtgattctcctgcctcagcctcctgcgtagctgggaatatagctaaacgccaccacagcgggctcattatcttttgtatttttagtagagatggggtttcaccatgttggccaggctggtctcgaactcctgacctcaggtgatccacccaccttggcctcccaaagtgcggggattacatgcgtgagccaccgcgccggccagagaagccaatctgagtagaaaccggaacaagcaaggttcgaattccctcacctcaatgtgccttaactgaaagcactttctcaaggcagccccatcagagacgctgggctgacacactcaccgtcttggagatattctgggctgctcgaatcttgcgaagtttgatgtagccagggttcttgctcagtgcttctccaaggtgaggagggttaaggtacacgcaagggcaggtctcaatccctggccctgtccttaccacactcccttgctccagtcctcctctgggctgtcagatccaaggttgcgctcaggtggcttgtgcccagccctaccgtggaccccacctgtgggcctccctgcaggctgctgccaggaactaggggcagcaccagaaatgaaggcaaggccaccaatgctattgatctggccttacagtggggagtcatggctcaggtactaccactaagatttcagatctcatctgtagtccccacccccaacaaggagccaagggccagagagcacggagtcgcattcgccttagtctcatcagcctgcccatgaaggagaatggggaactcaggtgccctaggggctgggctgagatctctccagcagaaggatatcatcttggcagcctcggcctcaccctcggcctgcacaattttctgccgctgttcctgctttgctttttctaccaagaattgggcccgctgggcctcctgctgggctgtggtgggagagagtcagggagaccctgtcctgggtcaggagccccacccatggagtctttcctcctcctgcatctcagaagccctcaccccacggctcttgcgactcacccacttgtttggcttctacagcagctgtgtactctcggctaaagctcagctctgtgatggccacatcatccaggatgaggctgaagtccttggccctctctgtcagctcccggcggatcaacagggatacctgagggcaggggtgaagaggggaagggaggggtggtttgaggggactggggagctgaaaggaaggttgcgacccctaacccttcactctcaatacaacatgcactgccttagcttcctgtcaggcaaacctgtaacataagcctctctgctcgaagaggtgcaggaaaagccaagacttggccattttcctctgtgcttcctaacaccgagtgctatcgagttctaatgctggctctccttatttcacagtggcaattagcacagcttttaggtggaaatggcactagggtgacaatgcttttctaataagctgcctttcctaattcccaatactctgggcctaggaaggaaaggctgacaccacgcagatggtggtgggagtcagacctgggcccgctgggtgatcagctgtgaggcattgaacttggccaccacactcttgagcacctcgttgacaatggacggcaacactcgttcctcgtagtccagccctaggcgctggtacatgctaggaagctcctgagcattgggtcgagacaacactcgcagggagatattcaccatctgtaggtctgagattgaggtcagcagtggctggtcaaggccaaacaccctttcccaagcattttctccttcatgttcctccctgtatgccctgtgcaatggtgtacagcctggcactaccctggggggaggagagttaatcaggctgacaaggaagacaagacgcagcacagctgaaatgcaccctcacccactgtgaagccttgaactgcaaaccccgtcaccagcagagctgactactctttccccctctgtactctgtgcaacctctaacgtgggcgctttcgtgctgtaccgtaatcatgtctcctgtaaggacttgggggacaagaattgtgtttaatgaatcttttattcccagggcccagtctagtaaatgaataagcgacctgcactaggtatagcacaaagaagtacattacaggttacaggtgagctacctgacccagggtgtatatgtgtgcgtgggtggggaggaggaagaggtctggggaactcaaaggcacggcttttatgtatggtctagaaggagagaacaggtgaactagtcaagcttagggacaaacttctccagaacagagtgtactagtggatgtaactgtagatatagtaagtcaagcagttagaaaaaaaaggctttaaaacaaagctttgatctaggcagtgaacaagacgagggacaaacaatactcttattgaatacacgtcagggaggagacagtaaaaagcacgcaaacacagtgtgttcagaatttgctgctttgaccccaggaggcaggtatttttgttacagctcttgcagatgtggaaagaggcctaaaggcctgacactaccatattcccctggggtttcttgccagctaccttgatcatcccacctgccatgtgattaccaagtgctcagacctacctttggagcctgtaggggaggagatttttcgaggtctggcccgaatgtcatagataatggggtactggaaccaagggatcctggagaggacagggataggtattaagaggccacagtttcggccgggcgcggtggctcacgcctgtaatcccagcactttgggaggccgaggcgggcggatcatttgaggtcaggagttcgagaccagcttgatctacatagtgaaaccccgtctctactaaaatacaaaaattagccgggcgtggtggcgggcgcctgtaatcccagctactcgtgaggctgaggcaggagaatcgcttgaaatcaggaggcggaggttgcagtgagccgagatcgcgccactgcactccagcctgggcgacagagcaagactccctctccaaaaaaaaaaaaagaaaaggccgcagtttcactagccttgcccggtttcccctcaccacgcgttttttggcctgctcctctccacgaccacagacaaggagagattctcttgtccctctggaaaacaacagtttgtatgctgctggaggttctcgcagcacccactatcctaggggcagggatgaggagggtgggaaaagagcagcgttgaatcctgttgcacgtccgactatagccactgctgggtcggcgtcaagggtgaaaggtcagggtcagcaggctctgcccgccattacctgaagtgaaggccctcggccaggatagtgtcctgctgcactccaccgatccgattgaagaagatggctctgtgcccgccttccactgtggggagatgggtggtgatcaggccaggccgctgctcagaggaaatgctaggcccgtggaggggcgcggggacagggcaaggggtttgggggagggactggaagcgtccggcgagcaggcggaggttgctcaccggtgaacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccg

SEQ ID NO: 9835 - DNA, 738 bp, Homo sapiens
ccaaataccattattgattgattgattgactgactgagacaaggcctcactcctgttgcccaggctggtgcagtgatgtgatcatggctcactgcagccttgacttctggggctctggtgcatcctctcacttcagtcccctgagtagctgggactacagacacatgctaccatgcccagctaatgcaaatatcatttttaaaaggcgactgaactggacgcctcatatgagctcccatggctgcccagacatgctttcatgtcagtgattatataattttttttgtaaattagcttatgcaaataatcttgtggaccctaacttatacatgcttctgcaaagaaacatgtttaacgataaagttatactggaattcaaaacatgatgttttatggaatgtaagacattggggtatagataaaaagtggttggaaaaaatatatatatttatttttagagatgaggtctccttctgtcatctaggttggaatgcagtggcatcatcatagttcactgcagtctcaaattcctgggctcaaatgatcctcccaccttggtctcctgaatagctgggactacaggtgcatgccatcatgcctggctaattaaaaacaaaatttatttatttatttttgagacagaatcttgctcttttgcccatgctggagtgtagaggtatgatcttggctcaatgcagcctcaacgtcctgagttgagcggaggaccccgggctccag

SEQ ID NO: 9836 - DNA, 663 bp, Homo sapiens
tttttaattatactttaagttctagggtacatgtgcacaacgtgcaggtttgttacatatgtatacatgtgccatgttggtgtgcttcacccattaactcgtcatttagcattaggtatatctcctaatgctatccctccccactacccccaccccacgacaggccccggtgtgtgatgttccccttcctgtgtccatgtgttctcattgttcaattctcacctatgagtgagaacatgcggtgtttggttttctgaccttgtgatagtttgctcagaatgatggtttccagcttcatccatgtacctacaaaggacatgaactcatccttttttatggctgcatagtattccatgttgtatatgtgccacattttcttaatccagtctgtcactgatggacatttgggttggttccaagtctttgctattgtgaagagtggcacaatgaacatacgtgtgcatatgtctttatagcagcatgatttatattcctttgggtatatatccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttc

SEQ ID NO: 9837 - DNA, 219 bp, Homo sapiens
ttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactacgcccggctaatttttgtatttttagtagagacggggtttcaccgtgttagccgggatggtctcgatctcc

SEQ ID NO: 9838 - DNA, 1641 bp, Homo sapiens
tttcctgtaaatattgcatagactttagtccagattttagtacgttatcttgtgtaataaatttctaccttttataaattaacttttggtatttagaaatatatattttggcgtgaagtctattctatgatatttcctagcttactatcttcctcatggagaaatagaaaacacaaataatccttagttgaaatataaacattttagttttagtgaagtgtaccattaccaacttgtaatggtgttacaagtcatcattctgtatacactagcgtgacccaaaatgctccacagtctaggtaaactacaggaagtaagcttaaggttatttaacttccaaaccccagatctctgctctgatggtcacttgaaattctacaatttcaaacacctctgaagacattcagttaaggcctctggcctctagatggccctctatcttttgggaatgccttaaagtccatttcatgagggaaagttgaagccagtgatctttctgggatagcacaagttaccctgtatctttgctcaaggaattctttctgtaggcttcctagaggataccagaattaaatttttctcccctttgaagagtctctccaaagcaaggagtaatacctgtattacttttgcccacccatgaagggcacttgattttatttcaagccctggcttttagacgtaccttagcattttgtgagttgtaattaaaatcccaacctcttcctaggaatacaaccataatctcctaaactctgtcctcacctccaacacagtccttttggctttcaagaactatccacaatcaggctcagatgtgcttttcctttgttatgtaatcagatgaatctgaaagtggaaagttacatgtattaaagtgaggagatgggtagaggaaggtggaaatgaagaaaaagaacaaatctgaaaggaatcagagaaactgtattctgatactattgtttagatttctaaaggaaatggaaagatgtttggcaatgagagaagtcagttatgatttttagaagatggttgttttcttcagcatttaaaactgtttttgctttgatataattttgaagacgattataaagcttgggaccttcgtaaaagtgaactttataagccagaacgaacttaccacccccctactgtgaaatttggaaattcaactacattccaggatgactttgttcctcaggagataaagcctaggcaaagctttaaacccttctctgtggtcaaacgttctacagccccttttaatggtattacaagtaatcgccttgattatatacctcatcagcttgaactcaagtttgaaaggccaaaagaagtttacaaaccaactgaccaacgctttgaggatttcacaactcaccggtatgacttttggggtcttatttggtgaaactgcaaaactctgcagacctgtacacaccagagtgacccagaatgctcggtttgaaggaagcactgaattccgtgaaagttttcaaccatgggaaatcccacgaccggaggtcaagaaagtaccagagtatgtgcctcctacaggtagcatgctgttaaacagcacaagccatcttgactatgttccgtatcaggccaaccgtgttgttcccatcaggccagtttctc

SEQ ID NO: 9839 - DNA, 1600 bp, Homo sapiens
tgttctatgagcctcttgtctgcctcatttttaaagtgtctttatcataaatcgttatttttaacaaatatgtttctgaatcgattgaaactattatatgggttttggcttataattattaatacggtgaattatacaaggcaaccaactaggagttaggatctgcttcacagctgtttacccaggtaaattatctcagggccaagcatagtttggaatcactaggcttaactctccaggtttcccttgtctcccaaagatttctcagcctgcggcaagttttttgatacatctatgatttttaaaaatattgtatcttctttattctcagcagcagggtaggtaggagttacctagtccattgttatcaaatggaactgataacagttccattgataacacaaggcccacaaatcaaaagatataaagagttatatagtgagaagctctttataccttttgatttgtgggccttgtgaatgcctcacttatataaaaataaagataatgtgaaaccatttgaaaactggaatgaaatgaatatattcctagaacaatataaatgataaggattgagtcataaagcaaattaaaaaaaaaaaaaaaatgagactgaaagaaggtgaattggtaaccaaaagccttctcccaaaagacaccaggcacagatggttttacacaaaagcttcatttcagagaatagaaaaatatacaaattatttcggagaatataaaaagaaaaaaaatccaatttattttacaaaatgtattagttaggttttgcttcactcatgtcatgtaacaaataatgccaaatctcagtaacttacaacacttctcactccattgtctgtggatctctgtaaccatgtagttatatcaatcaatatagaaaatgtacttaataaaattgaacactcactcatgttaaacaaaacagacctcatatccaactggtactagaaggtaacatgaaaagagacatctttctaaaacctatagcaatcattatggttaatattgaagtatgagagattttccattaaaaccaggatcaaatcaagaatgtccataataatggtttctattcaaattgtcctggttgtgtccttcccagggtaggttgggaggtaggaagatgaagaattctttgatgacattaattttccccattaagcatgaggcaatgttatcagctgaacatgggtgggaagctgtcagaggtttggtaagaagggaaggtattgactaagcatcttgtagagtgggagagcaaacttattcgggaaccatccaaggattgtgagaaaaagttaaatgtccactgtgtttggtgatcatgaatggaagaggaaacctataagagtttatgactttcggctgggcgtggtggctcacgcctgtaatcccaggacttcgggaggccaaggtgagtggatcacgaggccaggaattcaagataagcctgaccaacaaggtgaaacctgtctgtactaaaaatacaaacattagccgagtatggtggcacgtgcctgtagtcccagctactcgagaggctgaggcagaagaattgcttgaacccaggaggcggaggttgcag

SEQ ID NO: 9840 - DNA, 1601 bp, Homo sapiens
tgttctatgagcctcttgtctgcctcatttttaaagtgtctttatcataaatcgttatttttaacaaatatgtttctgaatcgattgaaactattatatgggttttggcttataattattaatacggtgaattatacaaggcaaccaactaggagttaggatctgcttcacagctgtttacccaggtaaattatcacagggccaagcatagtttggaatcactaggcttaactctccaggtttcccttgtctcccaaagatttctcagcctgcggcaagttttttgatacatctatgatttttaaaaatattgtatcttctttattctcagcagcagggtaggtaggagttacctagtccattgttatcaaatggaactgataacagttccattgataacacaaggcccacaaatcaaaagatataaagagttatatagtgagaagctctttataccttttgatttgtgggccttgtgaatgcctcacttatataaaaataaagataatgtgaaaccatttgaaaactggaatgaaatgaatatattcctagaacaatataaatgataaggattgagtcataaagcaaattaaaaaaaaaaaaaacaatgagactgaaagaaggtgaattggtaaccaaaagccttctcccaaaagacaccaggcacagatggttttacacaaaagcttcatttcagagaatagaaaaatatacaaattatttcggagaatataaaaagaaaaaaaatccaatttattttacaaaatgtattagttaggttttgcttcactcatgtcatgtaacaaataatgccaaatctcagtaacttacaacacttctcactccattgtctgtggatctctgtaaccatgtagttatatcaatcaatatagaaaatgtacttaataaaattgaacactcactcatgttaaacaaaacagacctcatatccaactggtactagaaggtaacatgaaaagagacatctttctaaaacctatagcaatcattatagttaatattgaagtatgagagattttccattaaaaccaggatcaaatcaagaatgtccataataatggtttctattcaaattgtcctggttgtgtccttcccagggtaggttgggaggtaggaagatgaagaattctttgatgacattaattttccccattaagcatgaggcaatgttatcagctgaacatgggtgggaagctgtcagaggtttggtaagaagggaaggtattgactaagcatcttgtagagtgggagagcaaacttattcgggaaccatccaaggattgtgagaaaaagttaaatgtccactgtgtttggtgatcatgaatggaagaggaaacctataagagtttatgacttttggctgggcgtggtggctcacgcctgtaatcccaggacttcgggaggccaaggtgagtggatcacgaggccaggaattcaagataagcctgaccaacaaggtgaaacctgtctgtactaaaaatacaaacattagccgagtatggtggcacgtgcctgtagtcccagctattcgagaggctgaggcagaagaattgcttgaacccaggaggcggaggttgcag

SEQ ID NO: 9841 - DNA, 115 bp, Homo sapiens
ttttttttttttttttttgagacggagtctcgctctgtcgcccaggtgggactgcggactgcagtggcgcaatctcggctcactgcaagctccgcttcccgggttcacgccattc

SEQ ID NO: 9842 - DNA, 1437 bp, Homo sapiens
cactattagattcatcatgaatgatctaaaggggttaggataggataggactactaagtagtggattcagagaaacaggtttcacttcaacatctgatggacctttctcacagtaagagtcctccaaagaaggggttggctgcccttaagtgttccccatcattggaaaattcaaacatggcttggctagctgcttggtaaggatgttgcagaaggaagtcaggcagcagattttgattgtcttgatgacttttaaggccacttacattagggagtctttattttctacctttttcaggcagaatctcctcttgagtttacacaatatttatcaagtcttctctggaatggaaggagagaagtcaaagttaaccctgttaaacatattctagacaatcattttactttcttggaaggatttttaggacagagagattcttcccatcttgtgcttgttctaactacattaactattagtactgcattgatggctgacttactgggaagactgcttggaaaaatacaagaagccattgtgggaaagtgtattctccaaaagaattccaaatgaatgaagttgtttggattttgtctgagtgcaggtttatacacacatgcatttatgtatttcctgaatctttttgggatataagtttttccagagaaagctttgctctgtgcataagcagaagagaagaacatgaggaaagcacaagagtgtagggacaagaacctggccatactcaaaaggaactgaaggaagtccacatgactgggcaggaaatggggctgacactgctgttatttggcgtctttctttcctaattgggcagcatagaagagagagagcagcagtcagactctggggggtgggggggggggtcaacactgacccctctgacatcatctggtgggctgggaataatttctgaaatagtgtaaccaaacatgtgcagacaattatgtctgatgacataagcccaccacaaaaactgggcctgaaaatgccacttgaaagagtctctcactttgcattaatttttttttccatgaactgtggttattttatttctgggtctttaatatgcagggtaaatgaatcaaaggctgatcgtgatatgttcttttgatatcagttttaaattgtgccacctgcaggaggctaagcttgttatagtgagatgtatttttagatggtggtattcgatgctaagacatgtgtgtatagagcaggacaatgactgccagcaggagagagagaggaggggagacaagaagagacaaggacaggaatgaaagctttgagccaagaaatgaaaataaacagttcctaaccccaaagctgcagtggaattcccagctgggctctggattgtgtttgattcggtggaggacattttctgggcagcgtttatctgctcccctggctgggctttc

SEQ ID NO: 9843 - DNA, 1732 bp, Homo sapiens
gtggtggtgggtgcctgtaatcccagctactcaggaggctgaggcaggagaattgcctgaacccagaaggtagaggttgcagcgagccgagaatgcactactgcactccagcctgggtgacagagtgagactccatctcaaaaaacaaaaaacaaaaaacaaaaaaaaacccaactttttatgattttagtcttttacaatttattgagacctgtcttttggcctaacatgtggcctactgtggagaatgtttcatgtacacttgagaagaatgtgtatttccactgttgtcaggtggatgcttctgtacgtgtccgtccaaaccccatgtttattaatcttctgtgtagacgtcctgcttactattgaaagtggttcattccagcctccagctatgattagagctaccccttactttctccaattccatcaatggttgcttcacatattttgggactctgtttttgattttggtacatatatatttaaaatcattgtatctccttgttgaattgacccttctgtcaatatataaatagcctctgtccttcattttcttaattattgtcttttttgtggatttttttggagttaactgttttgatttcccttttatttcctgttgcgtatatattttaaaatactttctttgaagataaatttataatattaggattaaacatagaaccctagatttataacagctcccttcctcccttgctgtcgcaggtttcatctttttttttttttttttttgagatggagacttgccctgtagcccaggctggtatacagtggttcaaatgattctcctgcctcagcctcccaagtagctgggattacaggcaaccaacaccacacctggctaatttttgtgtttttagtaaagatgggttttcaccatgttggctaggctggtcttgaactcctgacctcaagaaatctgcccgccttggcctcccaaagtgctgggattacaggcgtcagccacggcgcccggcctgtcacaggtttcacctttacacattgagtgcacggtaacatagacgtacacttatcttttatgcattcatcttttaatttctgtagcaacaaaggtggagttacaaaccaaatacataatcttgttggttttcctggtcgtccctgtattcaccatcgctgaagacctttcacttcatatagctttgagctaatgccgctgtccttttatgtcaatctgcaaggttccctttcgcattcttgtagagcaagtctcaagttccgtttatctgggaatgtcttacttcctccttcattgtgaaggatagttttactgactataaacttcttaaaatttttttttctttaggaactttatcatcccattctcttttgtcttccatggtttctagagaaatcaagagataagctttttctggaaaataaataatcatcccttgtgtgtgatgagtcacttctcttctgctgcttttgggattttctctttatccctcactggtttgattataacatgtcttttgcaaatctcttcatgtttatctgacttgaagttcattatgcttcttggatttgtatattcacatctttcctcaaattttggatgtttttggcttttatttctccaaatattctttcttttcatttcgttctcttttcccttttcggagactcttgtaatgtgtaggctgatcagcccgatgatgttccacagaccctcaagtttcggctc

SEQ ID NO: 9844 - DNA, 1376 bp, Homo sapiens
aattcaagaaccagtagacctctggatgaccctggtttcctgtttctgtggaccacaatgctctggggcagtgctgcgtatcagaggttcaagccatggctggagcagccacccctgaagtagacaccctaatatccttcccactgagttcctagttctacatgctggagtgaggctgtcaactctgaagtgtcagagtgtgtctgaaaatgattgctgtgaaaaataaaatatttcacattgcaggcctcatttttaagttatttttcccagagaacattttcatattttagaacttatggtaatgttaacactttctatttgcataagcacttccctgttgggagatactgcaggtgtaagtttttctgaggagtgtcataccaccatggaactattttccatcgatctggagatagggaacttcttgtatactctgagagagaacttctttgagatgtaaactagactgacctactttagaggctgcctgtatcctaattttctattttaaaagagtgatggctgaacactgaaaagctcgggacattttagaactgtgctgcccaatatggtggccactagccatatgtggctatttaagtttaaattgaattaaaataaaatgaagtggaaaaaattaagttcatcaattatattagccacatgtaactgatgactagtggctacctaccatatatagaacatttctattattgcacattattctactggacaatgctgttttaggatgtagaagtcctgatggataatatcaaagccaccttaccacagacagagttttacagagctgtgaagtaattcttactgggaacaccagatacttacttaccattttatatagcgtatgtggcattctctcatcttatcattagagcatgcctgtatctttagcgacaatagcattcaaacaccaaatgttatattgtctgtctggaaatgttttcttatacaactcaaaggggaagagaggaatatgtcgtgagtaaatggaattatttttctctgcaccacatcattataaaaactcgaagaggttgggtgcagtgctcacgcccatgatcccagcactttgggaggccaaggcaggtggatcacttgaggtcaggagatcaagaccagcctggccaacatggtgaaatgctgtctctactaaaaatataaaaattagacgggcatggtggtgggcgcctgtaatcccagctactcgggaggctgagccatgagaatcatttgaacatgggaggcggaggttgcagggagccgaagtcgcgccactgcactccagcctgggtgtcagagtgagactccatctcaaaaaaaaagaaaaaagaaaaaagaaaaactcgaagagg

SEQ ID NO: 9845 - DNA, 915 bp, Homo sapiens
tgaggaacagaatagaggagctgtaagttggggtatagtgtggcaaggtttgtgagagacttaagaacaaagggtgtttatcataggtaattatcacagtgttgttagagtgtaggcagagcagctttctaaccaacattacaagtttattttgctagtgaaaccttttatttaccaatgaagcattagaatttcagagagttaattgtttgtgaactttgttcatggtctttctgaaactttcaactctctgtttagttacaataaggctcattttatagcctttattgtcctcttttgagaagaggcagtataggtagataggaacatgggcttgggatcagatagactgggaatagaaatccatgcctgacgcttggacaaattgtttaaacttctgaatgttaatttcttaaccagtaaaatgggaataataatgcttaccttacaggcaaggggacaatttctttgtgtggaataaaaaaaggaaggtaagctgactcattttcagaaagatctttaaaaattaataaacatgccatattccttaatcttatttatgattacatttggtttatttaagttttaccatgcatatctacttagtgttatcaaactataaggaggaagggctcttggtaaaatcagtgagataatctcagagtctgtgctcttaggaaattaataaaaaaattaaatctgataaaaaagatctgttttaatagcaaattcctttttaagactaattgctgtattatctaaaaggaaacaagctgagtgcagtggcccatgcctgtaatccaaacacttcgggaggctgaagcgggaggattgcttgagctcaggagtctgagaccaccctggtcatcatagcgatatttcatctctatgtttttatgttaaaaaaatagctaa

SEQ ID NO: 9846 - DNA, 20549 bp, Homo sapiens
ggtgtgtcctgctccccaatgacaggttgctcagagactgctgatttccatccctatataaagagagtccctggcatacagagactgctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtgagtacatggtcctagacagaaatcaggattctcaaccactgggcagtggggtaaggcgagaaggggctgggggtatgcacaagctggagagcttctccaaagcttgaggtcaccatttacccttgcatggtgagcatgttgtcctatgagaaaataattcagtgaattttggagtgggcacctagtccttcctaaatcacagaattgggctggaacaggggatttgtggagcaaacctgtccctcctgccatttggaagcaagaaggggtctatgcaaagggcaggtccctattacacttggtgtttggaaagaggcggtttgggaagtttgtactactttctgagtttgcccacaacactaacgaatttgggttttccagaaacagttattaataattagaaaagttggaaacaaaaacaaaaactttgacataaaaatagcagtagttgaatcttatatttgagtttgtgtatattcttttaataggaaaccttaaaatttttttaacaaatatgtcaaggacttagccttcaagaatgcttactgagcatcaccacattagtaactggcagcgtcttggagagaactcagcacgtgaccttcgaatgcaatatcttccactccagatctgttctgccttccgtccttgtcttcctgtctttcctagagtaccttctcaactagtaacttcagcaacatctctagcttctttccctccttgtttaactttttaacaaaagcatagcatacatgcaccagattacacatattctggatgtgcaccctgatgaatttcacaaagcaatcacagccaggtaaatagcctgcagattcagagagaaagcatcaccagcgccagaagtgcatgctgcactccagccactaccctggtaagcacttgctggacttctaacacacagattcattttgcctgatcctgtactttatataaatgaaatcatacagtgggtcctatattggatctgacttctttgctccacgttacattggcttagttacccaaagctgattgctcaaatgagaacctgacttcccattcccagtgtggcttaactcaaattcctatcatttctcaccaggattactgtaattcaactcactgtctctgcttgccccattgaaaactcctgatctttttttaaaatgtacttttggtgatttaactcctaactctccttcttatgagcatcgttgtcaaggcccctggcaagctcaatgttgctctcagcctctgctaccctgatggcttgggtcccctctgctgtagacacagcctgtcacactcattttctccaaacatcaaaattgttaaaatgatggtcatattgttgtctcttcctagaatgtctgtcctcaaatcttgttggtgaactttcaaagttcctttgaattctccttgatcctctgcagccataattatgccctttacttttcacttatgagcttatagcagttggtacaaatatgtcttgcagctttttaaaatgtactattttgttcagtttttttttttaatgtctggttcctcaaagaaattgcattccaaggttgaattttaccctcctgtgtgtcttcatgcctgacaggatgtctagaaagtaatagaggcttaagaaatgttttagataaatgaatgaatgcatgagtgagtgaataaggagatatgtcgagggaaattacgactttcattcagaaagccagggtttgagtttctgctctaacatttactagatttgtcaagacatttagcttttctgagtatcagttccatgatctttaaaattatctttagataataatgataactgataaaccaatctcaaaagttggtacaaggcacaaacaagtgaatgttcatgtatttttgtcataaaagataaattattattaatagttataattaatacttttatataataacctctcagtttaagtaagtaaaacaaaagttaattgaaatgcttacatgatagtgtaggttgtattttcctgtaagagagatttctagataatggaggaaaactatttttttggttgtaagaattaaagaaagaggaaagaaacacaaaaggtggctccacagtcaaggacaggtttattttagagaaaaaaaacctgagaggggcttctggctgagttaagtcagagcccactctcttacagactaagagttttaaggatttggcgtgggagggtttattagagacttggactgcttctgtttctctttgttgtgcttatctgggagggagagttgtgtgtctgttcccgtacatcttcctgcagctgcaggcatacccaccctgaatctgcttttagcttccctatcttagaacactaaagagaaactaatgtgcttatttaggcccactgttttactgggacccattgtatgacagtgaagtttggcagttacctaaaagacttcccctcaacctccctctgtgctcaagctgtcttgtctgtgttttactgtctgctctttctggctgcttgtggttagaagataagtgatttccttgaaatgcatgaggctagaaagggagctggaacttaaagtggtggtgtttgtctgagatgatggtgttcttgatctgtcagtggtaattaaaggtttaaattcacattgaaatttaaattttaatatatatttttatatattatatttaaaattaaaatttactattctggctaaagatgctcctaaaatatattatttactttcctggcttttaaactgttttgaaattctattcagaaagactgaatagaattaaaaataatgagcatcagatctgggctgtaatatgatcactcatgtatgttaacactattgtaaataaattactccttgtctaagatattaattatgcctctaaattctattccttcccttttgttattcttccatcccttctaaatatactcctcaaaattgttagcagttttgtgccactggccaggaccctgtcttactttctccagtttatctgccactatatcacatcaccacacttcttaggtaattatgttttgttttgttttcgggttataatgagtgtcactcaaactgcctcccagcatgatggattataaatagggaggtgatataatgcctcactgtccaatcatagagacatctgagagtgaaagggggcactaaaactcactcacagatactgtttcatctaccataaaccaaaactgttccaggcacaccagcctggaggcttctctacttataaagactctaggctttggagtctaggcatgtaccctagctctacttttctctagccttatgatcttcagcaagtgtttaacctttcttggcttcaattcttccactaaaaaccagataataattccttccccatgggttatttaagggttgaaagctttaaccatattaccttgggtgatgtatggtgaggccagatacagattaatagagacaagaaagaggtttgcacgggttcattctcctagaatgcaggcaggcaggtgtatgacgcacaggcccatccttctagaatgcagactggcaggtgtatgttgcaaaggtccatcttcctagaatgcaggcaggcaagtgtgtaacgcatagatccatccttctagaatgcaggcaggtgggtgtataacgcacaagcccatcctcctagaacgcaggcaggcaggtgtgtaatgcatagaccccatcctcctaaaatgcaggcaggtggttgtgtaatgcatagaccccatcctcctaaaatgcaggcaggtgggtgtgtaacgcatagaccccatcctcctaaaatgcaggcaggcaggtatgtaacacatgcaagagacatgttttcttctctgagaaaacaaaatgaccccagagtaaagaccaaggatattagcaattggaggttttcctatgaataaaccagtttacctctctgtctctctgtagtgaaaccctcttttggaccagcccctcccttcatcacagaaattccattctgctattttgtgccatactgaaatttgaatgaacaaataaaaacatcaaaagaagaggcagacaccaaaacaaatacacagagagtatgtaggaagaagaaaacgtccaaaaaaatctataactagtaattgcagagagataagagaaagaattgcatacatgaaacaagaatagaatgcctggaaaggaatagtcagaatatggaagcatctggggaatgaaaaatggggtttctaaaattaaaatcttaatagaaagacgaaaagttaaagtcttaaccaaaatgagaccaaaaaatcaggatagacgtaggaaggaagatgatgataagaaaatagtggttaaatttagaaactccaatgttccagtaatagaagttccagaaagatgaaaaagtaaaaattgagacaaggggtgaataagcaaatagtaaaagaagatttttctttataacataaagagctatgatttgagattgaggccttccaggtggccagacagtgaatagagagagattcctaggacacccggtcttgaaattccaaaacattaggaagaaaggttctggagagagaaaaagccatgcacttacaaaggagtacaaacgagggtgttatcaggcctctgaacaacagcatttaaaactgagtgaaaatgacttcacctagaatgtgatacctggacaaacaattgatcaccaatgcattttgaggcatacaagtcatcactttaattcctgctttacgtttttttcaggaagcttgtaaagggattctccaaaataagggagtagcccaagagggtgggcgatgcggaatccaggacaaggagtggggatgggaaacgcagagtcaggaggagtgtcattctcaggctggcagctggcccgtggacagtcacgccacatggcaggcatgtggctttatgctttgcaaatcctggtgctgcctcattgtaccctttggtgtctgagcaagtctattcatctgtgtaaccagttccctgcatccctgtttagatcccgaattaaacatatgctattcccattgggtgggattggtgttgggaactagggttaggggaggggaaattaatgagaaagttttatttcttttttttacattgagaaaatactacttttgctattaaaataataatgtatatttgtgaagtggtaaaattcatgtatcaccttgcacaggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgtgctccatgggatggcattcttcttattgctattgctatttttattgttggttcttatatttccttccctcctgggccttcagccaggcctgctgaggaactggaagggaggaaaaactaatcttgcttactctaattgcttttcaagctgtgcacggcattatggcagttttagttccttagggctctcagtaaacaagtttggcaagttagataatagaccttttactgagatgactatcttgtacattgcaatttagcaaatacaagatctatggccttagtttagacactaggtaggaaaattaacacatttgacagctttgtaataaaatatctctgttgggactggactggatccatgactaattttatcagaacctcgtggtgtgtggattagccaaggtggagggctccaagggattccaccatgtagccaggattaagaactgctgaattctaaggctgctgagattcctcgcagttcagttttctgcaggtgtcatgtccatatagcagttcttaaaacttagcaagagcttggaaaacattagctcttcttatatggactgtcatgttgggaaacaggtataatctgttacagtacaattctctgttcttgtttatatgagctgttggagccttgaagtctttcaaagggaaactgcatttataatctgttgaggatgttgctgagacatctctgataccccatctgtgatggtgcggacatggactgtgggggagggacgctgtggatgtgggttggagggtccatctgataagggttaagcaggtagagaagagtcaaggtgtcagatgcaggtgaattaggaagggcctacaagcgtgtaaaaccaaaatggtagtgaagggaggcactttgtcactcacacagggagtctgaggttcaaaagtgaactttgggaaccatactcagagagagaaaaaagaaactgaggaagcagtgtgatggagaccaactggcggggttttctgggtgggtacccagccaatgcccttcctccaagatcagccgtccaggatgtcctcatggtgtgcagagtagggacagtactgcatgtccaggtcaaatctctcaggcttgtgggagaaagtggtataaattagtgaatttagaagcatataagaaaagacactgtcagcagcatggagacaataggaaagcatgaagactgtggagaacgggaagcatcgcgccatattcctatagtgcatgagtggagcgccaactaggaggtttcattgatttttgtgcagcaagagaatttggatgatcctcaaattattaaacatagatcaaaaatctacaattataaatatttgaaaataattagaaatatttttaggcattgtgaggaacaaatgtttatagatgcctatctggcccataagctgctgattttccacctctggcttaatgggtcagggatgggtctatgtgttgagtggatgaagagagctgttttagggcctcactacctctccaagtttggtaatttgctagaaggacttccaacactcaatagccagctatgctcacgtctagggtttattagaataaaggatacagaacagaaacagcagggtaaagacatatatcaccagagtccagagagtccagacacaggctctgagtccttctccatcccaggcctcataggttgtactttctctctagcagtgaactatagggacatatttggaatgtctttgcacaggaaggtccatttgagtcttagggtctgaggctttatacagggctagtcatttatgcacatgctgctatgtaaccagctattggaactgaaactcaggaccccaacaacgcaaccaaggaaatcatggatcttgttaaacaatcctgagaagtcttgacaagttgattcaacatgccccattgctccaggtttatacacctcaccaatgatatatagaatattgtagctaccatatgtgcagggattggccaagattccaccatggttccaggttttcctggaaagatgtagggactgagcaaacagatctgctccattaaatctctcttcccaagagctttggcaaggaaaagctgaggacaggaggatagttatcatggacacatagcaaaagttggaaaggcggcagaatatagcaattgacttacagatcctcagatgacttggaaatcaactaggtctgtctttagtataactgataaggctgtatgtttttggttttgaacttaatttctggtctgtttggagatcaggtgctcagttacttgccttttcacaatgtgatatgccattaggaatttatttgagatcaatttttagaacgttttgagttgttttaaattatggacagttgccttattctggctccagtttatgctagatattttgagggcgtatgttacatacggataaaataaaattagcccaaaataggagttaaaatgactctttttataatattagaggatagttgcttaaagagtttttggaatttccagcttctataatttgaaagtaattttaagaaaaagagtcgactcttaaaaagtcacaaaactaggaaaactcagacttaatcaactgcaaggagtgactcagccattgagaatatctgtacttaagagataagtggatagcatgaaggagcagaggaaattggagggataataagataggtggagtagaaactagtgtgacagaaaccaaagcaaaggtaattgtgaacacttgctgtgctcccaaaacgacacgctgtcacagctcttcacataccatgttgcaaggaggggtctgtttacactttattcccacaccaggcttccctttctcttggttttcttggcatctaacacagttgtctctgacatcacatagaatgtctctagatatttagatgatgagacaactgtcaagaagatgtccagaagaagcggatgaacttagcaaaaatactagggatcttcaacagagcaattttatctgtgtgatggaaagaaaaagaagtaaatttataattgttcataaataagtctagaggcatccaaatatatctacctgcctcagaaattacataatttgtatgcaggaataaatgaaaaacctcatttaaatatatcagtaagtgctcacacacatacatgtgtagagttttcaaataatcaactaagtatttgcatcattattttacatatatatttagtttttcaggtttgacacaagaagaaagtaaaattcatatctcaatgagttttgtgggtataaggaaaagtgtctttttaaaaatttaaacaagatatattttatcacaagagatctaaatagcccaaggggcttggtccttggatagaaaagtttaaacatgatcattttccctcaggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcgctttcaagataaattctgtcattaatcgtttcaacgtggaagaggacatgacggaacagatcaaagcactaaaccctgtccgctggaaagtaagtacacaaggtcgcttttgctgatttccttcaagaaaactttcaggaatgacttttttcaatgaaactgaaaacaatactgatacaagagaactctggacctcgcaagccagtccagaagtcaggtccttggtctttcagctctgttagacttaaaactatacttttctttgtcttagacataaaactagacttttctttgccttacttcccttttctgaaaacatgatatgatttcctttggaaatattgtgaggataaacataaaaaaatatgctcagtgctttgaaatgtttggaagaatatgttcatagaaagcctaaatttatttttaaaactcttggcttatggatggacagataccggttcctcataaattctgatgcagtgaatttctagaagacattagggttaaagtcttccccaagttgtagcaaaatgggacctttattcccagattcatgctttagggctggccccactaccagctactaaaagccaactccacatatgcagctcccactctgtgcagacatcatgactaaaatcccagttttctacctttgactgctcgtcagaagcaaatcaggaggctgtttaaaaagcagcttcttgggcctcatatctgctgccctgaaacagggcctgtggtgaaggtaagcatagcagggagggcttgcacaaacgtgtatttctaacaagcagtccaggtgcaatgaaagataagatgcagagctcagtgctagcacaaacacacaaaaagagatgtgggaaaagtcacatgatagaaagctatgtgtgctaccatatcgtgaaatggcaaaacaggctgagcttaagtggaaggcttcatataggaggaagcatttggctatgctctgaaaaatggaaagaattttcgtaggtggcaaagacctgaagaagaaaggcacatccagactagagggctttgcctgcacaaaaaacagcttttccttcaaagctgccttggctgtttttttaaatcccatgtcagcattccaaatagagttagggaagagggaaagggatattctatcattttcctgaagctgtcctgtaatatgtggaaatgggttaggggaagctggagatgctactttcaaaaattgctaataggtatgttgaacttgaacttttggttacatatataaggatatgaattatcagccacattcccaggtctagaaggaactggagaaaagctaaagagagaggtctgataggaaaaacagggacatgatccaccaggaaggcagaggctccagctggagggctaagctgccttagacatgttgactttcctgcctgcccctctcctgtacccacctctctcgtcttccctatgtttcctgttactgtcttcctcattgttctcttttggtgtccttttttcagatgtgtaaatattttttccccacagcttggttttctcctatctcatggcctttctctcagatattttgactcccacactggcttccattcatctgattcactgtagatttgccatcaagatcctgactcttttggtggaaggctagtttctgcctgtttggaaaaccagattattgatgtatgcaggcttccaattgatgtaaattgatgcttctggaacaggtgcctgttcttagtccaatcttacattgcactcagaacctagtttcctgaggctgcctcctccactgtgaggctgtgggctggaaggtgtcaccagccgtgtccccgggacaacagcaatgagcatgcgtgattactcactgggaggctttgttgtgacctgtaggcttgctccagcagcatgggaggagagggctccttctactcccccatgcccaatcccacaccctcaatattgttccccttccagctcctacggcttgcttttctcctgcagaagcccttccagtctagctggctgattctggagtcaaagtccctggaaaaaaatgcctgtgctgtatgtcttctttgatagtcaagtctgctcatgattcaaacctacatggaagggcactccctccctgccaggcctctccttaccctgagcctggatggggcatgaggatgggtgacaacccctcccaagatgctcacagtctattaaggaagacaccatgaaagcaaatagcaaaattatcctatgaccaggggccagtggaggcagatatcaaaagaccgagaagcaaaaaagaagaggaaaaataaagagtgagcaaaaaaggcaacatgaagtgttgacaatttcttctcatctgactatagtggcatctgagtggttcagacgatgatattagtgaaattctgtgtagaatcatcctttccatggaaaccctttagatctgggtttgtcctgcctctgtgttgggttggctgtcaccctttgtcaccttgggcaagtctcttcacttcttgccttttctaggactgacttttattttcaaatgatggtagtatgtatagaataatacactgtccacactcttacacacacatttgtttacttaaaagactgttgaaagagaatattaatgattttgaaaaactgttcttaggtcttacatgaaaaacagacatatgctagaggccttcataagaatatattaaaaatcagcagagaaaacaatgtttttaaaatgtgtttttctgggttatgggattacacatgatttatttttatgctcttttatagtttatattttttcaataagtacctattattttgttgtctgaaaatttatgactcaatcaaacataatctagacaagtttttgaaagtttatattttaataatgtttgtgcttctgacaccatattcctaaatttcagggctagctttcatttccccaaagtaatatctttctagaatgttcctcagctcgtagagtctctttgctcagaagagatgaagcttgaaaagggggagtgaggtttgggggaaaacacgatggaaagctctctgcaaagcaaacactaccattgcctttcaggtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaaggttgtataaagcaaaagttgttttctttgtcatcatacattcagattgattcccaaaagggaagtctctcagccaaggaccccacacattgttattttagagggttcggtggtgagaaatgggaggaatgccatgtcagggcagatagggctgagggctgccattgactctgccacctcccagctgcagggtctttagagagcttcagtttctctatccacgatggatagagtggtactttgcagatgatacaactgtatatagattcatgtagatattcttgctatatgattcatataagtataatgtccctatgtgtcatacatgcatgacataacccctaaacatagaaagaactaacgaacgccactctgttgatatcaacattatcactttatttagttgaataatctctatgtataattttgttatgttgcacagaatgtagaagaaatgtttcccatttagttttctaatgtaatgacaattggatccatcctattagcacaaatttcatacaccgataaaacaaggttggccaaaacatgtctacactgtggagcttcaggtataactagaagccgggtatctaaaaatgtgttctcagaagctacaggaaaaaaaatccattaataaggaacctccttattaatgaaagatacaaactttaaaaaaattatgatagtataattgaatccataaaattaaaaatatgtcacacatatcataaaattaaaagtgaaatatgttaacatgatatactgaattgtataaaataaagtattatatataaagttatttaaatcaataagaatctatgaacaccaaaaaaagcaaaacatccaatgggcataaatagataatttacagaaaaaaaacaaatggtgaataaacattttaagagtatttgatattgtctatattcaaggaaatacaaaataaaatatgaagcataaagttgcagtaagagaggcaagttcatattgttagcaagagtataaattattgcaactttcctagaaaacgaattgctaactttataacctttaaaatagcccatatttgaatttagaaattctaccttaaaacaagagaaatattcacagaactagagaagtacttatgtaaagatatgttactgcagtattaagaataataccggccgggcgcggtggctcacgcctgtaatcccagcactttggggggctgagatgggcggatcacgaggtcaggaaatcgagaccatcctggctaacacagtgaaaccccatctctactgaaaatacaaaaaattagccgggcgtggttgcgggcgcctgtagtcccagctactcgagaggctgaggcaggagaatggtgtgaacccgggaggcggagcttgcaatgagcggagatcgctcactgcagtccagcctgggcgacagagcgagactctgtctcaaacaaacaaacaaacaaaaagaataataccaaaaaaaaataaagatagcctgtcattcagcatacagagaatgagtaagtctgtaggttcacagaatgaaatgttacactgactaacaagcatattccaaaaatttttaagtgacaaggagaaattctgataatataatagtaggtacagataaaaaacagtatgcaaaattaatttgaagtttaatcctgatgtgtaaaaaaaagtatctctacatattcctttggttatcttggagtagtggaattataagtagttttattcacctttataactttttgaactttaaaattttgtaacttaagtattagttttattattttaaaaacagcttctccatctgccatccaaaaatacatatacaggaaaatctctaccccatatgtttaagtaatgctaggaactcaaagagcagacattcattccttatgctttagacttctgaggctctaggtaaatggttcaagtttaaaaggtaatgttgaagtgaacatgaacaagaaaatctcagaatgaaggacaggatgaccatcaaaaagaagagaaagggggtagaggaggttttcctctatgcactattttatttaattttttaaaactccatcttaatagttaatatgacatcaaagaaaatttggttgagtacctcctttgtaagagggactgttaaccctttgactcattgccattttcactaatgcttcatgagccaggttgtatcatccccattgtatacatcaagaggccgagtggtaggtactcatttacctgacttgtatcaggggcaaaatctgaattttgatgaccccaaagcccacaaaccttttagccagtttgtttcaaacttcatcaaatcacctgggatcttgtgaaagggcagacctctactcagtgggtctgaggttggcccaccactctgcaccttgaactagttcccagatgatgctgatgctactggtaccccactagacattcaatagcaggtctgctcccatcccttcctaggagttggcaaatgctggccccagggatgggtctggcctgccacctgttgtagtacaggatgcaagttaagacttgatgagggaaaacatcaaaacaagaatcgtatttgtgccctgtgaacattatataaaagctggttttctgggtccataaattaagtttcagtggagctcagccaagctatttttcttatgtatcatctgtggtggattttgggctgcaaagcacagttgattagttgtgacagactgtgtggcctgctaagcagaaaatatttgctatctggccctttacagaaaacattttacagacccctatctacaagaataggtatagaaggaataccttcccatcaacagtgcaggtacagcttctatatacctatagaagtcataactgtttgtaagtaatgttagggtaataataaaatcctcaggtaaatcgaccctttagctccaaaaaaatagcattcaagagagttctgctttatacattgaaaagggagaaattagatacatggtggacacagtcatcagaaatatcatgtaaagaagaaaagggctctcccaaagtgtgaagggttggggaaattgccttggggttcaatgtcagggaagccttcaggatgaaggttctgatgtgtgaccttttcagcaaagagcagagaatccaggcctgctgtgatctgttgaaaaccgaatgcacacaaacagagccttgtcttgtgagggccatgccaaaggcaactcaagggaaatgagaaatgctggatccaaaacaatacaatgcaaacactacaggtggacaattgagctcacatactgagaaatgcacctgaaactaaatttgtattaacttctcctttgcagatgaaagactcctaccttattctggatgaatatgtgagtatttccaatgagttataaaattaaaacttaattaattaattagcagtaatggcagagttgagttccatgagcataactatctagtacctatttgtccttcttaattagcacttcacagtttgatagtcagtgattatgattatgccagagccctcacttcacagggtcaaatgtggagctaaacactggaacagaataagcttcaacccaggtcccagcactgatttgcactgagcaccatatgatattgtctgccatgtaactatgcatccgtggatgtcacattgaacccgttatcacacacaacagagtcatctgttatgtagtcctgggctggaggctctcctgagatagggcatccagcctactttgaaggaaggccatatcactcttctcattatcttggacaaaccaggcacagccagcttgtcttctgattgataaaccttggctttcctaaggagaggcttatgtttctgctccaaacaccactgatattattcctacccccactgccttccaaaggaagagggaaacctacccttctcaaaactgaaaaacaaatcactttcccctttcctctgtctttttttttctagatctataaccattgccactcttcctagcaaaggacaaataattccatttgaagacatattttaaagaaatgagctccaacaaccttgaattccatatttaaattggatttgttttttggagaaatacttactgtcacttttgatgtttgcttttctttctttcttttctttttttttctgagataggttttcctgtcacccaggctagagggcaatggcacaatcttggctcactgcagcctcagccacctgggctcaggtgatccttctgcctcagcctcccaggtagctggtactacagatgtgcactaccacacccagctagatttttatgtattttttgtagagattggattttgccatgttgcccatgctggcctctaacacttgggcctccccagatgctgggattccaggtgtgggcccccatgtccagctggtattttgttattttcaagttaaccaatcattgtttatacccatttcatttcttaacaatataagctttcttaatagagcataagggaaaaggtgataaggaaaacatttagtttctgggtccaaggtagagaggaaaattcaaacaatttatttttggagtggaaattattatgattgtctagtgattttgaccagcatccctcaacaaactcactggtctccacatatttggaaaacacatcgttgaaccaaaatttgcttttaccaattgaataacattttgcttcaataagtattacttgagctcctatgaaacactcagtgtaggtcgtaaggagtgtgaagaaatcgtttctgcctacagagtagaataggacagactaaaacaaatgaaaatggatggaataagattaaaacaaagagccttcgcaggtcatggaagactcttcttgatctggcacctgccatggaagactcctcttgatctggcacctgcctgcctcagcagcacctttcttttcatcctctctccgtttctcaaaacaagcctttattaatatttacatatatgcatgcatgcacggatgcatgcacatcattactattccagaaacaccgtctacctccatttccccagtacatcatgctatatcacacttctgtgcttttatgataccattccctccaatttaaaatctcaacacataattcagatgttagcatttggggcaagcctctcctgattaccccttcccccagtggaactacatctgcccatgcggggcgcatatcattctgtttattgtgcgcttaggtgtctactgtacttagcccagcctcttccaccagaccatgagctggttgagtagagagatggggtccaaggggttcaatatcagccacagatttcaaaagatacctgtcgacatgactggaatatcaaaagctatttgggattaatagtctagattgagttttacaggattcatcacatggaaatataccagtttctgttatgaattttctagatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttgcctttatgccattgcagtcttgtactttttactgtgatgtacagaaatagtcaacagatgtttccaagaacatatgatatgataatcctaccaattttcaagaagtctctagaaagagataacacatggaaagacggtgtggtgcagcccagcccacggtggctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacggcacactgggttggcataagatatcctaaaatcacgctggaaccttgggcaaggaagaatgtgagcaagagtagagagagtgcctggatttcatgtcagtgaagccaagtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatttcagtgttcctcactaggtggcatttaaatgtcgcctgatgtcattaagcaccatccaaaaagtctgcttcataatctattttcaagacttggtgattctgaaagttttggtttttgtgactttgtttctcaggaaaaaaaatattcctacttaaattttaagtctataattcaatttaaatatgtgtgtgtctcatccaggataggataggttgtcttctattttccattttacctatttactttttttgtaagaaaagagaaaaatgaattctaaagatgttccccatgggttttgattgtgtctaagctatgatgaccttcatataatcagcataaacataaaacaaattttttacttaacatgagtgcactttactaatcctcatggcacagtggctcacgcctgtaatcccagcacttgggaggacaatgtgggtggatcacgaggtcaggagttcgagaacagcctggccaacatggtgaaaccccgtctccactaaaaatacaaaaattagccaggcatggtggcgtacacttgtaattccagctactcaagaggctgaggcaggaggattgcttgaaccctgaaggcagaggttacagagccaagatagcgccactgcactccagcctggatgacagagcaagactccgtctcaaaaaaaaaaaaaaaaaaaagcaagagagttcaactaagaaaggtcacatatgtgaaagcccaaggacactgtttgatatacagcaggtattcaatcagtgttatttgaaaccaaatctgaatttgaagtttgaatcttctgagttggaatgaatttttttctagctgagggaaactgtatttttctttccccaaagaggaatgtaatgtaaagtgaaataaaactataagctatgttaaataca

SEQ ID NO: 9847 - DNA, 3443 bp, Homo sapiens
tccttttttatggctggatagtattccatggtgtatatgtgccacattgtttttatccagtctatcattcatgggcatttgggttggttccaagtctttgctatttgtgaacagcactgcaataaacatacgtgtgcatgtgtgtttatagtagaatgatttataatcctttgggtatatacccagtaatgggattgctgagtcaaatggtatttctggttctagatccttgaggaatcaccacaatgtcttccacaatggttgaactaatttacaatcccaccaacaatataaaagcattcctgtttctccacatcctctccaacatctgtcatgtcctgactttttaatgattaccattctaacaggcgtgagatggtatttctcattgtggttttgatttgatttgatttctctaatgaccagtgttgttgacctttttttcatatgtttgttggccacataaatgtcttcttctgagaagtgtctgtttatatcctttgcccacttttggatgggtttgtttgtttttttcttgtaaatttgtttaagttccttgtagattctgggtattagccctttgtcaggtggctaaattgcaaaaattttctcccattccataggttgcttgttcactctgatgaaagtttcttttgctgtgcagaagctctttagtttagttagatcccatttgtcaattttggcttttgttgccattgcttttggtgttttagtcatgaagtctttgcccatgcctatgtcctgagtggtattgcctaggttttgttctagggtttttatgattttatgtcttacgtttaagtctttaatccatcttgaataaatttttgtataaggtgtaaggaaggggtccaatttcagttttctgcatatggctagccagttttcccaacacaatttattaaataggaaatcctttccccattgcttatttttgtcaggtttctcaaagatcagatggttgtagatgtgtggcatgatttctgaggcctctgttctgttccattggtctatatatctgttttggtaccagtaccatactgttttggttactgtagccttgtactctagtttgaagtcaggtcgcgtgatgcctccagctttgttctttttgcttaggattgtcttggctctatgggctcttttttggttccaaataaaatttaaagtagtttttcccaattctgtgaagaaagtcgatggtagcttgatggatatagcattgaatccacgaattactttgggcagtatggccattttcactatatcgattcttcctatccatgagcgtggaatgtttttccatttgtttgtgtctctcttgtttccttgagcagtggtttgtagttctccttgaagaggtctttcacatcccttgtaagttgtattcctagatattttattctctttgtagcaattgtgaatgggagttcactcataatttggctctctatttgtctactggtgtagaggaatacttgtgatttttgcacattgattttgtatcctgagactttgccaaagttgcttatcagcttaaaaagattttgggctgagacgatggggttttctaaatatacgatcctgtcatctgccaacagagacaatttgacttcctctcttcctatttcaataccctttatttctttctcttgcctgattgccctggccagaacttccaatactatgctgaataggagtggtgagaaagggcatcattgtcttgtgccagttttcaaagggaatgcttccagcttttggccattcagtatgatattggctgtaggtttgtcataattaactctgattattttgagatacgttccatcaatacctagtttactgagagtttttagtatgaaggggtgttgaattttatcaaagaccttttctgcatctattgagataatcatgtggtttttgtcattggttctatttatgtgatggattacatttattgatttgcgtatgttgaaccagtcttgcatttcagggatgaagccgacttgatcacagtagatcagctctttgatgtgctgctggattcgatttgccagtattttattgaggattttcatatcaatgttcatcagggatattggcctgaaattttctttttttgttgtgtctctgccaggttttggtatcaggatgatgctggcctcataaatgagttagggaggagtccatctttttctattgtttgtaatcatttcagaaagaatgataccagctcctctttgtacctctagtagaattcggctatgcatccatctggtcctgggctttttttttggttggtaggctattaattactgcctcaatttcagaacttgttattggtctattctgggattcgacttcttcctggtttagtcttgggagggtgtatgtgtccaggaatttatccatttcttctagattttctagtttatttgcatagaggtgtttatagtattctctaatggcagtttgtatttctgtgggatcagtggtgctatcccctttatcattttttattgtgcctatttgattcttctctcttttcttctttgttagtctggctagcagtctatctattttgttgatcttttcaaaaaaactagctcctggattcattgatttttttgaagtgcttttcatgtttttatctccttcagttctgctctgatcatagttatttcttgtcttctgctagcttttgaatttatttactcttgcttctccagtttttttaattgtgatgttagggtgtcgattttagatccttctcactttctcctgggggcatttagtgctataaatttccctctaaacactgctttagctgtgtcccagagattctggtatgttgtgtctctgttttcactggtttcaaagaacttatttatttctaccttcatttcgttacttacccagtagtaattcaggagcaggttgttcagttttcatgtagttgtgcggttttgagtgagtttcttaatcctgagttctaatttgattgcactgtggtctgagagattgtttgttatgatttctgttgttttgcatgtggtaaggagtgttttgcttccaattatgtggtcattagaataagtgtgatgtggtgctgagaagaatgtatattctgttgatttggggtggagagttttgtagatgtctattaggtctgctcagtccagagctgagttcaagtcctgaatatccttgttaattttctgtctcattgatctgtctaatgtggacagcagggtgttaaagtctcccactattattgtgtgagagtctaagtctctttgtaggtctctaaaaacttgctttatgaatcaggttgcttctgtattgggtgcatgtatatttaggatagttagctcctcttgttgcatcggtccctttaccattacgtaatgcccttctttgtc

SEQ ID NO: 9848 - DNA, 1564 bp, Homo sapiens
gacagtcatcaacctttgaccaggagggatctagcacaggccagtcttccagctatggccaccgtggctctggctccagtcagtcttctggctatggccgacatggggctggatctggccagtctcctagtcgcggccgacatgggtccggttctgggcactcttccagctacggccaacatgggtctggctccggttggtcttccagcagtggccgacatgggtctggctcaggtcagtcttctggatttggtcaccacgagtctagctcatggcagtcctctggttgcactcagcatggatctggctcaggtcactcctccagctacgaacaacacggctctaggtcaggacagtcatctaggggtgaacgacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacagcccatatgggtctggctcagggtggtcttccagccgtggcccatatgagtctggctccggtcactcttctggcttaggtcaccgagagtctcgctcaggacagtcctctggctacggtcaacatggatctagctcaggtcattcctctacccatgggcaacatggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccactatggtcagcatgggtctggctcccgtcagtcttcgggccacggccgacaagggtctggatctggccagtcccctagccgcggccgacatgggtccggtttggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggtcagtcttccagccacggtcagcatggctctggctcaagtcagtcttctagctatggccaacagggctctggatctggccagtctcctagtcgcggccgacatgggtccggttc

SEQ ID NO: 9849 - DNA, 2179 bp, Homo sapiens
gggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactttccatattgacttatgtatttggtcccaaattatatttaagtcttttttcttgcaacgtagcccattttttgaaagcaaaacatttctgaaattaggtcatggtttttttgtttatttttaggttaggtcacttaatataggaggatgttttctcatgtacttgctatttgcaagttcaggtttcatttggttctttatgttaaatacgaataagtaacctcaaatcaagctaaatgtaattaagaattttcagcaactatattcaagtgtttgatttttaaattctttctttctttttaataagaaagatgacctaaaaatcagtggtatttgtttgtcctcagaagccgtagttgaagaaagatattagagtatacacagaactggagccatacattgtgctaattttttacattaagtacagaagtctgagcacagcatgaatgcttctgcctgacaggaccacaaagcagcagaagttagggataaatggagatagccatgagtagaactgctgtagggcttcaggaggctacgcagacctgatcaactgcaaagtttccaaagtaaaagattaaaaactttcagacggttcttacctctacccgtgtttcacaaatagcctgaggatccaactatttttaaagcaaattggggccagacgtggtgcctcacgcctgcaatctcaccatttgggagacctaggtgggggtggatcacttgaggtcaggagtttgagaccagcctggccaacatggt

SEQ ID NO: 9850 - DNA, 542 bp, Homo sapiens
gctgggcatggtggcatgtggctgtaatcccagctacttgggaggctgaggcaggagagtcacttgaactcaggagccagagactgcagtgagctgagatcgcaccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcagtgtcacgcgtataatcccagcactttgggaggccgagacaggcacatcatctgaggtcaggacttccagaccagcctgtccaacatggtgaaactccgtctctactaaaaatacaaacaattagccaggcatggtggtgtgtgcctgtagtcccacgctacttgggagggtgaggcaggagaattgcttgaacctgggagacagagattgcagtgagccgagatggcgccattgcaccccagcctggcgacaagagcgaaactctgtcgcaagaaaaaa

SEQ ID NO: 9851 - DNA, 651 bp, Homo sapiens
ggactatgggcatgccatcatgcccagctaatttttttattattttagagagggggtttcttgttattttgctaaggctggtcttgagcttctagcctcaagtgatcttcccaccttagcctcccaaagtgctggggttacaggcatgagccactactcagttcttaatgtttctctggctaggattcttcattgtcttattaaatgagtaccaaaaaactgcttttttcctgatgtactcatagacttctgcctttagtaagtagtgtcattatcatattcttgtcattcctccgcagtcaggtagtgccctggaggtttcctccctcctgttaaggtgctctgggtccagcagttgcctcctctcccttctaagttagtaggcgatccttctcctgtcttcaagaaagacccccttctctcatttgggccctctgttgtggactgtcaggaagttttcttaatttgtttgagaatacaaatctgccttgaagtgaagaaaaacagcatgctggtatgtacagtacctagtgtggctttccatcttaagaaacaacacaagcatttgtgtttttcattctaaataaaccctgtgatttctaccacctgagtgaatcaactgctaccaatcatactcttttccttggaaaa

SEQ ID NO: 9852 - DNA, 3837 bp, Homo sapiens
  misc_feature (1307)..(1307): n equals a,t,g, or c
ggggctggactccttggttcctggggacgaagacaaaccctataagtgtcagctgtgccggtcttcgttccgctacaagggcaaccttgccagtcaccgtacagtgcacacaggtaggggaagagagggccctggccttcaagcccacagctgtcctagggcaaagtccctgatctcccatgttctctgcctccaggggaaaagccttaccactgctcaatctgcggagcccgttttaaccggccagcaaacctgaaaacgcacagccgcatccattcgggagagaagccgtataagtgtgagacgtgcggctcgcgctttgtacaggtacggagccagcctccaagtggcttccaaggcaaacctgcaagaggtggggtgggccaatagggagggttctgttcctcccagaggcaggacttgaagtctcctccctcccaggtggcacatctgcgggcgcacgtgctgatccacaccggggagaagccctacccttgccctacctgcggaacccgcttccgccacctgcagaccctcaagagccacgttcgcatccacaccggagagaagccttaccacgtgggtacccaacctggcctgcccactgccttagaattacctctcctttgcctaggggtgggctctgagaggtgcgggcctggctgtccctagatctcttagaaatgagcggtggccggaagagtccaagcaaataaggggtggaggctgggagtcaggatgggcaggtatagaagtgatgctcctgggctgagcactgttttctcagagaggagctgagaagtgggaaaacctttgctaaataaggcggggcctatcccctcagccacccctgaggatttgggaggatgtgagagtcaaagagctgatcttccgctggatagttcccacctgggagagctggacggccgcccggctcaacacctaaaaggtgattgtggatggggcagggcctgacttggctgtcctcccacagtgcgacccctgtggcctgcatttccggcacaagagtcaactgcggctgcatctgcgccagaaacacggagctgctaccaacaccaaagtgcactaccacattctcggggggccctagctgagcgcaggcccaggccccacttgcttcctgcgggtgggaaagctgcaggcccaggccttgcttccctatcaggcttgggcataggggtgtgccaggccactttggtatcagaaattgccaccctcttaatttctcactggggagagcaggggtggcagatcctggctagatctgcctctgttttgctggtcanaccctcttccccacaagccagattgtttctgaggagagagctagctaggggctgggaaaggggagagattggagtcctggtctccctaagggaatagccctccacctgtggcccccattgcattcagtttatctgtaaatataatttattgaggcctttgggtggcaccggggccttcattcgattgcatttcccactcccctcttccacaagtgtgattaaaagtgaccagaaacacagaaggtgagatcacagctctgctggcagagattactagcccttggctctctcgtttggcttgggtattttatattatttctgtcataacttttatctttagaattgttctttctcctgtttgtttgcttgttagtttgtttaaaatggaaaaaggggttctctgtgttctgcccctgtaattctaggtctggaacctttatttgttctagggcagctctgggaacatgcgggattgtggaattgggtcaggaaccctctctggtattctggatgttgtaggttctctagcagtctagaaatggatacagacatttctctgttcttcaagggtgataggaaccattatgttgagcccaaaatggaagtaataataaatgcctcctggaggctgtgggtgtgggggattctgtatctggattccgtatcactccaactggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagcactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgctgcctgctgtgtcctgggttcttgccttgggggactcggggagcgaggaagagagctcttcctcctggataacatcttggattctgtaccattccactgtcccttcccaccagacattttaaatggtcctcgttgtccccttccctgcccttgccttcctgctcattgtgtaggaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagaccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaa

SEQ ID NO: 9853 - DNA, 114 bp, Homo sapiens
tttttgtatttttagtagagacgaggtttcaccatgttggccaggatggtctccatctcttgaccttgtgatccgaccgcctcggcctcccaaagtgctgggattacagtcgtg

SEQ ID NO: 9854 - DNA, 105 bp, Homo sapiens
ttttgtatttttagtagagacacggggtttcaccgtgttagccaggatggtctcaatctcttgacctcgtgatccgcccaccttggcctcccaaagtgctgggat

SEQ ID NO: 9855 - DNA, 2753 bp, Homo sapiens
gcgactccccagcaggaagagcgacggccgttcggccaatagctacgaaggttggctggccgcctcaccaatcacagagcggcattggaagatggggccggggcgtggcggagagaacccaaactccgccccacctgactccgcccccaactggagggaaacaagcgagcgcgcgcgcctccggggtctcctgggaagagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccggggtaaggagagggaccccggggagggcaggactgcagaagatcccttttctttcacgtccagcccgacgatagcaggaggtcagggctcttggttcctccccacacttttctgcaagatcttagagtctgggggtgcagagatgctctttagaggtcacccagtgcatccccccgccttcgggttgctcgacacctccggggtcttgctgcaagagggagctcctaggaagcctgttggactcccgcgctccaggtgtttcacactcaccgcagtgcagaggaaagagccccgggcttctggaggtttgagttccagccccggataattagcagtttgaccttgggcaaagcagtttttctctcagggcttcagtttcctcttccgtacagtgcaagggatggagtagactatctttaaggtcccttccagtgctaacatttgcagtttcaaaaccttttcccggatttccttcatacgtcttatgtgagtcccactgcagtccttcccatgctgtcgtctgaggaagaacagcgaagcttttcgtcctggcaccagggtgatgagcccgcagtgacgtggaagtggcttccaaaggtgccacctcggtggcgattttcccatttccctttggattctccttggcacttcttacttcagactgcagtcactccccttccccagatctcagccgctcctcccaagcccttactgccccccacctccccgcttgctttcttctcatctcttcttactgaccttccttacctccatccacagggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtgagttttaaccacccctttgcccaccaacggggcgtggcttgtaggggagggcaggacttagaaacttctccaagtttcaggtggcgagctgaatccaaagttgtgggaacagaattgttgggttcgattggaatctcagaggggtggggcagtggaggtgggaaagtatgtggaattgagaagacagtgggtttactgtggagtaagctgagttgatctgattcagacttgggtccctggcctcatcctcccttttgggagcttggagtgagacccaagtttaagtaagtagttcgttgagatcatgtgagcttgtactagttgtatagtagtactcagaaggcgttatgaacattgtgattgggctctgactctgaccttaatacatattattgaccaatattaaagagaaaggaggaagaaatcaacatttttttctgcatgtgaggtgtgccagtactttgccatgtaatgttttagtgtttgagataagtattacatccccatttcacagaggaaggaactgagactgagctaggattctcacctagtctgtgactccatgctctttcccccataccaaagtgcctcccaagcagtggttacttagcttaagaggggaaaactgggagggtaccttggccaagtctcagagagggaaagcgtcagggctgcctggaaaatcctgcacaggtgctgttgcaggaatgcagggctcgtgctgaggatcaggctctaggcgggaggaggaaagaggcaggcagagacccagccacactgggccttttgtgccatgtttggacttggccaggaagtgatggagttacggggttttaagcagggaagtgacaggatctgatttgtgtgggtccctccagcagccagcacagaggatgaatagactataagaggtattgcagcattcatgcaactgatgaagctagaatgactccccccagctcctctggctcaggcttggcccctccccaaaccccgtgcacatctccccacccgtagggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 9856 - DNA, 6040 bp, Homo sapiens
ctctgtctctgggaagtatattttatttacatttttaaaatctttaactagtatctcttcctcctttccacccccagagacttgggaagggaaagaacgggaacctcaaacacctactccccacatacaaatacacaccccatggctcacaccagcaaatgaaagtgaaagagaaacaggtccacccctccctctgaagggcccaccaggtctggacaagggtgggagggccctgggctgggtctctaaagagaagaaaaggagaggggagcaagtcagttgaagaggctggaaagtcatccagggccccaccctcctcttccctctgtgccctactgcctctgctggcagacaggggcaggggtcccttcgtcccctcaacaccagacacacaggcaggggctgcagccattaacggtcaggcctttggacacaaaatactttcgctttgtggtctcctgacgtggtcaccaccagggaggcatctctgtaaacagaaagcatgtgattgcagagactgggggacccaagcccaccacctaggggccctagggtgggctcctccagcacaccctcagttctagggccctagtgcctagcactgggccgacatctctgcagccagcatggaggggattagaggaagcccccagcacgggagaagcagagctgactccgatggggaaaatcagtctcagcctctccctcatgactgagacgtggggccccggagggtcactgtcagccactggaatgggggctgggctgtgaaccctcaggcttctctgcattcctgccttaggaatcccttcccacaccccaaggatcctgtgtcccctacatactactgccaccttccaaatacacaaagatcccagcccttggccaattcacttacttgctgagggcaaagtccaggatctcagccgtgtggccccggtagtcagtaagcaggcggccggtccgggcgtcccagaggcgcacgatgccatccaggctgcaggtatataccacggcagtgcctgcctcccacagcagctgcacgatgcccgactgccccgaggaatgacagaggcagggcggaggttggcaggagagctgagagccatctgctcccaattctcaaagagggacagccacacacaagggccaggcaggagccagatctggggtagatgctcctggaggcctgggcttccccaccactatggacacagcccacagggaccccagctccagctgcccatacctggtgctgacactgatgcctaagagtctgcgtagccaggtcatagatggccaaggtcccatccaggtagccaacagctgccaggggcatcctggccagaggagcgtaccatgaagactcatgagggcctggactcacacgccctgccgtcctcccgggcccccagcccaggcccctcccacaaacccctttccccatcctcactcacacactgcagaagcccaaggactccaccgagttggactcactctcctccccttctcccaggctgggctgggaggccacagtctcaggtctaaaaacacccaccacctgaaagccagagaggatcagaggaggacacggaatccgggtgcttgatggagagaaagacggtggggagaggagacagtgaagacccaggaaggaaggagaggagtcgggaaagcggaggccccagccgggctccaggtccactcaccttgccggtggtggcactgaccagcttggcctggcagtccacagagccagttaggatcaagctgccatcctggttggcagcaacacaggtgagtgggccctggtgaccctcagtccctagcatagagcagggaggcagctcaggcttcgtcctacctcccctctgagtcctgccccaggttctcagcccctccctacaaaggcccaggctaacacttcccccacctctgatacctttcagtacatggatagggcttccctgcttcaggtcccaaatcctgatggtcccatcttcatagcctaccacagctctcttccctgaagagaggcacagatgaagagagggcagagggcacgctcacatacactaagcaagggaatggggagagggagaggaaagaagagtggaagggcccagacactgccccaggaatcacaggtgagttcagagcaggaaggaggcgctgtgaactttggggcccaggaggtcagcactgcaaacagcaggcctcagattttgccggctgtgacccagaaggctgctctgggaggtgtatatcccgggattcggcctctgcacccaggaaaggtcactcaagggaggtgctctcaccatcagggaggactcggccacaggtggctgggcagttgggaccctggaaggtcttgcagtcaccattcgggactttccacatccaggtgttgccgtcagctgtgcccgccaacaggacaggtgcccgaggatgccactccatccactggacagggaggaaggggcagcagggaggcccgtcaccccatcccacctagaagcctgccccatgagctccacccaaggtttcctgcctctggggttccgcggggactttccaggtagcaggtagatattcttcctgtgccttggggcgcattggctcagagctggcttggcgcaataaaggcagaactggcctcccaagcttgcacccccaacaacccaaggccccacagagctgactcccgctctgatgatcttacctccaggtctcccgcttcaaaggaccagacctcctccttagtgtccacctgccacactttcaagaggccactcatgtcccctgtggccactagagtggagtcatggctgaaaccagcacaagtcacagagtctttatggccttcaaagaaaagtgggcagaaaacagaggaaaaaaatagggtacctggtgctgggggcatgtgattctggtatctggcccactgaaaggaccagctaggaaaaaaagaggggcgggactgagcagaacaggtgctggaactcaccaccactctaggaaccaatactcccatgtctgctgggagacactgctggccctcactcaaccagaccaagtcccagcctcctatgccttcccccttctgtccactctacacctctgcccgcctgctcctataccaatgtggccttctctggcctttcctggattcccttggccaattagtgcctcctgcctctgtgcccaaaacacactagtattcgccccgtgtccctggggcccagcacagagctggcacaaaagagatgtcactaagtggctgttggatgcacaacctctgcaggtcagcctcctaagatctcccaaaagaatatgacctctcccaggcctctaccccagccccctcacctgcacactcaaagagcagctccccatcgctgagccgccatacgaaggctttgtcatcttcacccccggtcactgccaaggtattggtcttggggtccaggctcacacaaaacacagatgctgtcccaagagatattccatgggtaaggggacagagctcccacctagggctctgtccttcacaatcttcaggaaacccaccccctttcacccaaagcgtgtctttcctcctggaaaacacaggtacatccaagttcttctaagtttcaagaattgggttgttagatccttcccatatttgccaagctccctatttgccagagtagatcccctcactgtgtgactcccgtcaccacccaacaccaatgccatggacaagaggtggggacaggtgcagggcttacagttgtcagcatgggatgccaccggggttgggtacagagcgaggagagcatcacgttaagggttttttgttttttgttttttgttttttgagacagagtcttgctctgtcgcccaggctggagtgcagtggcacaatctcagctcactgcaacctccacctcccaggttcaagcaattctcctgcctcagccccctgagtagctgggattacaggcgcccgccaccacaaccagctaatttttgtatttttagtagagatggggtttcatcatgttggtcaggctggtctcgaactcctaaccttctgatccacccgcctcggcctcccaaagtgctgggattacaggcatgagccaccgtgcctggcaacagtttcttactaagaactagcacttgagaaagttatataaaatatgctcaaaaagatataattatctctcattttattttatttttttgagatggaatcttgctctgtcgcccaggccgaagcgcagtggcacaatctcagctcaatgcaacctctgcctcccaggttcaagtgattctccttcctcagcctccggagtagctgggattacaggcacatgccaccacacccagctaattttttttttatttttagtagagatgaggtttcaccatgtcggccaggctggtcttgaactcccgacctcaggtgatccacccgccttggccttccaaagtgctgtgattacaggcatgagccaccgcacctggccaattatctctaattttatactcactacttttattaacttttatcaaagataactttttttttttttttttttttggagacagactctcattctgttgcccaggctggagtgcaatggcgcagtcttggtccactgcaacctccgcctcccgggttcaagcaattctcctgcctcaacctcccgaggagctgggactacaggcgcccgctaccacgcccagctaatttttgtatttttagtagagacggggtttcaccatattggccaggctggtctggaactcccgaccttgtgatccgcctgcctgggcctcctaaagtgctgggattacaggcgtgagccaccatgcccagccaaatttttgtatttttagtagagactgggttttgccatgttggccaggctggtctcgaactcctgacctcaagtgatccacctgcctcagcctcctaaagtgctgggatttcaggagtgagccaccacgcccggccaaagataactttttaaaagaaaactaagaggttaatcaaggttaactggcaaagtagagggtgtctcgactgatgccagaagccaagcaatcatccattctgccacactttcccacctgtgggctcctccagcgcaaggccagcatcttgcccatctctgtgtcccccataacgttctgtccatggctgatgtttaatgcttacacgcccacctaaactgatttgaggtggatcgcctcaaagacctacctgagtgcaatgcaaaggtgacctcgctatcgtcggggccctccatgctgccgaccaccccttcctggggttctagaacccagccctcttcgttgccctcttcctcctcttcttcctcaaagtccacatcttccatctcctgggccaggtcatctgctttggggagagggttagaagatggggctcgggaggcggtaagaggtacggagagaagcatgaggaggcctgaggctggggcgggtcatgtggcgagaagggaaggtggagtcagacacaccggggtccgcgggggcgcgcgggacacaggacgggaggccacggctggccagagaccgtgcggtaagggagggccaaggggatgatgggaagggggtgtgtgaggggaagggccagaggaggcgtcagggaacccccaccccagccaggcctgagaactaagtgtgagggtgggagtgggggaggaggggaagagggatatcggtaggaatgaccagtcgggtgtggaggggagcggggaaaagcaggagtcagaggccaggggtgagcgtctcctgtcccatggcctgaggagcggcagttctcacctgggtccggcggaccgggatcaagttctaccacctcgataatctcttcatcaccatggaagcttagggtctccagtgggggggtgtcagcagcagccccgctttccgattcggactccatgcggcgcaagcggcggatccacttctctgggcccaaacgcctcccagagtcagctctgcgcgacgacgcggaact

SEQ ID NO: 9857 - DNA, 12281 bp, Homo sapiens
tttgtacttttagtagagatggggtttcaccatgtttggtctggctggtctcaaactcctgacctcaggtgattcccccccaccgccctcggcctcccaaagtgctggagttacaggtgtgagccaccgcaccaggcccagtttcctcattttgtaagatgggactggagttgacatggactgaacctgcagtccatcccctcctccatctgcaaaactgtaggtatacatacagctctttgaggaagagagttagctctcatgagcttttggaaagggtccatggtgcagaaaaggtcaagcactacagccaagaggtctcttccatatccagtgatccagtgtgatagggttgagctctccctttccccacccaactcctgagccttcactagtctattgcatccgtccccggaaactgctgcagtaaagtgtatttgattaccttggaaaaggtgggacagcccaagccagaatgcagaaggaagaagtggatactttgggcagagccacacatactcctggagccatacagggttttaacttctagacataaactttattacatttatagttgtatccctttgtgtgatatagttaggatttctctattaagtaattaatcctaactatatccttgggctgatttgatttctgcccccacccgacagactgacccttgtcccccttccccattccagctcaaggcacttaatattacaaagaaggcagtggctggctggagagatgggcctcaagtcagaaatcccccagtgcaacttaagacaaacagagagaagtcaccttcctcttaggaccctccctgggttagcagaaggaaagaacccagaagtcttcagtaccacagtaggcttcggtatctccctagccaggtgagggacccccaggcattctccctgcccgcaccgagtctctcttcaccctggctacttcctggccacacgtatgactctgccccttactttctgctctgagctgcctgaatacaggaagcaagagttcactctgaccagagatccagaagcctgcaaggaggccccagcagctttcaagaatggggagcagatggccacatgtggcctgctctgtcttatagcgtcacaagccaggagcaagcccaggggagatgctgttccatgctggcctgtataggttactttgctcgttctgttatctgtcccccatccctaacccagataaacaatacatatgtcactgaaacaagaagggattgaagcaaggagacccatgggcacagatctcttctaccttcctgagctaaaagatgccaagccaaaggaatacaggataatggcctatgtgtccaggaggccggggacaaagctctctggctttgctgggggaagaaatagctccaactacgtagtcaagaagcctgtgacagaggtgggaggggaacctcgtgaccttgaagtcacttctacctttcatattcccttctagctatcgaataggctcttttcatattcctcacaaccccagctgttaggaagaatgtggtgtcatacagtaggtggcggggagaagacacatcttcagcctagtccctgccaagcccaccaagagcaacagttagtccctagctcctccgtccccaccaagtacccacacatccatagccagagaggccacctgtctccaggacagaaaggaaactgggcatgttactcaaggggaaggaaaggggcctaaagcccagaccacagtcatagggcccagccctctagcttggaagggagagcccaggatcgggtgaaaatgggggcttgctccttaattgcgatcccccatcagctgcagcacaaaggtgaagatgtagatgatgtctgtgtaaatctgcagggcgccagtgatgtagtcctcggggctgatggtgtgcttccggttccccaggaccagctgtgtgtcgtaagccaggaactgcaaggatagggaagccagaagtgagaactcaggcatcagtgtccagagctcatttttggtcagcagatttgtcttgggggcctatgcgccacacagtgcttagggccacattaacgcacagcataacatatgggctctatactgtagctgctcacagtctaggaaaggaggcagacacaccgttctcaatatggctgactagtgttctaatagcaggcagcttgaacaagagatggcaagagtgcccacaaaaatcaatggaatctctggacagtagtgagaggaatggcctgctatggccccattccctgcctcccaggcagtctaaattcatgcccccttccctagattcctcccctcatcccctcagctccccttcctagagtggggctgggacttaccagggtgaaacaaatggcccccagagcagcatagagcatgtggagccagtaaacctggagaagaaggggacagagaatggcattagaaacctcagcaaaccacaggcccacaggccccagcttcccccgggatagtggcatgagagtgggtagagctgggaagctagctctccatgaaaggctactgcctttccagatcttggaggaaattaagactggtgatatatccagcagagaaagcagaggccatcctgcaatggctgtataaaaccaatctccaaagccagtcaaggtacacaagtgtctactatacttctagaaaaaaagcagttgagttacagctctgaaaggggcagacccagcattcaatagaccagttcctacagcccagcctgggaggggtagactaaggaagaagggaggccccccaacccctctggtgagtatcaaaatccgggagcacccacaggacagcccacatgacatgcccacaggtggccgtccacagaaggacagagctggcccatgggcaggcagccctcgtgtccccatccttccccttcggcactgttctcccccagctgaacagaataaaggaaataattggatccagagacccccgcaaggtcccttccacctaggcccatcatctcagtcctctgggttcctctcccagtctgcctccgagaacctgattctcagctgccagccagattgaacccaccccttcccctaggagtgcagtgatgcagtccagggcttcaggtgctctggctccaaggccgcccatctccacacagagagtctaccctcacccagaaggatgctgcctccacgttggtgcctttgctagccagtcgagaggttctggaggtcagagcctgccccggggacctttggggcctgcgagaccatgctatataggaagtctgccctgagcactgggttccctgaccccagctctcctgggacactcacgtattggaagtagagcacaatgctagtgacaatcccagtcaccaggagcacaattcccaggacacagaagaggcctgtgcacgaggtgaagtccacctgccaggaagcaagaaagaggcacctgtcagatggctgtgacaaccagcccagtcagactggccctgccagggagtcccagtgctgcctcctagggggtatgggaatgtccacaacattctaaggacagaaacaggacacagttttgtaggtgcggatgaggagaaggggatcaggtctctagggaacatccctagtgtgccggggtccgggcctgataagaaaggggagtcggggggccagggaagggccctccatgccctcaccttggtctgaaagcagaagatggtgactgaaatggataccaccgcagtgatgatcattgcaatgatgacggctttggtttggtacatactggggagaagcaggagttacagacaagaggcattaagccacgtatgaatgacttcaaaatcaccacttccagaggggacctgcccagaatccacccacgcagctggctgccggcccaggaacaccccactccccacaatacacatttcccaagagtggtgctttatccctgaatgtacctggaaatggtgcccgtcatgaagcccatggcaaaagtctaagggaaggagagagacaagaatgaaacacttaaaaaggaaggaaggcagggtgctgggggagtggccatggtggcctctgccagagctggggaacgccaccaagttggaaagaggcagccacagaggagatcagaacaggcggcccagataaggtggaggagacagccaggacatccttctgaaatgggtccccatcccttccctgggagcagtctccctcacagcatctccacaccctcctgccacccttctagacttacaaaaagggtcagcagaatgatgttccatgggaaacggcgtctgaagggaaagagaagccttgattaaatgacttggggcccctcaggcgtcagaggctcctacagcagaaggaagcgcttggctcctgtgcctggaggattaagccttgactccaaggagggaggttggcatggcctttggcacctgttcaggtgtggtacgcagggacaacatgggccaatgagacagacctgtgttgtggcgccagaaacacctggattggtttgcaactcttaaactgactgcctgtgtgatggggagaaagttactcagcctctttgagcctcgggttcttcctatttgttaactggctaaaatgctacctgtcttgcagggttactataagagtgacagctagttagctcctaaacacacatggtcctttgtatacacctgaacagtagctgtcatcgtcatcctcctcctcatttcttgtaagtttccattcagctgctataaaggaatccttctttccaaaatactcggcccccatcccaatccctgtcacccctctcactgtgttaagtctctgggactcacctgggtccctggcagcaggcaaggatcaggtaggtgacaacgaagacagcactagggacaaagagatggggaagcagttcaggcccaaatctgccccgcttggcagcacacaccaggccagtgatttggggcccaaatagccgtttggaagtctgaggggaagcaactcaacaggaagcaagaacgagattacccccagccagggtcactgagatgctctgaagcaccaggctccggccaggaaggaggtctggggaggctgcagctgacgggctgagaggacatgggggctgcagcgcagcgtgcacgccaccaccagcaggtcccactcttgctctcgagttctaggggtctgctactcatctgggcacgcacacccacaccctctggcacgggaaactggcaccaacttgggggccctctcaaaaagcattttgatcctgccctgagcaaagctggtcacctagaaacagaagctgccacccctgcctccctgcccaaccacagaggagcacacactcactaggacacgtagtagacagccacatttctcctcacaaaggcgctgacaggttccctgtggggcacaggaggacaggagtagtcaccctgaggcttgtctgccccacccaggccagccaggcagccctggcttcaccttctctaattgcccatggtcaccctgagagcagggcccaccgccacccacacccccagcaggtgaccctgaacccccagggcagtaggagtgggtggcaaagcctagagacttacacaaaggtgaagatagcaatgatggccacagtgatgagcagctgcacggagatgatggagtaaacctggacacagacggccgggcatgggtcaccatccggcacccctggcctgccccaggaagctgccagcccccagtactttcctcccactcaagaaccctccctagctgcagcctggcccagaggcgaccccagtgagatgcctggctcagaggcaatgtgcacttcttcctcagccccgctcccatgctccctgccatctcccctcctgtccaacaccagcctcggtgactactgacttgccctgcctggccaccatactctaccagtatggcctctgcactcccagcagctcagtctgcacgctctatgcagctgtgagatggagagggtgggttacaagcgagtaggatcatttctggctccaagctgcctatagtctaaagggagaaagatgtctggggaaggcgggcgctgtggcagaacccacctaggagattctcccagactgaatgtgtcctcccaaaacatggtcaagaagagaggtgcaaaaagagagggaaccctggggttagagaagccaggtgcccctctgagaagcagacaaggctagagaagacaggcagccagtgtatttcatggaattgatgccctggggctactgtggcctacccacttcccattcccacagcctgaggggccccaggtacacccacctcccagcgcgtatcttacctttcggataaaagtgtgtcgcactttccggtcatcccactctccaggcccgaagctatcactcactgctctctcctccccatcatagccatggcctgggcctagggacagatgacacttgactcagctggggacctgagacatgtggcgtcaatcccaaagcctccctgacaatctcaaagtctcagggatctccagccaaaagacaagtgttataacaggaactcttctcccaagctggggtcttctagacaccctcagagtgacccagagccggcctgtcacgagggggcttaggtgggaaacgttcctcacgtgcatctgtggagggctcctgtgtgcccagcccacgccactgggggttcactggggggtcacgatgtagtggggaagccaggcaggagcaggtatgggcatccactggggcagccagccagggcagaacaggggatggggacagagggtaggagaaaaggagggcggcagagcgcagtttgtgcagcagcagggatagaggtgaagacagggatctgcatcagcctcacagaggcaggtgtgcaaagggtgtgcgtgactgtgcaggacccatgcgcagatccgcaccagcgcacatgtccaggtgagagctggctgacacccctctggggttcagagatgctgcagggctgcaaacattccctgaatgcctgaatgcctgaatgcctctttgggaactacttttaaaatccacgcttgagccacccaggaagactcactgcactctaacttcacctcatttcctttttttttttttttttttttttgagatggagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttttgttttgttttttgttttttttttggttttttttttgagacagagtcttgctctgttgctcaggctgaagtgcagtagtgcgatcctggctcactgcaacctccacctcctgggattgcaagcgattctcctgcctcagcctcctgagtagctgggattacaggtgcacgccaccacacccggctaagtttttgtatttttagtggagatggggttttgccatgttggccaggctggtctcgaattcctgacctcaggtgatctgctcgcctcagcctcccagagtgctgggattacaggcgtgagccaccgcggccggcctcacctcatttctgaccaaacacaagcatgtccctgccatgatgtttaccaaacttggctccaaatgtcttttgcaaaagtcagatttcactttaaaggatgaggaaagtggttcaggttcccaaaggagttcctaaggaagtcgacaggtctgggaggtggcagcagcttgttggccgcttgttgggaaacagagctggtgccctgaggtaacccctcaggagtcattacttggcccagccccattctcctgtggtgtgtacgttctgggacatgcctcatggatctccttgaacaaagggggcagcaagtggctgggggccagttgctgaggcaaaaagtggagggtaacaaagacagaaacagagggagagatctcaacagagaagatgagaaagggatttaagggaaactagaagagaaaaggggcaggaggcggtggcctcatctgctccaagtgctgtccctcccacccaccttccatctgcccttccaggactcaccgtagttcatgggcatcgggtgggtggggggcatgggctgtgggtagccagcagggtgaccgtagccaggctgcgggtagccagggtaggcaggataccctcctggcaggacagatggctgcccatagcccccagggggcggagggcctgggtacagggggttgcggtcttcatatggtggtggggcgctggggttggacatggctgctcacgggctgagggggaaccccagctgctgggacctgaaatgggagaggagaaaagcaatcgtgaatgcccaggcccagctcactcagcctcatgggcccacttccagccttgtccaggctgcctccgtggagaggaacaccacctattttctccttagagggcagcgtgtgatttgctgtccacaggccacctccccaccaactgggctcctgtccctcctgcctttgcgcctgcttcttgtccacaggcctctcactgtgcagctccccagccataggaaagcaggaggaaggattcgctgaggagagagggaaccagggagcctgggaactccctgttgtggtttaagaaaaccttccagttttggtggcttgatggcagaaccagcgaagaagccagatgggccaggcacagcctcctggcgactcacagggccagctgggaccctctgaaagggtcagctctgcccctgccacagctgacggggatgccaggcctggaagccagagctgggttggagccaaggctcaaagtggagagccgggggaagaagtggaggaaaacaagctagccccagtgccagagctgccaggccccgaggaggaagggatccagggacccgggggccagtggcaggctgagtcaggaagcctgagaagcaggagtgggtggtacaggggctgggggcagggaggctgtgccaaagggccagcttgagacaggactttctggttccttcaaataacagcggtggcgtgtcagaaaggcatgcggcagcctgcgaccacagctgctctctggccttgctagggaagagagagtgagtgcacggcccctcgccctcccccttacccccaccctggagggggagacagatgttctgaatcccaggctctctgtgagttctacctgtcttccaggtgcagtgctagcagggaggacaaagagctgaggagtcaggccacaaggtcaagggaatgccttccctgcagcaggaagagccccatagccaggggagggccaagaaaccagggggagggaaccccaaactggagttggaagggacctcagggccataagccccaaatgctcacttcagatgagagaatgcaggccctgaacagggaagtgattccccagaaccccagaactcgcaggtcagtggcataaccaggacggaggccttccagatcctgggtccaggtccttcatgttatgcggtgctcttatgcctcctctgccagttactgtcctctgggcctggtggtcccctctgaggtagcagagatgcaggcttaggaggagctaaggaagcccctagagggcccctgcatccccagtaaggacaagccctggcagtctgggctcgacagggccaccacctcttctagagcatctacagggggctttaggatccccaaggaggacacccccagatgcaggtcagcagacaccagaggctctcagaggctctgctggaagcaagagagaccagcgtctctttttagggcacattgcatagttcggggatcaaataaaggactgtcttatctcttctcttttatgacaactgggataattcagagaggggaaggtggcagggagggttgaggagggggaattgaataaaagtccaggtctctaagtgggttattttgaggaaagctgttcttcatctccctagaggggctgggatagaaccagggcaagaatgtcaggtcagaaatacaaagctggcagggtgcggtaactcacgcctgtaatcccagcactttagaagactgaagtgggcagatcatgaggtcaggagttcgagaccagcctggccaacatagtgaaaacctgctctactaaaaatgcaaaaattagccaggcatggtggcatgtacctgtagtcccagttactcaggaggccgaggcaggagaatcacttgaacctgggaggcagaggttgtggtgagctgagatcgcgccaccgtactccagcctgggcaacagagtgagactccatctcaaaagaaaaaaaaaaaaaagcactggccggaaaggctctgtgggcagaaaccccaaccgtgatgtcaccatgacgtgtcccagcacctcctcagggtgcacctctgtgaaataaggtgggggcgacacgacctctaagcccactgccccctctaacaacagactatgattctgggaactcggctctgcagggcctgacctttgctcggccagagagctgcccctgctccctcctctgagccaagcagggcaaacagctaactttccagaccaagggactgtggcagccaccgggtgaaaggtgcctcagagagaagggtcagcctcggatgggccacggggactccaaggttctggtgcagctcagcgggtgctgactcagagcttcactcctgcctctcttgcccctccctttcaggcttttggtttcagaagcatgtgctagtaggcctgcctgcactgcacacagcagtttccaggccagtccttcgggtacctcagccaccagcccatccacaccagaaactaccatgaccatttcaactcactatgcctcagtttcttcacctggaaaatgggtctcacactagtaatagtaccctccacggggttgctataaaaattaagtgagaaaatacacatagaaggctgggcacagtggctcacgcctgtaatctcaacactttgagaggccgaggcaggtggatcacctgagatcaggagttcgagaccagcctggccaaatggtgaaaccccgtctctactaaaaatataaaaattagctgggcatggcagcaggcgcctagaatcccagttactcgggaggctgaggcaggagaatcgattcaacctgggaggcggagattccagtgagccacaatcgtgccactgcactccagcctgggtgacagagtgagactttgtctcgaagaaaataaaaaagaaaatacacataaagtgcttagaatgaaacccgacccctgatcaatggggataaaggttggttattttcattaaatccttacaacagtccagcaagttaatactgttattattattcccatttacaaatgaagagattgaggcacagaagaattaaatcacttggccaagataacctagctagagtgtgatgaagtcaaaatgagccccaagactgactcccaagcccctgctcttaatccctaacctgaaaacaccctgtctatccaaccttctcatcacttctgccatagcttccatctaaaaccctctcatgggttttagcctcaacaggaggctgacacaagtggaagccaaactactcaggccctccacaccaccacagggctcacagcctggccaacggccccaggagaagagggtggcccaggcttggagatacataaaggtcagagctggaaagaaactcacccaaggacagccaacccctcactttaccaactagacagccacagcacaggaacctgtccttggttaccgagctggtcctggggacaggacgagatcctagctgtctacatagagagacctgggcacaggagaggaaaccccagcattaacgctagccaggggagttgctaaactcagccacactcacctctgagcagtgccaagaacactgtcagactggcaagagcctccggggaccagggctgccgggtttggcagctttagagcctgctcttgggcttctgcccagcctccatgagggccctggccacttccacatcagcaaggcctccactagggatgaggtttggggctggcatctgcct

SEQ ID NO: 9858 - DNA, 675 bp, Homo sapiens
tctgcattggaaattggctgaatgacagtatgtgggtcctttgcaatttttctctgtataaagagtgccatagtggctgcatctgagcatgcctgcattcctacagatatctaaagattcctccatgtcaggcagttgaaagggtgattgcttcctctaggaggggacatttcctgttttcttagatctgacaagattcctccctgtccccaactatcaaagtatccgtttccagcaagatgagattcctcttcagttaaacaaaacttgctactttttatattttaaaaatctttatatatatatatacacacacacacacacatacatatacgtacacattggcacacatatatgtatatattttgaaaatttgctggatgtggtgactcatgtctgtaatcctagcactttgggaagctgaggttggtgggtcacctgagctcaggagttcaagacaagcctggccaacatggtgaaaccccatctttactaaaaatacagaagttagccgggcatggtggtgggcaccggtaatcccagctactctgtggctgaggcaggagaaccacttgaacccagaaggcagaggttgcagtgaaccaagattgcattactgcactgcagcctgggcgacagaacgagaccctgtctaaaaaaaaaaaaaaaaaaaaa

SEQ ID NO: 9859 - DNA, 680 bp, Homo sapiens
tctgcattggaaattggctgaatgacagtatgtgggtcctttgcaatttttctctgtataaagagtgccatagtggctgcatctgagcatgcctgcattcctacagatatctaaagattcctccatgtcaggcagttgaaagggtgattgcttcctctaggaggggacatttcctgttttcttagatctgacaagattcctccctgtccccaactatcaaagtatccgtttccagcaagatgagattcctcttcagttaaacaaaacttgctactttttatattttaaaaatctttatatatagatatacacacacacacacatcatacagtatagcgtacagcagttggcacagagtatatgtatatatttgaaaatttgctggatgtggtgactcatgtctgtaatcctagcactttgggaagctgaggttggtgggtcacctgagctcaggagttcaagacaagcctggccaacatggtgaaaccccatctttactaaaaatacagaagttagccgggcatggtggtgggcaccggtaatcccagctactctgtggctgaggcaggagaaccacttgaacccagaaggcagaggttgcagtgaaccaagattgcattactgcactgcagcctgggcgacagaacgagaccctgtctaaaaaaaaaaaaaaaaaaaaa

SEQ ID NO: 9860 - DNA, 313 bp, Homo sapiens
cagttttgtcttttttttttttttttttttttgagacgaagtcttgctctgtcgcccaggctggagtacagtgggttgatctcggctcactgcaagctccgcctcccgggttcacgccattcttctgcctcagcctccggagtagctgggactacaggcgcccgccaccacaccctgctaatttgttgtatttttagtagagacggggattcaccgtgttagccaggatggtctcgatctcctgaccttgtgatccacccacctcggtctcccaaagtgctgggattacaggcttgagccaccatgcccggcc

SEQ ID NO: 9861 - DNA, 297 bp, Homo sapiens
tttgtcttttttttttttttttttttttgagacgaagtcttgctctgtcgcccaggctggagtacagtgggttgatctcggctcactgcaagctccgcctcccgggttcacgccattcttctgcctcagcctccggagtagctgggactacaggcgcccgccaccacaccctgctaatttgttgtatttttagtagagacggggattcaccgtgttagccaggatggtctcgatctcctgaccttgtgatccacccacctcggtctcccaaagtgctgggattacaggcttgagcca

SEQ ID NO: 9862 - DNA, 4034 bp, Homo sapiens
agggtctcaacgcagactacgtgaagggagagaacctggaagccgtggtatgtgaggaaccccaaggtgagaactttgtactcactgtcccttgctgacgctttcctagttggtcccagcactgagcagaactgtgctagagaagcagggaagcacagaggcgtctgcttctagaatgtccggccagagcaaaagcctgccctgatgagcctgcctcccagtttcaggagcccaaagatgctggggtgacagccagggccatctgctgccatgcctgtgacttctgggcattgcggctgctcggcccctgcccttgattcgtccgtccgagccagagccccaggcacctctgctccccatcagcgaatacaattacatcctgaacagagccatggggaagcttttcacctagacctagaacttttccctttgcaaattgccacaggcaagagggaacttgggtaaaacccagaccctattgtcaacacctgtgcccctccctcccccttctgtggtcatcaagcactttctggattcaggagctgttggcaatttgaggtcgcataagttcaggccacaggcctagagtgcccaactgctcgaggcagatatgacctgtgcccacgggatgccaatgaggaggtccggaaaggcttgctggggtcggggagcagccgaggcctggtggcgcaggcagggagactaggacagctcaggcgagtgttgccagtggaactacagtgcagcagccgtggggactgggcctgggagaccaggaggggctcagcctgtgtggtgtgtactgggagccaggtgccctacaatgctgctgaagacgggtggcagtgctgcaccaaatgaactaaaataggcctgggttcagatgtggaaaaatggattccgctgtcgcatccactgtcatgagctttgccacggttagccaccacgaggccagcatctgtgtgggcaggtgctaggttgagccctttgtttaaaataacccttccagcagcgctggcaggaacacgctcattttttaggtgaggagatggaggctgagctgtttccagagcctgtccagctttctctttctctccccttgaccggcccaaaactgctcccaggctcaggagggaaggttgctaagcggccccccaggggatacaaagggaaacccagttctgttcccagcacgggcttgctgctgtatttgcttcttctgtgcaagacagagcagaattccttctgacggcctctttttcccctagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccacagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttccggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggattagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcaga

SEQ ID NO: 9863 - DNA, 2444 bp, Homo sapiens
tacatttacaatttactgaatgaattaaatcacataaagttagttactttacatcatcatatattaactgtgcttgacgcacagtaaacattcaatccatgttattttattaccgattttcctcaaaggaaaaatctactaagatacttacttacttacttaaaaaagaccagggagcaaacatatgatcattttaattacagatgattgaaatacagtgcaacagatgagacaaatacaatactgtaccagtttttaaaaacctgaaccataacggcttcgcattctagtacacttacttacttaaaacaaaaattgcttagataacaaaactatacttcaagttgttttagaaacagttctgcgctaggaacatacaaaggaaaatgacccgttgtgcttctttaaaatcgaatgagagtctcctctagggtcctgctgacagagccccccccagcctccgccaggtgaggtgcacagggcccactccaggcaccagctccccccaacttggcttctctggtttgtcgaaggcatcatccagtccacactatgtttaacagtcctagtcagccaggggattacatatttctgggaagaaaatggcaaatgtccccattaaaaaaaaaatcagtatatcaataatccagtatatccattcataaataagctttcagatatgttaggaacataaaagctattgttgaacacgacttagcaacaaatcccacatatgataaaaaatggagaattgattttaggttatcaaattaccttgaataaatctctctggtatcttcttatagaaggataattttccgtaagaatcaggaggttcccagttaaaaaaaaatccattctttctctctctatgaaaaaacccttaacatattttcaaaaataataaggtcaatctgtaggcctttgcctggaatccagtagtttgaaaccaaccagctaacactgctatgcagtcacactggggtttgacctcaggggccgctgcagctgcctctgcctctaaaggctgaattcctgcagccagtggcggggtgggggggcagctgcagcaacaggcacggcacatgggaggggcatggcctgctggggcaggacccaggtgtgcaatagtcatctgtggcatgtcacacagaggagctcagagctatggcgctcaagtggattgaaccaattggtaagttagttaattcctgcgagaaccgacggagtcacagagctcaaagtcagtaagtaaaggttcaggagcgggaagagagggctgaccagctgcggtcggctctgggaagggaaaaccaagggaagtgcgtgctatgcttttccaaaccaaagccacagcacggtggctgctttcaaatatgaacaggcagccacgcgagtaagctgagttgaaggaattgtgataaaatgagaaatgatttcatacaggcaaataacataagaacagacttgctttgatcccagcagctggctgcggtaaagtgggggtgggagacatggctagacagcccaggagcgagtgacaggcagtgctccttgaaggagccagaggccagcacctgtgcacagctgccagaggcctcggtttaccctcagcggggctggaagactgagcatggccgcttggtgccatccccatgaatgggctgagccgccccaagaggcgagtaccagagtgaggtgaggacagaacacgttgcccttgaaattgcaccacagaaaaacgagcatgaggtttgttggaaaagaatttctcccacagtacagttgagctgatcccccctcgggtgactattctaaacgtaaaaaaggacataggaaaataaaggcctgtttctcttctctaaaaataccttatatgtacacaacagtaattgttaacaggaggaccccgtgcatgaagaaaactgtggaacagagggcagtggcctgtcttctccccaagtacttcattcaagacagttttcaagttgtggccaagagctgagggaagccacggggctggcaatgcatcttgaagtgagtggtgtttgttgttactgaaggatttaagttggaaagaaatggcgtacagctttcttgaacctcagtactgcattccgttcacttagtttctcccaagctgcctgaatgccagaagttgcttcacagggtgggcgtgacagacggctcccctgtgaaaccgctgacaggagggtaacggttgccaacagtgggagctgtcacctagccacacaaatggtccctgggcctaatcctaaaagacaagatcacaagctacagccataacagtgatcgccaggtccctttcctgagccaccgggagacagtggagcagcaggctgacctcgcccatcagaccgaggtgtggacggaggtggcggagtgggagggcgaggagccccgctcagatgaggatgagacgg

SEQ ID NO: 9864 - DNA, 10852 bp, Homo sapiens
ggtaagagggactggctctcagtccccgcctcgcggggggtgcctcagccccctgcgatgggggtcctaagggccaggaggggaagagggggagaggatgataataatttcagcatcgccggctgtgttcacccagcctgtgaaattgttattaatatcctgaaagggagagaatgatattactccccgtaatagacagatacgactccgcataatagagcacgaggtatacacccaccctgtgatattcttcctcatattcagaggccaagaagttgatattactcgtaatatcgcaggacgtatacaccctcgtgttagatggtccttaataatattccaaggcggagtgggcgatgtgactacatatatggcagaaagtggaaacccccctgggatattgttcccacgatcctggagggaagaaaatgatattactttcaatatgacagaaggtggacatgccaccactgatattgtttctaattgcaacgtgggagaggaggatatgacacgcgatatcgcagggagtagaaacacccctgtgatactgttcttaatattcagggaggaagaggatgatattactcccaatacagacgggtgtacaccctctgtacaccaagggtgtacacctgtctgtgaaacagttcataatctccagaggtctccagagggggagatgatattactcacaatatggtaaacaggctgtgagtccactgcggatcctaagagccagggggggaagaggggctggctctcagtcaccacagtttgggggggcctttatgttcaggttttgcccaagagtcagcttatttgcttctagtactagcagagtagttgctgccaaggccctcaaacaggggggccatcctgtagaaaccctgtctacttgtttagagacttaggccaccggcctcagccaggtccccacagtttgggataaaagtccagctgccatcttttccctctctgacgcatacaatggaaaaggctttgtcagatccggtagccccagggctggggctgccagaagtttttcctttaactcctgaaagccttcctgttgttgggatccccattccaaagcttcccggtccccgccccctttgtgacctcatacaaaggcttggctaatactgcaaagtttgggatccacagtctacaaaaccccacagctcctaagaattctctcacctgccttctgcccttaggctccggtagattgcaaacgacctgctttcttcctgatcccgggctgcgttcggacccctgtggtatagtaaatcccaagtaaggtacctgcggtcggcagatctgagctttcttcttggacacctaatacccagggtcctccaggtgggtcctaaggatcttaggattcgcgatgggggtcttagccagggggggaagaggggctggctctcagtccccgcctcgcggggggtgcctccccccctgcgatgggggtccgaagagcctgggggggaagaggggctggctctcactccccgcctcgcggggggtgcgtccccccccctgcaatgggggtcctaagagccagggggaaagagccgctggctctcagtccccgcctctcagggggtgcctccaacccactgcgatgggggtccgaagagcctggggggggaagaggggcaggctctcagtccccgcttcgcggggggagcctccccacacagcgatgggggtcccaagagccaggggggaagtggggctggctctcagttcccgccttggggtgtgtgtctgccctgctgcgatgggggtcctaagagcaagcgggggaagaggggctggctccggtagattgcaaatgacctgctttctttctgatctcgagctgtgttcggacacctgtcggatagtaaatcccaagtaacgtcggcagatctgagctttcttcttgggcacctaatacccacagtcctccagttgggtcctaaggatcttaggatccgcgatgggggtcctaagccagggtgggaagaggggctggctctagtccccgcctcgcggggggtgcctccccccttgctatgggggtcataagagccagagggggaagagggtttggctgtcagaccccgcctcgcatggggtgcctccccccactgcgatgggggtccgaagacccgggcggggtcggggggggcggagaggggctggctctcagtccccgcatcgcgtggggtgcctccaccccctgcgatgggggtccctagagccagggggggaagaggggctgtctctcagtccccgcgtcgcggagggtgcctctcccccttgcgatggggttcccaagagccagtgggggaagaggggctgactctccgtccccgcctcgcggggtgtacctccccccactgcgatggtggtcccaagagccaggggggaagtggggctggctcgcagtccccgcctcgcatgtggtgcctccccactctgcgatgggggcctaagagccagaggtgaagaggggctggctgtcagtccctgcctggcgggggttacctccccctctgcgatggcagtcctaagagacgggggaaagaggagctggctctcagtacccgcctcgcgtggggtgcgaagcgcctgcgatgggggtcctaagagcccgtgggggaagaggtgcaggctctccgtccctgcctctcggggggtgcctctcccccctgcgatgggggtcctaatagccagggggggaagaggggctggctctcagtccccgcctcgtgtggggtgcctcccctccccgcgatggggatcccaagagccggggagaagtgggtctggctctcagttcctgcctcgcagggggtgcctcccccctctgcgttgggtgtcctaagagccgggggggggggaaatgggcttgctctcagtccccgcctcgcggggggtgcctccccccactgcgatgggggtcctaagagccacgggaggaagagaggctggctctcagtccctgcctcgcggggggtgccttccccacccgcgatggggctcctaagagccaaggggggaagacgggctggctctcaatcctcgcctcgccgggtggcctcccaccctgcgatggggctcctaagagccacggggggtagaggggctggctctcagtccccgcctcgcggtgggtgcctccccgccctgcgatgggggtccgaagagcagggggaaggagaggggctggctctcagtccccgaatcgcgtggggtgcctccaccccctgcgatgggggtccctagagccagggggggaagaggggctggctctcagtccgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccaggtaaggtacctgcggtcggcaggtctgagctttcttcttggacacctaaaacccccagtcctccaggtgggtgctaaggatcttagaatccgcggtgggggtcctaagccagcgggggaagaggggctggctctcagtccccgactcgtgggcggtgtcttccccccttgcgatggggatcctaagagccagggggggaagaggggcgggctctcagtgcccgcctcgctggaagtgcctcccacccatgagatgggtgtcctaagagccaaggggggggaataggggcaggctctcgatccccgcctctcggggggtgcctcccccccttgcgatcggggtcccaagggccagggggggaagaggggctggctctcagtccccgtctctcgggtggtgcctcccgccactacgatgtgggtcctaagagccgggggtgggagggtctggctctcagtcaccgcctcgtgaggagtgcctcccccgctgcgatggaagttctaagacacagggggggaagaggttctggctctcagtccccgcctcgcggggggtgccacgcgcctgcattgggggtcctaagagccatgggggggtagaggggctggctctcagtccccgcctcgtgggggttgccccccccctgcgatgggggtctcaagagcctgggggggaagaggggctggctctcagtccccgcctctccgggtgtgcgtcccccccctgcaatgggggtcctaagagtcagggggagtgagcggctggctctcagtccccgcctcgcagggggtgcctcccccgcctgcgatgggggtccgaagagcctgggggggaagagaggcaggctctcagtccccgcttcgcgggggttgcctccccgcacagcgatgggggtcacaagagccaggggggaagtggggctggctctcagttcccgccttgcggtgtgtgcctccccccctgcgatgggggtcctaagagccaggggatgaaaaggggctggctctcagtcctcgcctggcgggagtgcctccccccccgcgatgggggtcctaagatcctgggggggaagaggagctctctctcagtccccgcctcgcggggggtgcctccgactcctgcgatgggggtcctaagagccaggggggtaagaggggcaggctctcagtccccgcctcgctgcgggtgcctccgtccctgcgatgggggtcctaagaaccagggagggaagaggggctggttctcagtcctcgcctcgcggggagtgcctccctccactgcgatgggggtcccaggagccaggggggaggtggggctggctctcagttcccgcctcacgaggggtgcctccccccactgcgatgggggacctaagagcaagcgaggggaagacgggctggctccggtagattgtaaatgacctgctttctttcttttcccgggctgcgttcggacccctgtcgattgtaaatcccaagtaaggtacctgccgtgggcagatctgagctttcttcttggacaccccatacccacagtcctccaggtgggtcctaaggatcttaggaaccgcgatgggggtcctaagcccggggggaaggggggctggctctcagtccccgcctcgcgtggcgtgcctcccccgcttgcgatgcgagtcctaagagccgggggtgggagggactggctctcagtctccccctcgcggtgggtgcctccccgccctgcaatggggatcctaagagccaggcggggaagaggggctcttctctaagaatcaaaacactgtcacctttagcagtgaaggatccagtgagatccagtttaacggtcataaccgcctactggtccaacgttcagaagtaacacaggcacctggacaatacacagtagatgtggaaggacgcggttgtacatttatccaggttacagaaatctgcctaagagggtgatgagtgtttgccagtaaaagagtcagactgtctgttcagttctacgtgaagtgttatttgaccgttttgtgtatttacatgatcaatagccaaaattgcaagttactttatgaaaagctactcagctgtctaagagaagtttgaggaatattgctattagaaagtattctatcttcattaaattacgttattctgaaaactaaagaatttaacctgattccctgatgataaagatgtaaactgcattagtaatagaaataaacaataggttctttctttttaaaaatgttttatttttaatttttgtgggtacatagtaggtgtaaatatttaccgggtgcatgatacaggcatgcaatgtgtaagaatcacatcagggcaagtggggtatgcatcacctcaagcatttatccattgtgttacaaatgatcgaagtatactcttagttattttaaaatgtaaaatcacattactactgactatagtcagactgtataattcttaatacaggatgggttttcttataatttgctatcctttctaggccacccttaagtacaatgttctcctacctaagaaggcatctggattttctctttccttggaaatagtaaagaactactctttgactgtttttgacctcacagtgaacctcaagtaagtgtcatattttgacagtaactcccacgtgaacaagatggtaaaatattttaaaagttcaaacagtagtgaaataacaaaatataaatcatggtaatgagttctcatgttggtggtgacaattctacagcacagtcactttttagccgtctgtccggacaccacaatttagtacatcttcagctaaatcagagctaaaatgaggcaagaaaacatgcagtctatgtgagcaggatttgaaagctttcactgcactgatgtttcaatgatactttttattctgttgtatggaagtactcctagttttgaaaaacagagattctatatttctttctcaagacaagcatgcatggtcatatagtagcaagcccacaaatgtttattttgtaactgtaaagagtaacattttagatttttacttttcagaatagaaaaacgaaatgatcctcttgaattcaagcatgatttatagatgctaaaggcttttagccttagttaatatgtggaaaacattgagtaaaattagtttgggagatattttttagaatttctaaataaaaatcgcttgagctccagggctaagaactcaatgaattggggaactctttttcttttttggttttttttttttttttttttttttgagacagagtcttactttgtcacccaggctgcagtacagtggcacagtggcacaatctcagctcactgcaacttccagctcctgggttcaaaggattcttacggctcagcctcctgagtagctgggattagaggcgtgcaccaccacatctggctaatttttctatttttagtagagtcagagttttgccatattggccaggctggtcttgaactctgaccctcaagtgatccacccaccttggcctccagaagtgctgggattacaggtgtgagcaaccacgccctgatgaactatggaactcttaacttcataccccaatagtcttatccagaagcaggaaactgagctagaagttctcctggggacacatctactctataattatgctcatataccaccttttaagcaaagatgtcctctaagtgttacgcaactctaacactaacctaagtatatgtaaaagatttagaagctctgtttatcagttcaaactttgagactgcaggtaagcttaaaagcagggtttggggaagatttcatgtccagataattcattatttgctccaatttctgttgctatgtatcatctctttcattatcattctggttgtgcctattcacagatgcttgaaaatgactttcttccgatattttctcttcagcttttacctgtcctccagatttctagccaattagtatttatccacctggcactctcattatgagataagtcactttttaaaattgatatctaaacgagtgttttcttaaaattttcagatacactggaattcgcaataaatccagtatggtggttatagatgtaaaaatgctatcaggatttactccaaccatgtcatccattgaagaggtaaataatagaagcctaatctttcatcacaaagacagctacatagagtataaagataaaataaatacttgtttagccgtagtttagcaaaacaaaactatagaattcttcttcaacattcacctttgtatttttgcgctaacactggagagctggtgtacttcatttgtaccaattagcagtcagtatttcccatggttcatcatatgtttttctttagttgctacctgtgtttatgaaaacatcatggcaccaaggaatgttccataaaacagaacgtgacgtagaaaagagtggacattcagttctgcagtggcgctgtcatttgttctaatatctattctctatccttccctaacaatttcttcaaagcttgaaaacaagggccaagtgatgaagactgaagtcaagaatgaccatgttcttttctacttggaaaatgtaagtttagccatatttttttttctttaaagtttttcttttttccttccaaggataattggatgcttcaatttcttatagatatgtatgataggatttgtaaaaggaaaaaataagggacgttaaggattaccagtgttttatcccactgatcatcttctccttgctagttccaaggctatttcatatatgccctggctatgtgactagatagctttccattttagaaacatcatctccctatcaaacacagtctggtcacagagtagatatgtaattattttataatttgactaaagtcttacaaagtttgccataattttttgaaattacaattgtgtattgaaggtatgtggtgtgatgttttgatatatatagtgagctgattgttatcatctagcgtgactatatgtgaattagctggctaacacatccctctcttcacacagttacctcttctttttttgtgacaaagcacttaagatctactcccttagggaatattacatatacagtacagcattgttaactgtaggccaccgctgtacctgagatttgtagaatgtattcatcctgcacagctgaagctttctatcctttgaccagcatctccccattttcccatccctgataactgccattctactgtctgcatctatgaactcaactttagatttaacttacaggtgagatcctgcagtgttttttgtgtgtatctggtttgtttcattccacataatgtcctccaagttcttcagtgttgttacaaatggcagaaattctttcttcttttaaggccgaataatttgtatgtgtatatgcctcagtttcattatccattcatctgtttcgaacgcttaggttgattccttatgttggctattgtgattaatgaaagaattagcatgggactgcagctgtctcttcaaaatattcatctcattttctttggatgcatacccagaaatgggattgctggatcatagggtagttctatttttattttactgaggaaatgccaaactatggcatgcgctttagagacatcctttctatgtgtattgttaccactcacataaatgcctacattcctctgagacttccagctaaattcctctcacctcaatgtaagcaaaggaacttgaaattttatatgatttaaggttaacaactcattattttgccaatatgtaagttaatcataccctagatctatttaattatgtagatcataaacttctgcggataattttctcagtgattatcttttctcagacctgctacaatgtaattataatttgtgtcatgataggtttttggtcgagcagacagtttcactttttctgctgagcagagcaaccttgtgttcaacattcagccagccccaggcatggtctacgattagtacgaaaaaggtaggcaagcaacagccatgccctaaggttattgaatgtggtgtttatatctaacattccctgagctactaaactttccaaaatcaacctctgtcttcacagagtaaacaataaatggcattactttgtgttctggtttctttatcccatgatgtgtcttctgactgaacccattttccagttaccagagtttttcaacaccagaatccttgcaatataacctgacagggctccacttgaacttgaaatacaagccacactaagcttccaggtctttttgttattgtcattgttgttcatgctaagactgactgttccaagctacttctgtggactttgacttaaaaagaggagtggggaatattctgaaatgttaacttaaaaatttgatagattaatttctaaaacatatactaaaatgttgtagagaccatacaactgttccctggaaggttggtactatttatttcttgttgaatgctgtgtgaagtttgtggagtgtttgaattctgtctctatcatttactaatagaatatatttcatcaagtgtcttaaatattattagcatatttctgcataatgtataaaatgggaaagtaattgtctctatttcaaaattattggaaggattagatctaatgtgcttatatcatctatttaataaaaatacatgttccctttattttttcagaagaatatgccctagctttttaccacatcaacagtagttcagtttccgagtgagacaaagcaattactggaagaagtaaagaaattttattacgtcataaaccattgaaaacacatctagtaagaaaatgaaaacctgaataagataggacaatagttgaagaaagaaaagtctctggtacttcattagacttgtgtagctgtgtactgcatgagtaatctgataatcattaagattatattaatttctttaaaaatagctttaaagaattcacagctatatatgtaccttttataaatctctcatttttgttttgtaagttgacaggtcagtaaaaatttaggcatatatatttgtacatatgtgtgtatatgtatatacatgtctatgtgcctatatatgcatgtttttatttctaaatatctatttatatatacatacaaatgtgtttattgtttaaatgatgttttaaatcccaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttgcatctga

SEQ ID NO: 9865 - DNA, 418 bp, Homo sapiens
ctcaactgacagaataaactcctgttgtttaaaaccagccaggtgtggcatgttttcacaagagccctaggaacccaatacatcgactttcaagggccgcatcccactgacttcgaagcaggcctggatctgtgtgttgtctcagttctgggagctcccatgagcctgcagagagactgcagggtcttcctggacagttcctgaggaggaaagagagactcagaggattgccccgatgttgcccctccctcctcctaaactctgctgggctctcccactcccccaggaagacttacttccctgctaacttctgccctgcaagttgaccctgacattttcaagtgccacccgcccctgtgaacttgaatggattgcgctgttctttgcacaagaacagaaacgtctgcctggagtgcag

SEQ ID NO: 9866 - DNA, 4544 bp, Homo sapiens
tttttttttcttttgagactgagtcttgctctgtcgcccaggctggagtgcagtggtgtgatctcggctcactgcaagctccacctcctgggttcacgccattcccctgcctcagcctcctgagtagctgggactacaggtacccgccaccacgcctggctaattttttttttttttttgtatttttagtagagacggggtttcaccatgttagccaggatggtctcaatctcctgaccttgtgatccacccgcctcggcctcccaaagtgctgtgattacaggtgtgagccaccgcgcccggcctttacgttgaattctttaaattcagcttgtgactttgcacttcaggattctgagtgttctctgtcttcttcctgcattgtttttcttataccatacaggtttttcattggccttgactttttgttgttaactcattcttctttgggtttattttcatttgtttctgctgaatattatttgtttcaaactaaaaataacattccacattttaattgatgtgcggactcttaatctacttaaaatgtgggctgaagttccatgattccagctagtctggaataggtcatttaactggatgttaattcacctacattgttccctaagtgacatgtgggtcccattctgctgacatatttgtgggtcctggtaacaaccatttgggtagatttgctgattcctcttttctccttagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacaggtaagggaggaaaacacagaagggggaatataaaacaaaggcttcaaaattgaagggtgtgaaatgtcacactcattggtaacaggatcagcagatggtcctagatcctccttggtccccagtctactcattttcttatcaccagcaccctcaccccaactacttgtttcagaaaggatttgagactagttatcagttactaggtctgcccagaactttttgcatgatccatggtttgcacaacagagcaacctttctacagagcaggactggtcaggcttcaatggacacagcacagtatttcagagtggggtctctagatacccctattagaagcttatgaggaacggtttaatacacaaatatccttgcctcccttgccccacagttaaaatggcaagaggtgagggaagggcaagggaccacattaaaaacacttaaaccattggcatattatagaatttaagtataacgtgtaaagctctgtgttagaacattaaacacattgaattgaaatcatctctttgggtctcccctccatccgagtaagttcttagatgtaaggagtgcattgctttgtctatgaatgcttgctactgccaatataagacataacaattttaactgaatgtgtcccaaggctggggtacatgggtagggtgagtaatatgttttggaagaaaagggaggttgagctatgaattatctccatgaaagggatttataacttattatgaagagtcccttaatggagtgaggaataataaacaagcaagtacagaattcagatctccaagtactagagtcagggggcttaaagcatggcatcagtggggaagtaggtatggaagtctacctcttccatactgaaattccatttcagtagccaaattaaaaaaactcctactgggcatcttcctaaaatagatggtgtatttcttgtttttgatgagcctcagggttatcagcaggaacaacataatacagtggggctccagaggcaatcaaaccataggaggctggcttctcaaagttgctcagccttaaaggagataatatgtgtagcttcttgctgttgtttttcatttggtgcttctaactgggtaattagttggattaataagcactgtctgttacctaatttccagatttgtattatttcccaaaaggtcgaactaacattgtccactgtacaatgtgattatgattaacaaatgcccacaaatttgttaaagaatggtatccctcatcttttgtggaatgctaggaaagatgaaatcttatgtattcagagttggatgcactccacattaaagttctgtgaaggcatgtttttaaagaaaaaattgttttttcttttacatacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagaggtaggtagcaatgtaaacttaactgacttgctttaagggagggatgtcactggattgatagatttgtgaagtggtatgtagggagggcaagggccaacgaataaacatgtaaattaaaagactggttgaatggcagaaaaaggaggtattgattaggttgaagtactattgtgttcaattcacgtaacttctacagacctgcactagcctgtcgaaccccatcaagctggagaaaaccttgcaatgatagtaccttacgtcagtagtgctttacagatttctaaatgtgttcagttacaatgtgtttctcacagtgtgctggtgaagctttatgacaggaagtatcattttgtcagacatttcttagtgtcagcacactataccgatcattttcagaaacctgggatgacaggtgtattacacataccaccattcatgaaatcttgggctcatcaaagtcctcaggatatactggaaagggccgttaggaatcccacagcattcagtggagttccagcctgtcagatggggatgaaatgaggcagcaccagcttgtcgcttcataagcacacagtaaattagccctatatctgcattcatgctctctcttcagaatcaccttgaaaacatacactttcttcttactgtcccttctctctgggttattttagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaatattgtatgtatcccagtaatctttgcatttctcaaaaaaaaaaaaaaaaaaaaaaaaa

SEQ ID NO: 9867 - DNA, 120544 bp, Homo sapiens
  misc_feature (66414)..(66613): n equals a,t,g, or c
tgatttcttaaaaaaattaatgtcaaccactcaccttttgcattgagaatgtttttaccttttcacaactgcaggggttactgaaaggtttttcattccaagttttatttatttattaattttaaatcatccacagtgactcagctcatggtctcgttgttggaaacactaggagttttcaggacagtctcttcatgtgggtgttttcattacagttcatttacactgttgtaaaataaggtactgaagcaaaaggaggactgatctcctttactgattggtctaaattcaaaagtgaattggttaaaatcgtgtcattaaaattttttaactgtccaatggtcactggagttttctgggcataaatatttttaaaatagaatcactcagtgtaccaaaattaaaagcattatgaaatttgcagtcataaacatgcagtggaaaactggctgtcagaatacttttatgaagagtattaggaagaccttaatttagttctgggtgctaaaaaaatcacgtgtaaggatatagtgtcagaacactgaaatctaagtctacaaagaatatcatgttttggtttgcagtgaaccacagtaagttgtcagtgctgctctgtgcttaccacttaaatcatgataaggtgaacctccataggtaaaccatgtgagaattctgtcctttcatttattttgaaccaagaactattattggattttaactctcattctgagatttcttctccaggtgatggtaaataaagtaatacgcacatgcattatgatgaggatggagggagtggttcacagcacctcaccttcgggtcctcaggtagaactgcaagagtaagaagttaggctctgatctgacatgttctcagaaactatacggttgaccttcaaataatgcaggagttaggggcatagaccccctaagtagtcaaaaatccacatctaactttgactcctccaaaacttaactactcatggcctactgctgaccagaagtcttacggataacatagtcgattgacacatattttgtatatgtattatatactgtattcttacaataaagtaagctagagaagagaaaatgtttgttaagattataaggaagagaaaatatatttactattcattaagtggaagtggatcatcatgaaggtcttcatccttgtcatcttcatgttgaataggctgaggatgagaaggggttggtcttgctatcttgggtggcagaggtggaagaaaatccatgtataagtggacccacacagttcaaacccgtgttgttcaagggtcaactgtattctgactcagaatagcttaagaccctcagggtcatagaaaaataccatcataatctcttttatggtaggttggcaatataaattattaacaaactctaaaatattaccagtacctgaaaaaaaaaaattcagcagaaaactgtgaagtggaacatttagtcactgtttttcattcattttgaaatttttatatgtttacatatatctgttgtaaaaaataccaactttccaagtactaggaatgctgaccactaagcctgatctaaagtttatgttggggacctcaggtatacaggagtggaacagggacaggagtgaaagctttgactgaagacaaatgtgggcttatggcctatctctgtcactaatttaactatatgggcaaagtactaaacctgtgtcttcatctgtaacatagggattagacaccagtgataggagggtcttggtcagtagctaatcacagagctgcttccttaaaagccttgagtacttttgtttaaaagtttaggtctacttgaaagtctgtaaagtgctaatttttatcatcctgagagatctgtttctcccctttccagttaccagtggcattctcccaaaactgttagtatctatgttatagaaagatacttaaatgctatgataaattgtatgaaaaaaactttaaaattcagcaagcaattcttaatgaaagataaaactggccctctagtaccataattagtttagaattcagtcttttaaattatttgcaccttgagactctgtgaaatgaaaacatttaacagtaaactcttgtcccaagggagcaaagtgagagtaaatgctggtccatagtgatggggaaaaaggactgtgttcaccatgagtttttcaggatgcagcataaagcttatctaaatactacacagatcattatcttttaacccaaccaatcatatattcaaactaagggaaaaatatgtaagcttttcctttggaacctgagacaccaggagccttaaaccacaaataatctactgtagctatggacagggtagtcaaatttatttcaaaacaaaagctttgttgggctgcatcaaatgcaggagaaaaggaatacttaggggcatggttaaattaccagtgtgcgtaacagtgaggtatgcctcaaataagcctttaaaactttataaactgaactagaacatacccatgcagtaatattttttcagtgctactaatgaaaaaaaaaaattaaagcctgcactggaaatttacaatatggcagaatttgttacttttaccttttgaccctaatgtacagattttatgacagggtctgtgttaaaaatctaaacattttcacaagattttaaacatcactggaaagctgaatttagaggaaacaatatcagataaaagtacaatgcccgtgacagccaacattatgtaactgggctgtatgaggttgtttagaaggctagggttaaaaagatagatagacaaaaagatttttaaaaatcacccccaaagttgatgcgctgatttgaacataagtacaccagatactacagcaaggggatatacactgcaaaaaggtcatctatttacagaagagtgatttaaagacattatggttttctttacagatgtaagaacagcaactgttcactttttaaaaactctacatctcaaccctccactattattatagtccactgaattgcctgtatcaaaggcagttttttgtttgtttttttcccatttgactctccaaatgaacttccatcatttcttcatcatctgtgggctggctctcctgaaaagtctcagggaataagtcacaggagggcaggtttttgacctgctactaaaaattaaaccacaaaaactagagatccctctcctgcaccctgttcccctcactttgtgcagttcagtcatcactatccgacagggtctcgtactgtgctgagagcagtggggcaggctctcgctcccagatcctgttctgttggtgaggagctgcttggttcaccgcagagggagcacatgcaatcggtgttggtggagtactgctgagcatccgcatagtcagagggttataaggaaactgagttgagcctgacaaaagaaaaattaggttttcattgtcatgaacataactggtatttcatccaatccaacttttgtaggatggagtagaataggattattgtaaaatggtcatgtgacaccatgaaagcaaaatgaatacaacacggaatggccaaagtctcaccacttaaatcctagccaatgatatatagcagtcagtgcgggtccaaaaaagaagagtaacatgagtagcatatgagtgagggctgctgagcccagaagagaaagcccaggctagatttttagttaagtctatatcagatgtttccatggagaatcacagagtcaggttatagcaagagctttcttaactcttcaagagaaatgcaagagtatagttctcagacgacaatggacaagtacccaggaacgtctgcagactgaggggcagcaggatgcaagtcatctgctgaatctcactgggcagattttaaagtctacaagattgagaaatgaggtaattaatgaacactgctacccttcatcagtttctagatgtttaactgtccccagaaagcctcctacagcttaagaaaacgcaaaaacaggctgggcgcagtggctcacgcctgtaatcccagcactttgggaggccaaggtgggcagatcacctgaggtcgggagttcaagaccagcctgaccaacatggagaaaccccatcttacaaaattagccgggtgtggtggtgcatgcctgtaatcccagctagtcgggaggctgaggcaggagaatcgcctgaacccaggaggcggaggttgctgtgagccaagatagcaccattgcactccagcctgggcaacaagaacgaaactccgtctccaaaaaaaaaaaaaaaaaaacccaaaaacataaaacataaccatttaatcaaataataaatctcatgtatggcctaattaattcttccctaagagatctgagaagcagcaaccactggtctgggctgtaagctttcaaactcaaaacaaccactttgcatgtgacatgagttttataatgcaaaagcctgatataatttacatatatcttacagggaagggcacatttcagatttttttcagtgacatatttgtatttaatcctaaggaaaagatggcttataattctctgaaactctaaaattcgtaatatcccagttttaaaagtctgttgctttttaaagctactgtgatcatagttattacatacattaagtttacaaataggcacaaaatagaaaataataagtatcctggagtattgtttttcatcagtttgtgtaaatgtagtgaacgtacagacagatgatggctttttttgtttttgttaagatggagtctctttttgttgcccaggctggagtgcagtggcgcaatctcagctcactgcaatttccgcctcccaggttcaagtgattctcccacctctgacctcaagtgatctgcccgcctcagcctcccaaaatgctgggataacaggcatgagccaccgcgcccagctagatgatggctttttaaactagtcttctcatttctaattttgatttcttagtatttccctaagaactttttctaagaataccaatatgaaaggtgaagtactcttagaagtggcatgggtacattcaggtacagttctcaaaagaactaaaaccaccttatttgctttgcaaatagtcaatgttcgctaccagtgtaatacagaagtgaggagaatggttgagattattttttcatagctcttcctttgtttatggtaatcaggctttgcattctaaaaatgtttcaggttatatgtgcattcagtttctattctgggtgtgtgcattggttgactcctgtaatactaacactttgtgaggccaaggcaggaggaatgagttcaggagttcgagaccagcctgggcaacgtagtgagaccttgtccctacaaaaaataaaaattaaaatgaaaatgaaaaaaattagccaggcatggtcgtgcacgcctgtagtcccagctacttgggtcgctcaggtgagaggatcacctgagcctcagaggtcgaggctgcagtgagccatgatcatgccattgcattccagcctgggtgacagaacaagacccctcaaaaaaatacttctattcgggaaagtggaacatattaatgatacagaaatgggaatataggtttccaaattagaagagttgctgaattttgaagaactaataaccaagacattgatattattgctctgtctcattttctaagttaaagcagaatccttacctgttgaagagggcctgtcttcccaggcccaccctggcgtctgcctatggtaatccccttctgaatgtacagaggagactgaagagggccgttccgttcctaagtagccttgcccaggtataggagacttagatttcctgctgtttgacttgctgatcagctttggtttgcaaactcctcctgaaagtgaaattcaagttaaagtattaatatattaagttctcaaaaattaccaaaatgctaatgattatatattgctaaatgaaaaaaaagcagaatggtaacatgaagaatccagatcctggtactcaatgaaataaaatactacaggcatacctcagagatactgagggtttagtaagtcacaattattttgctggtggatggtcttgcctccatgttgatggctgctgactaatctgcatggcggttgccaaaggctgggatggctgtggcaatttcttttcctttcatgaaagacttatttgtagcatgcaatgatagcattttagccacagtagaactttcaaaattggagttgatccctcaaacccttctttattaactgggtttatgtaatgtagtattctaaatcctttgttgtcatttcagccatgttcacagcatcttcaggggcagattcaatctcaagaaaccactttctttgctcatccctaagaagcaactcctcatccatttcaagtttgatcatgagattgcagcaattcagttacatcttcaggctccactactagttctcttgttcttttttttttttttttttttttaaggcagggtctcacctctgctgcccaggctgcactgcagtggcacaatcacggcttaccagctcactaaagcctcaacttcttgggctcaagcaatcctcccacctcagacccaagtagctgggaccacaggtacacaccaccacacccggctactttttaaaatttttgtagagatggggtctcaccatgttgcccaggttggtctcaaactcctgggttcaagtgattctactgcctcagccacccaaagtgctgggattacaggcatgagtcatcatacccggcctctcttgctatttctcctacacctgcagtgactccctccactgacgtcttgatcccctcccaagttatccatgggagctggaatcatctttttccaaactcctgttaatgttgatattcttacctcctcccatgaattacaaatgtcgttaatagcatctaaaatggtgaatccttttcagaaggttttcagtttactttgctcagatccgtcagaggaatcactatggcagctattgccttatgaaatgtatttcttaaataataagacttgaaagtagaaattattccttgatccatgggcttcagaatggatgttgtgttagcaggcatgaaaacaacattcatctccttgaacctttccatcagagctcttgggtgactaagtggattgttaatgagcagtattgaaaattattttttctaagcagtaggtctgaacagtgggcttaaaatattcagcaagccattctgtaaacacatgctgtcatctaggctttgttccatttctagagcacaggcgagtagaccaagcataattcttaagtggcctaggattttcagaatggtaaaggagcactggcttcaacttaaaagtcaccacctgcattagcccctaacaagagagtcagcctgtcttttgaagttttggactcttccagtagaaggctgttttgtctacatggaagatctgttgtttaatgcagtcacctttatcaaagatcttagctaggtcttctgagtaacttgctgcaacatcttcatcagcactttctccctcaccttgcacttttatgttacagagacggcttcttcaacctctgaatggcctctgctagcttcagccttctcatctgtggcttcctcgcctctctgagccttcagagaattgaagagttagggcttggattaggattaggttttggcttaagggaatgttgtggctggtttggtcttctatccagaccactaaaatcttctgtgtgtcacgaaacactgttttgctttattaccatttgtgtgttcactggaatagcactttcaatttccttcaaaaacttttcctttgcattcacaatttggctaactgtttggcacatgaggtctagctttcagcctgtcttggctttcaacatgcctttctcactaagcttaatcatttctaacttttcatttcaagtgacagacttagtgattcttcttttcacttgaacacttagaagccattgcagggttaattggccgaatttgaatattgttgtgtgtcagggaataagggagccagaggaggagagagacagggaacaaccagtcagtggaggagtcaggacacacaccacctttatgggttgtttgccatcttatacaggtgctcctcatggtgcccccaaacaattacaatagtaatatcaaaggtcactgatcaccatcacagagataataatcatgaacaagtttgaaatattgtgagaattaccaaaatatgacacagacacaaaggagagcccatgctattagaaaaataatgctgatagacttgcttgacacagggttgccataaaccttcagttaaaaaaaaaagcacaataaaacgaggtatgcttgcatttaaaagaaagccaggatttcacttgtaacaatcaaaacaaaaaacaaggttcgtcctcctgccattaaaatgtggtaattaaggaactgaaatttctgggacatcaagccttctttactggcctcagagtacagaaactactaaagaaagaaggcagggtgacaaaaatcatacttcactaatgaccaacccccctttcccaactggaattaatacaccacacaaagaaataatatgtaaaggaaaaactgcagaacaaagcttcttcatgctactacaggacttgagcagaggctcagcaagttttggtagcccttttgatttttccagactgtgtagctgatgaactcagcagaatttcacagaagtgagacacctctgactgtgctctaaaagaaaacatcaaaaagagctcagaagagatcagagcccaggtcatcagcaaattttttcctcagccccagcaaaacaatttcacactgccccaaattcctatacaaccagtacaattgtaattgactaagtcaccagtcttataaccttaaaacacacacacttaaagccaataaaaattggaaggtaagaacagaaaggggaaggtcttaaagttaacatgtatagttttttttttaagacctctaatctctttaatctttttcttaaccatagtgagatagatcttttgcttgaagataacaggaaaataaatctaaactaaaacagaaatactgctgaacttcaggtaattttgaaaagcacaagagatattctcaaaatattaagaaaaaggttgtaagattaaagcttaggattattatggtttttttgtgtgcttgtttttaacagaatgtataaaatctcattctagcaactcttatctggctatccagagacatgtctgaaacaatgcttatcagatacaagcattagcattccggatgatgtgatctgaagaactgtttctttttcttccctttttcctactctttttttttttccttttttgagacagggtctcactttgtcacctgggctggagtgcagtggtgcaattgcagctcactgcaacctctgcctcctgggctcaagtgatcttcccacctcggcccccacaagtaactgggactacagcgtgagccaccacacccagctaatttttgtaatttttgtagagacggggttttcatcatgttgcccaggctggtctcaaactcctgagctcaagtgatccacccaacttaccctcccaaagtgctatgattacaccttttttcctactctttttttatggcttacgattattttattttattgtgtgtgtctgtgtatgtatgtattttgagacggagtctcactctgtttccaggctggagtgcagtggtgtgatctcagctcacagcaacctccgcctctcgggttcaagcaattctcctgcctcagcctcctgagtacctgggattacaggcacacgccatcatgcccagctaatttttgtatttttagtagagatggggtttcaccatgttggccaggatggtctcgatctcttgaccttgtgatccgcccgcctccgccccccaaagtgctgggattacaggcgtgaaccaccgcacccggctggcttatgtttcttttctactgagcctaatttttacagttaaatcacttttattcaaaaacattatatttgtgttacaattacaatgcagtatgtatagatgaggactaggtgcaaacaaataaaaaatggacatcccaggagggtgacactttgggtaaaaattttcttccattttatttctgttcatattataatgtctgggtaggttttcaaaaaccttttttaagtaacggaaaccctaagaggtgactctgagcacataaagacataaatgaaatgtcttagtgatgcatcagaatttgggaaataaactggcttttttggggaaaagcagcagaaaagcactaaaatgaaagctgtacctgaatgaggtgatgggtccccttcctctcttcgtgtctcaccactggtcacaactgaggtgttggcagtaccaggcactactcccataggctgggacatgacaactccatgatcctcaactttgtcatcaaagcttcccatgagagccttcctgataatgtcttccagcccaagattactggcaggatcagcaaaagaatggcctctagagctaactgagcctgaaagagaatcaaaaacatttccacttatttctgaaaggccaatcaggaaacaaacatgcattgccccatcagcccactgaatacacacagcacttggcaagtgacctagaacaataccaggacccaccacacagagacctttttttttggagacagagtctctctctgtcgcacccaggctggagtgcagtggcgcgatcttggctcactgcaacctccgcctcccagattcaagggattctcctacctcagtctcccaagtagctgggactacaggcacccaccaccacaccaggctaattttttgtatttttaggagatggggtttcaccatattggtcaggctgatctcgaattccgaacctcaggtgatccgcccgccttggcctcccaaagtgctgggattacaggcgtgagccaccgcacccagcccagagaccatcttaatccacagataactccttaaggaaatttgtttcccaagtgaatcagtcacccacacttctattaaagttactcaacaattttctcagttccctagttttgacagtgttctttaatagtttcattctttttgttcatttatcttttcaataggtatttactggatctcagttcctttctgtgctactgggtaaaccttccttcactaaattatttatttatttttccatattagagcagtcactcccctggtatacagttggtactcagtacatatttgttggactgactactgctgtgccaattttgtattggtaaataatgtcttttcaatcttacctgacgtagtaactgctggcagattaaagatctcagttcctggctgagcagctgctatatttaagcaaacattcaagttaattaagatgtgataatcatatataccaaactaaagtctcaaaaaattcctataataaaattaatctttttatttttcatgatctcaacctttatttctcacccattaagtgaagataaaatggaagtattttttttttttgagacagggtctcactctgttgcccaggctatttttaaagggaaatcaggaaataggtaaggtaggaacatcaaaagaagagcaataagctgtgtgcagtggtgcactcctagtcccccagctactcagcaggctgaggcggtaggactgcttgagcataggaatttgaggccagcctgggcaacacagtgagactctcccatctgtttaccaaaaataaataaataaataaaaaaagaagcagtgtaacccagaaaagggaaaggaactttgcactgctggagaaaaacaaataggaaaatgctgttctcagaacaggaaccaaggctttctgacgaagaagaaaccttggactctgggatgaccgccacaaataccaacaggtttgaggcagcctgggatgtgatccagaggaaagccaccacagtgaatactatgaaaatgactgtgtttccctgcatggctaactggaaactcaggatatttgctggaaaaaacaaaagactctgttgatccttttcattcctgctgactgtgcaacttgtaatctgcagtttgaatgataacagcataagacctgggaaccgcctataataaagcagtgtgccagaaaggggaagaatttgggacataaattggtgtttccgtcattcccaacttgacgctaagaattttaaagagaaaaaaagaatgcagaaagcaagtgggcagccaaatgatgtgtcccaaagaatgtgaaagttcttttttttttttttttttcctttgagatggtggtgttttattcttgtcacccaggctggagtgcaatggcgtgatctaggctcactgcaacctctgcctcctgggttcaagcagttctcctgcctcagcctcccgagcagctgggattataggccccccgccaccatgcccagctaatttttgtatttttagtagagacggagtttcaccattttggccaggctggtctcgaactcctgacctcaggtgatctacccacctcagcctcctaaagtgctgggattacaggcatgggccactgtgctcagccagaatgtgaaattaattaatttattaattaatttatttttaagacggagtctcactctgccgcccaggctggagtgcagcggtgcgatcttggctcactgcaagctctgcctcccaggttcacgccactctcctgcctcagccccccgagtggctgggactacaggcgcccgccactatgcctggctaattttttacatttttagtagagatgggatttcaccgtgttagccaggatggtcttgatctcctgacctcgatatgcccgcctcggcctcccaaagtgctgggattacaggtgtgagccaccgtgcccggccagaatgtgaaatttctaatgagaccacagaaggatggactcttacccaagggctgagcacatgagaggagggaagagtgcatgtgcctagaaacaaacttggttgattagggaggctttaaactgacagaggagaaaagtcctcagaagaactagaaaacaatggccatggatgacagtcttcttacttatgggccaggtgacaaggtaaataaattgagcctgaaacagcagagccctgttatcatgaagtgtgtggaacaggagtcattcatttgatagatatttaattgagcagttatttgactgaattgttaagattaccttattgatcaaaaatggtcagatgaagacaatttcctataagttaaccaatgataatccttagatactgcacttgcaggataacccttcctttgctaatggagcttacagtgcagtgtggtacttgctaaggccatacaaattagaatcacctgggtagcttagtaaattttctacattcctggggctccataattcaactatttaataagcaatccaggtgactggtacctactgttgagcaagaatgtggtaactgctcagaaattagcagaatggaaggtagacatgtgaaagccactgtggaggccaacttgacaggaggagctgactcccatcaggaggcagagagaccaggatagtaatggccagagtaatggtaactgttaactgtggtagggaaggaggaggaactttttgtatggggaggtagaacatggattcaattttagatatttaaggagccagtaagttagtcaagaagtaatgaggtctgcaaagatatgtaagtagagcttagtaggaaaagctgggctacagatacaaatttgggagttttcagcatacaagcgaccattcaactccccagagtagatgagatgactcaaattataagacatgaggagaaaggggctaagaagtgagccctggggaaaactaacaatcaagggccaggcaaagcaagactgagcttctaaggagacagaagtggccagagaagtagagaagaaacaggagaacatggcatcagaaagccaagagaggaaagcatttcaggaaaggaaagtggttcactgtgtcaaaagctgcaaagagatccaataaagtaagttttaaagcattacagttttcaaaaaaataaagtcactgatgtccttgggaacactggattcagatacaatgagctgaagtgaagctgtgttggctgctgatggctttcatttagttctacttcccagtgaaggctaaatgtgccatggtgggcccaggagcccactggttctttaatataaattctcctttccaccatgaaaaatagttcttgcaataaaaaaaaaatcccagactctaaagcaattctgttagtacttcccttaagacattaattatctcctgttaaagttaggtacttgtttcatcatacagcttcagagaatagagaccatgtggcatactaaaacacccaacatagtacgctactgaaaacattaggcaagagagaaaaaactataaagtaggcttcttcagttcaaacatggcatttccctgtcaaagagtttcccactttaagggtaagacaaagactacagaatgagcagaccacacaaaggtgaaatgatttgcatctcagttcctggctgctctgagatctctagctctccgtgctcacacagattcatctctgagtgccaagagaaattgaaaacaagagtatatttttgttggtgacacttgaggagctgtaaataatagattaaactgttgaagactggagacagaaaatagtaataacaatattttttgaaaaggtggccggatacagtggttcacgcctgtaatcccaacactttgggatgctgaggtgggtggatcacctgaggtcaggagttcgagaccagcctggccaacatggataaaccccgtctgtactaaaaatacaaaattagccggatatggtggctggtgcctgtaatcccagctactcgggaggctggcccaggagaaacacttgaacccgggaggcggaggttgcggtgagccgagatcgtgccactgcactccagcctgggccacagagtaagactccatctcaaaaaaaaaaaaaaaaaaaagaaagaaagaaaggctatctgtaagcctgataacaattctggtcagcattctaaaatatttgtcttttattttgttgccacctaaacagaacctagtaattaagagcgaggacaagttcagaaacagtggtgacactggctcatccttttttccttggtgttcaacatttattaatcacaagagtgacacagatctaaacaaacatccaccaggcagttcacagtgcaaggcccccactttcctttcttttgacaggatcaggagactagtagatggtagatcacagaaataaagcagatcgtcctttcctcagctgccaccacagtgcttggtccttccaaggaagctaaggccacgttgggatgaggccctcacttcatccggcaactaccaccacgtccggcagcgccagccccacacttgcccataccatgtcctctgtctccgagctcgcctgcatctactcagccctcactctgcatgacaatgaggtgaccatcacggaggataagatcaatgccctcgttaaagcagctggtgtaaatgttgaacctttttggtccagcttgtttgcaatggccctggccaatgtcaacattgggagcctcatctacaatgtaggggctggtggacctgctccagcagctggtgctgcaccagtgggatcctgcccactccactgctgctgctccagctgagaagaaagtggaagcaaacaaagaagaatctgaggagtctgatgatgacatgggcttttggttgttttgactaaatttcttataacgtgttcaatacaaagctgaacttaagaaaaaaaaaaaaagaataaaccagactatggtctacccaaagtctctctatcaaggggactgaggaaaagactgataagactggggggatagttagtacaagtgagtgctgagagaacacgaggaggttctgattaatacttgcatatcaacccagaggaaaaaggttctgccacagaacattagctagaatatttaccaacaatctggttaagatgctatgagtatggaactgttagaagccagttggtccatcattagcaacatggactctggagttggaatgcctgggtttgaactgcagcctcattacttactagatatgtaacctgtgccaactcttaaacctgagtctgtttcctcatctacaaaatggagataattgtaatatgtagggttgttgtgaggattaaatgagactatatctacacatgcttagaatagagcctaccacatagtacgctagataaccttttgctaccattattactgattttatatttttattttattaatttattattttttgagacagagactcactttgttgcccaggctggaatgcagtggcacaatcttggctcactgcaacctctgcctcccaggttcaaatgattctcatgcttcagcctcctgagtagctgggattacaggtgcacgccaccatgaccagctgtttatatttttagtagagacagggtttcaccatcttgcccaggctggcctcaaactcttgatctcaggtgatcaacccgtcttggccttgcaaagtgctgggattacaggcgtgagccaccacacccagacaatttaaaaaaaatttttttttttttcttgagacatctcactctggcttaggctgcagtgcagtgatgcgatcgtagctcactgtagcctcaacttcccaggctcaagcaatcctcccacctcagcttcccatgtaaataggactacagggatgtataccaccgcacccagctaattttttatattttgtagagatggggtctccctgtgttgtccaggctaatctcgaactcctgggcccaatcaatcctcccgccttggcctcccaaagtgttgagattccaggccaatgttttatttttacacggttagtttatcagagttgcatatgaatagtgaatgaatcaactcaagtccacaaagacactggtagggtagaaaaagtagctggactggagcaagcacagacggacttggacttgtcctatacttggagctagttactgtaaaagtagagcgagggcaaggcatgaattaaaagtagcccaagaccttgacatcaacgttcatactaagtacttaacagtgcacttcataacttaacagtgtataggctgccaacaaaacagctaatagtcttaggctactttaaaaatgatgaatttagcatagatcatattatactactctattttgtattactcgaaacctagtgaaaggctaggttaaatgtttttggtggagaataactgagatggtaggggtactaagaatgaggacatgtgacccacagctgatgaaactggggacactgattgagaggactcctgaaagacacgtcttcaaatatctgaggagatgttatgtggggataggcccaaatggacaaaatgaagactgatgggtaggggagaaagaaaagtaaactatggagagttaatccagtcctacataaagaaaagtaacctagacacagcatttcttcaaagagaaacggcacagcttcagaaaggagcgaactcctgcctcctaattagaactcttcatgggctggcagacacttgagaaggaactctaggatcagatgtgttggacagatgtcctgtaaagagccttcaaactcaagcattacaggagaggcaacactggagatatcattattaatgcatgttttatttggggttcatgaaagaaatcccacttacccatatcagagtcacctccaccagaggagttcaacttacgaaaaatctcctgcttctttgatttaaccatgggtgatgtattttcaagcttggtgaagaatgaaggcaagtagcttatactccctggtgagcgggcatcattcctgttagggccaaagttaagtatattacaaccacgtactcctaatcctggggacattcctatcaatgataacaacagtcagagagtacttagaaaactactgcctcctcatcctgtgtttgtggttacagccctaagaaacagtatgtaatcataaaccacttagtacatcatttgaggaaaaatgatttagctctcaaaatgaaatcataaaattagaattagaatggagataatctagagcagaaattcttaggaaggaatgaagaagcagtaaatgaatattaataggaaaactcagaaacagcttatgatgctctctccttaacagcacaaacactgatatattaatggttaccacctaaactgggaacaattttactagaattagttttaagtacactaaaattaaaactaatagcacgcttgactacaaaatagcaagaactcatatctaagcaatcaacagctggactggaacacaacagtataggaataaaactgcctatttgttacaatcatttcaagcaacctaacaaatgagctgagtttaatataaagagtttcatattttactggcagcttcctatactaacacatttaaaaaaaaacaaggtttccctaaaaactccaggccaccaaggatctagctagagccagagatgagaacagagactataggttattgaaaacctaatccaatcatgtggattcagtcatcattcaaacacaagaacacgtactctatgccaggaaagacaattaaggtgataggaacaggaataagacatggtccctgtcctcaaaacactcataaacgtaggggaaagatgtaaatgtataattaaattgaacatcactccctctccaaaaatggattttcttcatttcattgaaaagtagcaatatctgtttagctccctaagaataaatgcaataaattaatagcaacactttgtaagaaaggcactagcaatttggagttagaaaggccttcgtttaaaactggcccttccccattagtatcagtacgaccatgagcaagtgacatgtctggctttcagcgcatcagtggagggttcagcactaggcaaactgcacgactatggacagaaaggaattcagggaacaataagcaacatgatttggacagagattccagtgtagggatgatgcagagggaagtgaagctgaatgcgcagcatacacctggtcatgccaggaactcagatgccatgcaaaagactgggtgctggattctgcatgagttttagacaaatcactcaggtggaggtatggagactgactggaaaggagccaactcaaaggcatctagtcaaatggggataatttaataattaatagggttggggtcacggttagaaataggtaagattaaatctattcagagtccacagtgcttggtatacagtaagcattcaaatgttggctgaatcaatggatgaccctttcccctagacaaaaacattaaaaaaaaaatctagaaagatttaatttcaagaataatgaacaaatattttctaacctatttaaatatgatattataaatattttctttttgctaaaatacactagcattagatgagtaggaaaagagacaaatgatcctctaagaatgccatccagacataaaagcccaaagttctgagaaaaacggcaacaactgaaggaaatgttaaagcatgagcacccacgccatgaatggttgctgtcactaggaagcacacttacctctgctctgcaggctctgcgcccctctgagacaagagcagcaagctgtcctgtttctcatgcacaaccggaacctggggtggggagatgggctcgtagggctccgaagagacgtgactcctctctggggattttccaggcctactattgtaatatgtgaaatattagattgtgtttcaaaggctaacctgggacttacctaaacagaaacttgttaactcatgacttcattcaggagaaggagcaaaagctgccaatttctatcagaaaaaaagttgcctcaggtattcactatatacatagttaaaacaaacaaacaacaacaaaaaaaaccactgtgttactgccacttgacccatgcgcgccccgtggatccaggagtcacgtcatcagacagtgctgcccgggcagcagcagtggcagaagctgcgtccttgaggctccgcatgtccttcaacatcagacaccatctcacccttggctccttagtccaggtgaaacctcaagggttttcctacctattttgagtcgactgaccagttctttcatcgtcaagttaaagataaaggacttcagtactaaactgacacccaagaagttttatcaggtgagtcaacataggttctagttacactatattatggcagaggggttctctgcaattttatattttttctctggataccatttggtaagaataatataagatagacacactgtttagctcccacccatttatcattttttttttttttgagacagagtctggctttgtcacccagcctggagtgcagtggtgtgatcagctcactgcaacctctgcctcccaggttcaagcaattctcctgcctcagcctcccgagcagctggaattggaattataggcatgcgccaccataccccggctaatttttgtatttttagtagagacggggtttcaccatgttggctaggcctcctgacctcaggtgatccacctgcctgggcctccaaaagtgctaggattacaggcctgagctaccgcacctggcccatttatcttattattaaaatttttattttttagagacagggtcccgctcgttgcccaggcaggagtacaggagtgcaatcatagctcactgcagcctcaaactcttgggctcaagtggtcctctcacttacatctcccgagtaactgggattacaggcatgcgtcaccatgcccagctaatatttttattatatgttttattatgtctggtggcccatttttaattttttgtagagacaggggtctcactatgttgctgacctcaaactcctgggctcaagcaatcctcccacctcagcctccaaaagtaatgggaattacaagcacctcgccccaccacaccctcaatttttttttttttttaagacagagtcttgctctgtcacccaggctggagtgcagtagcacgatcttggctcactataacctccacctcccaggttgaaaggattctagtgcctcagcctcctgaatagctgggattacaggtagccaccaccacacttggctgatttttgtagttttattagagacggggattcaccatgttggccagaatggtctcaaactcctgacctcaagtgatccacctgcctcagcctcctgaagtgctgggattacaggcgtgagccaccacacccggccctgctaaaattttttgacatagcgattatgcatatgaaagccacctgtgactttcaacatctggaattatgactattagactaaagcaaaattataatatgatttgttatggcctttctcaatcagcccatccagttgttcaagatagccactttttttttaagttgttttgctgtttacctccaaaactctgtaaataatcttaaacatgttttttttatttataaaacttgaaacagtatctgttaactctcttccatgaaagatgaagaatttgatttgccttctctgttgttgcccattttatttttatttttatttttatttttgagacagggtctccctctgtcacccaggctagagtgcagtagtacaatcactgcttactgcagcctcaacttctgcgctcacgtgatcctcccacctcaggctcccaagtagctgggactacaggtgcatgccaccatgcctgggcgattttattttttagtttttttgtggagatggggtctcactacattgcccaggctggtcttgaaccgctggcctcaagcgatcctctcgccttggtctcccaaagcactgaaattacaggtgtcagccactgtgctggcttgcctattttaattttgtccattttgcctttacatagcatacttcagccttttatattttcttttttaaaaatgaagaaattagcacacatacccttacttctccatctctttcctatgcaaccctcacctcccaatatctgtcagccatttttaagatttattgcatcacatccttttctagaactacagagaaactcctctgtgttttgcttataaaaatcactccatacaattacatagaaattcaataacctgctcctggagtacataatgaaataaaggcagaaagcaagtttttttaaactaatgagaacaaagatacaacgtaccagaatctctgggacacagctaaggcagtgttgacagggaaatttatagcactaaatatccacatcaaaaagttagaaagatctcaagttaacaagctaacatcacaaccaagagcaaacaaatcccaaagctagcagaagacaagaaataaccaaaactgcagggggcgcggtggctcacacctgtaatcccagcacgtggggacgctaaggcaggcggatcaccggaggtcgggagtttgagaccagtctgaccaacgtggagaaaccccgtctctactaaaaaaatacaaaattagctggggtggtggcacatgcctgtaatcccagctactcgagaggctgaggcaggagaattgcttgaaccaggaggcagacgttgtggtgagctgagatcgcgccattgcattccagcctgaacaacaagagcgaaactccttctcaaaaaataaataaataaataaaataaacaaaacggaagctgaactgaaggagattcagacacaaaaaaacactcaaaagatcaacaaattcaggatctggtttttgttttgttttgagatggagtctcgctttgtcgcccaggctggagtgcggtggcgcgatcttggctcactgcaagctccgcctcccgggttcacgccattctcctgcctcagcctcccgagtaactggaactacagatagatgccggccaccacgcctggctaattttttgtatttctttttttttttttagtagaaatggggtttcactgtgttagccaggatggtctcgatctcctgacctcgtgatctgcctgcctcggcctcccaaagtgctgggattagaggcatgagccacggcacccggcctcagaatctggtttttagaaaaaattaataaaacagactgctagctaagactaatagagaagattcaaataaacacaatcagaaatgacaaggaatattaccactgaccccacagaaacacaaacaatcataagaaaatattatgaacacctttatgcatataacctaggaaatctaaaagaaatggataaatttctggtcacatacaccctcctaaaactgaaccaggaaaaaactgattccctgaacagaccaataacatgctctgaaattgagtcagtaataaatagcctaccacccaaaaaaagcccatgaccagacacattcactgctgaattctaccagatgtacaaaaagagctggcaccattcctactgaaaatattccaaacattaaggaaggactcctccctatctcattctatgaggccagcatcatcctgataccaaaacttggcagagacacaacaataaaaagaaaacttccggccaatatccttgatgaacatgaatgcaaaaatcctcaacaaaatactggcaaaccaaacccagcaaaatattaaaaagcttatccaccacaatcaagtagatgttatccctaggatgcaaggttggttcaatatacacaaatatcaatagatgcagaaaaggctttcaataaaattcagtaccctttcatgttaaaaactctcagtaaactagatattgaaggaacatacctcaacataataaaagagccatatatgaaaacccacagccaacatcatactgaatgggcaaaagctggaagcattcctcttgaaagccagcacacaacaaggatgccctctgtcaccacttttattcaacatcctattggaagtcttgaccagggtgatcaggcaagggaacgaaagaaagggcatccaaataggaagaaaggaaatcaaactatctctgtttgcagacataatcccatatctagaaaactccatagtctcagccccaaaggtccttaagctgatgaaacaacttcagcaaagtctcaggatacatcagtgtgcaaaaaatcactagcgttcctatacaccaatgagagccaagccaagagccaaataaggaatgcaattcgattcacaactgccacaaaaataataaaatacctaggaatacagctaaccagggaggtgaaagatctctacaaggggaactacaaaacacttctcaaagagataaaagatgaaaagataaaaaatgaaaaaacattccatgctcatggataggaagaatcaatatcattaaaatggccgtactgcccaatgcaattcacaaattcaatgctattcctattaaactaccgaagacattcttcacagaactacaaaaaactattttaaaattaatatagatccaaaaaagagcctgaatagccaaggcaatactaagcaaaaagaacaaagctgtaggtgtcatactacctgacttcaaactataatacagggctacagtaaccaaaacagcattgtattggtacaaagataagacacacagaccaatggaacagaacagagaacccagaaataaggcctcacacctacaactgtctgatcttcgacaaacctgacaaaaacaagcaatgaggaaagaattccctatcaataaatggtgctgggataactggctatcacatgcagaagactgaaactgggcttcttctttataccatatatatataaaattaactcaagatggattaaagacttaaatgtaaaaaaaaaaaaaaaaaaaaaaactataaaaaccttggaagacaacctaggaaatacctttcaggacataggcagggacaaagatttcataacaaagacaccaaaagcaactggaacaaaaacaaaaattgacaagtgggatctaatttaaagagcttctgcacagaaaaggaaactgtcaacagagtgaacagacaacctacagaatgggagaaaaattttgcaaactatgcacctgacaaaggtctaatatccagcatgtataaagagcttaaacaaatttacaagaaaaaaacaactccattaaagagcgggtaaagcgagtgtggtggcatgtgcctgtaatcccagctacttgggaagctgatgtgggacaatcacctgagcctgggagggttgaggctgctgtgagccgagactgcgccactgaaatccagcctgggcaaacagaatgagataaaaaagagagtgggcaaatgacatgaacagacacttttcaaaagaagacatatatgcagccaagaagcatatgaaaaaaaaagctcaatatcactgatcattagagaagtgcaaatcaagccaggtgcagtggctcatgcctgtaatcccaccactttgggaagctgaggtgggtagatcagctgaggtcaggagttcgagaccagcctggccaacatagtgaaaaaccctgtctctactaaaaatacaaaaattaaccagatatgggggcaggagcctgtaatcctagctacttaggaggctgaggcaggagaatcacttgaacctgggaggtggaggttacagtgagctaagatcacaccattgcactctagcctgggcaacagggcaagactctgttttaacaacaacaaaaaaagagtaagtgccaatcaaaaccaaaatgagacaccatctcacaccagtcagaatggctattaaaaagtgaaaaaataacagatcctggcaagactgtggagaaaatggaacacttatacactgttggtgggagtgtaaattagttcaaccactgtggaagacactgtggaaattcctcaaagacctaaatgcagaactaccactcaacccaacaatcccattactgggtatatacccaaaggaatataaatcattctattataaagacacatgcacatgtatgttcactgtagcactattgacaacagcaaagacatggaatcaacccaaatgcccatcagtgattgactggataaagacaatgtggtacatatacaccatggaatactatggagccatgaaaaagaatgagctcctgtccttttcagggacatggatggagctggaggccattatccttagcaaactaacgcaagaacagaaaaccaaataccacgtgttctcacttataagcgggagctaaatggtgagaacacacggacacatggaagagaacaacacacactagggcctattggaggatggagggtgggaggagaaggctcaggaaaaaataactaatgggtaccaggcttaatacctgggtgacaaaataatctttacaacaaacccccacgactcaagtttacctatataataaacctgcacatgtactcctgaacttaaaatgaaagttaaataaataactaaaatgaaaatcagttgatgctgttttctaacaccacagattgtgcaaacattttcatcaggaatggaccatgacaatgctatatagttttccatttttctttgataatcacatttcttttctttttttggttttgttttggctgaaagggaataaatgtgctttcatcttatccttaaggttatccagctgcgtctaatgactaagtccgagatttgcttcaaaattatccagtttgggggtcggggcaagcggggatgaaaatgaaacaaaactcgtcatacactgaggattaccaaaattgggtgatggatacctagaggtgtattatacttgttctctctacttttgtatgtatttgaaaacttccacaataatttttttttttaaagaagaccatttagcttcttatttatattcttctatctgctctttgctcactttgatgggttggtaggtaggctggagaatcacttctgctacaaatttctctttttcaggctctgagccatggcttccattactctggctcatgtgtcctctatgtcttcaggtatttgccagaatctttgatctgcccatatctcagtcttgttctcagcattctttttatcttttttttttttttttttttttgagacggagtctcgctctgtcgcccaggctgcagtgcaatggcatgatctcgggttcaagtgattcttccgcccaggttcaagcgattcttctgcctcagtgtcctgagtagctgggattacaggcacctgccatcatgcctggctaattttttttttgtatttttgtagagacggggtttcaccatgttggccaggttggtcttgagctcctgacttcagatgatgcacccagcttggcctcccaaagtgctgggattacaggcgtgagccaccacgcccggccttctcagcattcttaaatttatttccctttgtgcttgttaactataatttaacatttgctaatatttagtctaccactttgaagcaagaatcctgtgtccactttattttaaccaaacacagaatatcaggtaagaagatatgctctttatcagagagccctggcatataacatgtttccactcatgatgccactattggcttccctttcctttatttaaggtcaccttaaaatatatatgtgtgtgtgtgcatatatatatgtgtgtgtatctatacatacatatatacatatatatatatataaaattattcactgacagaagtctgaggcctagaataaaatataaatgcagaagcaagcaaacaaacaaacaaaaaatatataaactttttttttgtagagatgagatctcactatgttgcccaggctggtctcaaattcctgggctcaagcaatcctcctacctcagcctcccaaagtgctagcattacaggtataagccactatgtctggccaatatcaccttcttaaacttctactgatgctgacccagtagaaaccattgagacagataaatatgagaggtattattcggaagcaccactgaagtgtccccaaaccactaccaaactacacattcttcttaactgtctttacaaaccaacaaatagaatataatcatcttttgaatatacattaaaaagtcatagtaccaaatgccaagacagtggacattctaagaataatatgcagggggaagaaagctcatttacactttcctgggaataaaggcaaatgaactttagttgtgagaaacaaattccttatcctgtagatatattccatttgttttactgttgggcaatttatatataatttggaataaagatcataccttcccctggatttgtccacaagattttctggagagacccttgaacctggtctttgatgatggacagactgagcctgggattctgggctgtaacggtttgatgttttagtcctcacaggtgtagataccaaagcagaaggtgagttctggaatgtagaagtaggaggctgctggggagtctgcgaggaaacttgatttctagcaaaatcttgtgtgataatttgctgtgaatgagaaatgaaggaagtggtaaaattcattgagtacttgcaaaaaaaaaatagtattaagaaatctagatatctttattataaatttctttttctatatgaaatctgctttccccatgatcaaaaaagaaaaattaactaataagaataatgaaaaacttacacagatgtgatcagcaagtgtgatcagccgatgggtcctgggcacttgccccattccctctgcctgtgaagaagggggcagctgttgttggggagatggtgattcctgctgtggtcgatagtgatgtaatggtccttcatattgtctggtaggatcatctaggagagaacacatagatgtcttactccaggaatgtctgtgcttttcactcattatcaaagattaaatataattcagaagaacacctgaaaggatgtggtacatagctccaaacaaagaacttatcttaattttggagaaaaaaaaaattattcactgaagaagtctgaggactagtggaacaaaatataaatgcagaagtaagcaaacaaaattaatataaacaattttctgtatcattaaaaaataaaaaagaatcgattgctgtttctaaagaaggctcatgtaagattaccctaaaacaaacaaaacaagttaattcttactatggtctagacagataattagaagcaaatgataaatgcaaatatgaaaacatgtaaatggtagcttaagaagacatactttccgcttgatttgccttaacaacctctggctgataggtctgcagtttctcctggggtggcgcaggtgagctggcaggacttatcacctcaatagcatcgctaggtgtttcatacctgtgagaagatactttaagaaaagaaaatcttatttcaaaactaatcccaggaaaagtttctgaagtctaagttcttcacacctgtagcattttttcaattctgatccaccatgttcaaaggtattccaggttaatgagggttttctgaagttttatgggctttaagacatgttttaggctgggtgcagtggctcatggctgtaatcccagcactttggaaggccgaggcaggtggatcacctgaggtcaggggtttgagaccagcctgaccaacgtggagaaaccctgtctctactaaaaaaaatacaaaattagtagggcgtggtagctcatgcctgtaatcccagctactcgggaggctgaggccggagaatcgcttgaacccgggaggcggaggttgtggtgagctgagattgtgtcattgcactccattctgggcaacaagagcgaaactccgtctcaaaaaaaaaaaaaaaaaaaaaaaaaaagacatgttttaaagcccaataataaacactggaatgaggcagaacagagaacagatttatgatattttcctgggagctggaaaagaaatcaccagggaaacatttatggaagaggttaataaacaaatgagggagtagatctcaataactgattccaatgattccaattctgtgggacactctgttcttagaaaaacgctgaggctataaagctgcttcattcaccaccatgatgattttaaagctatggattatataacactatataatgattttctcaaataaatggagtattgctaacaaaacttactccaaacattaataattttttagcactgtgttacattgtgaaaataaccagaaatggtagagaatgtctgaagggaagtatattcccagaaagggaggatgtcaaccaactctggaggatacccacatcagaaaaggacctcctctaagacacagttcccaagtaaacagagggctatgcagtggggctaacaggcagcttttcacagtcctgccatagcctcagagctgacagttgggagcagatgtaaccgcctgctcaggaacctctgaattcagagggctcttcacatccacaaactgcactacagaatctgagagcactgtcagagctccaaagggtgcatggccctgggctggacacagatgcagcaggtgggaatgaactctgctccctagccaccacctgctcctctggtactcaacagtccttcctatccccaccaggtcatggaaactgcagctacctgggttctagtacacttaggagattggaaacttgataaatggaacagaaatgatcattgagaaactaaaataaatcactatattctaagaagtttacagtaatttgtgacttttgtatccactgttactcatcactgtttatgtattcaacatcctaaatctggttacaacttccaatattcactcagtagaaagtcggaatccaaaccgtgttcacattgttcttgaagccttaaggggcaagactatggcaatggacctccccttcaggatgaggaaggttctcaagagtcaaactgaaaaccacactgaagaactgtacatagcctttggacatcatggaattcactgaccagtgataaaaaagataaccacacacagagacatggacactcagaaaagatgagctttctattttcacaccttctgaaaatcaaattcctaaagcaaggtttggtttgtgatgcaaactgaaaagaaatgtttaatccaatgattaaggaacccatgtgctataccattcaataagcccaggtgggatctcccagtgtgccggtgacttcccttcaaaagacctattcatacaactatagaatatctctttctcagctagcaattttctgcatgcagaaaatctatattgcagattttcctaatctcaggttaaaagaagtcttttgtctacacaacactaactctctctctaaaagcctcagcaatgcggtagatatgacgtaaacaaattataattaagctagtggatactcagagatcaaaagaactgcacattgcattctggagcatgagaaatcattttttttttcatgatgtctaactctactgaatttattcaatggagataacagaaagatgattatatatgattaaattacttccagtattagcagatgcttatttaaatacttgcttgttctttctgcaattccacatagaattaaggcaatagtttaaaagaaaatttaaaaagtaacttttctagcattttaatgtagacctgtgaattctaacacatttgcagtgtagccatcctaatgactaaccagacttgaacaaaatccaacttgcaaaaacgatgcaatataaataccaatcaccaataataggtagtctcacttttaaaaacctgtgtcttagaaaaaggatattagaggctttggggtattggcataaatatagaaccatgtcctagcaaatgcttcctgagaaattacacctcagtagcccagagcctggcgatatatccattacctttcagatgcctaaatatgttaataaggtctgccttctactttccaaatttaattacatgaatgatacagttttcttgtggaagatacattgataggcttatatgtaggaaactgggatatttaaataatcataaaaacagcagaagatacatttttgcattacatttactatcaaccgttaggatttttaaataccatatagttctacttgacctaaagaataaagtaattctttactcagacatcacattgtgaaactcggattgagatacatacagctactagaagagtctgaactttgagagccacgttccctcgcatccttgtccgaggcaatttgccgggtgatgatcacgtctatgaagttagctgcagtaatggtagtcttccctctggtccttagctcttcctcatatctggattttggaggaggccctttatctttcccagcctcagaataaactactgaagaatgaggctggggcttgccacttggaaaggctgaagaagtgtataaacactgaacagatctcttctccacctccagggttttctgctctagctgctgctgttcactaactgctgctgacctgcttctcaaattttcttctaacctggcagcttcatgcttactctcttttgttttggacacatccatctggggtgcagaagctgcagcatccacaagagcagccagggcatccgcagcagtgttgtaacgggaggctggcaggccttggcttattgaagggcccccagcaggcagtggcctgtaaataaaaccaaatcacagctctgtgaagggaagaccatttgctgggaatgtggtggggagatggaaggacaaactgcaacaacaacaaaaaaagccttcatggcatgggcagaaaagcatgactatacttagactattgcagtcacaaattttaaaatgtatatgcaagagacattttttgtcaaaatatgtacaagagactgacatgattcgtagctgagcagttggatccaaaggtgtgattacactggttccattggttccttggaaaacactgggtctctgttgcaacatggtctcctgagttcttactgaaggggaaggggagcgaacatatccatgactgccaggtcggccaggctgttctgagcctgcagaggtgaaaaagagaaagaaacaaagacataaggaggaagccagagacaaaaggaagcaatgcttatggattgtttatttcctaacatacctaaatagaaaaaagaaaaacaagataagaaacttgatagtctactttctggcctttccagaaatatgttctaaaagtgtccaaataaagatgcaataaaaccgcagcagtaacttgaaacaaaacatcagccatcatttactgtcatttccatttctctgataaatttcaatcttgattccataaataaaacagcaccaacaagaagtactactacaaatcatataagttcatctttctgatttttcctcaaactctagtgtgtatatgatttccaaaatctaatcaggcacaactttctaagcatcataatgaaaataatataccactgctacactagggtttgagactgtttcattcaaccacagtttgccctgcttcacttcttcactgtccccttcacaggtgactctttctctcagcaagctctctcttttgaaatgaaatcattcacattatcttcccacaaaacacttggctcccacaattacacttctacaatatttggtatgtttttgttcacttaaccctaactctcccataaccaagtcagagcttggacttggtaagaactacttcacgcagaggattctgaactctcaaatccctccccagtcactttcttcttgacctcatcttgttctgtgtcctcactccaaccttctaacgtgctcactggcttcataacagctagctgttttatgttttagcacacacccctcttctcacagacaccaccacctcagccaggcttctcagcagttttctcccttctaaccattcatcagcttatatgaatatttatttttttaattaaattaaaaaatttttaagagacagcatcacactctgtcacccaggatggagtgcagtgacactccatagctcactgcagcctcaaactcctggcttcaagggatcatcctacttcatcctcctgagtagctaggactacaggtgcacaccacggctgctggctaattttttatatatatattttagagacagggtctcaccatgttgctgaggctggtcttgaattcctggcctcaagcaatcctcctgccttggcctcctgagtagctgggattataggcatgagccaccatgcccagcttatctgagtatttctatgggatatattcctagacgtggaattactagacaaaagagtatttaaaatttttatctccacagaggctacatccgggaccagccatacccactcttcagggttttaatccatctattccactcgtgtaaatgtccctctgatcatgtcacctgcctcctggacacaacatttcactgtaattcaagatgctacacaagctgctaactgtattttccattcctcctctaaactcaagctcaacaacacctttatatctaggagtttttgctagggctgttctttcagccttgaaagctctgtgaccaatatcttcaggcccaactgcagtccactgtttgcaccaaataaaaatgataccttcatcatgaaaacatttttccgtgtaaaattcacgtttccaccatctcagctgctacagcactttcacctgtttttcacttggggcctgtaataacgttgtcttagaatttttgtttccatcaaaactttttgtgcgcagcattaagcacagtgtacaagattactaagatgtgtccagagaatggaagagcagtgcctttcactgacctggccgcaggtagaggtcggaggaagctgcagcaatccgttcccgctcccgctccttctcccgctcccgttcccgttccctctcagcacttgcagcagctgcaaggtgtgttgggtgtcctgtaaaacataaacctgcagcttaaagataaaaatatcaactgactgagtatatcaaacaattccgaaattctaagtgactgaaaatttttcaaaaagcttcaaatttgggatataagaagtttgttttggctgggtgcagtggctgacacctgtaatcccagcacttcgggaggccaaggcaggtggatcaccggaggccaggagtttacgaccagcctgggcaacatagtgagaccctgtctctactaaaaacacacaaaaaattagccaggtgtggtggcgcgcacctgtaatcccagctactccagaggctgaggcacgagaatctcttgaacctgggagatggaggttgcagtgagctgagatcacaccactgcgctccagcctgggcaacagagccagactctgtctccaaaacaaaaacaaaaaaaaaacaagaaaagagaaaaagaagtttgttttattaagagtcctggataagaactgaagcataacataagcttttaaggcattcctaaggtatctagtgacagctggcacataagaactactattaaatgttaaaagaaaaacaagaaaccaaatgaggaaaaattgcccaagataccttaaaaggctatgttgtaaaaatgtaaacatgatggttctattagagaggtgtgtaactgtacaatctcacctggagacatggaagcagagttgtacggcctgggagggaaagtaatctgtgtaccaggaatataagtgattctgtccatgggaggagtgcttgttccccctggatgaggcactaaaattgttggaggcatattggtcaggtcaatgattcctatccaaaagacaatacaatttatgttaagtgttattctaaaggtacagaaccatacatgactttggattttgtctatctctgtgaatcaagggtaatttgtacataatataaataaaaatgtttactatcatcattactttttaagacattctttaaagaaggatattaaagactgtacttcacatcagtaacctcaaagtatgggcagattaaagagagcaaatttgtaagccatggattacaaatactcagcacaaggatttggtttagttaatttcagtattcaccaaaacaccttgtctcaatgtatgtctctgggctaaaaagtctacgggaggaaggatatagtattcttttctttctttctttccatcattcattcaacaagtatttactgagtacctaagaaacactaggtaaacataataaattctacgaaatctgaaatgcaaagacacacacctctcgttgctgggtatgggagacccagtggctgctctcttggggagagtcctctggccacatctggacgcaagttcacttgcatctgttgtgaggtaatgtaatcatttaagattgtctgtcttgtgttctccattgcgtaaagctgatactgacttgggtaacctggagttggtgaaagctgtctctgaaacaggtaagcagccgctgctgattgagagaatgaaagaaaggcactgagttttgtcctggctgaaatacatttgctaaacaccacgtacaaaagagtagagaaaaatcacatgctgagctagtgcacatggaacttttacttagctacaaggattaaggtggatttattttagaccttgatgtattagcaatagcaattctaatgtctaagatgtaatggaaaaggggaaggataacagtagctaaaaacttctcaagtagttttactttcaatctttgacatgtaactttatcatatttttacctggcatctgcaagagttgtgtttgaaaataaaattgtctttatagtactgatcatccagtacaaccaacagaaatgtatacgaaaatactttgtggcaatcagtaactttactctccagggggtgaaaatgattatagactataagcatttaattagtccatgtgtttggagcagagattggcaaacttttgacataaagggccaaatggtaaatatattttaggctttgtgggccatttcgcatttgtcacagctactcaactctgtcactgtagcacaaaaagagctacggaaaaaaagaataaatggtgtggctgtatcctaataaaactttatttacaaacacaagtggcaacaggatttggccaaaaagctgtagtttttagcaacccctaggtgagagaatgacacaagacacaagatacgaggaaggggtaggcgtggtaaaaagtagataatgtctctctcctcaaaacattataatccaactcaggctcaaaaacaagcaaaagaaaccactacaaaatgaagacaatgataaacactaaatagaaaccagaaaaattccattttgtctgagaacttgagtgacctattttatatgtatatgttctccctagaaaaacaagtaacatgttttctggaatatttgcttccccttcatctagaagctaggtaagtctgtcagctgacacaatctgggagacagtgccctaagtaataggtattgggctcctctgaaacagtgttgtcaaatgacaaataatttgatggcatttacacagcttttagataaaatatttcccacagttactttcctattattatgaaatgtaaataacccttagaattcttacttttaaaatttagcatactgataatgaaaaattcttctctaaggaccaaagtgaggcacaagtattctgtgtcctaatttgcacctgaaggatacttattaagcaaagagtttatttaggccagagaagaggtctcagcagaaaacacatgtgtgactgggctcagccaatagcggcaaggaagagcaaggactgcaccctgggaggacaaggtgcagccggtggtcctgcagattataacagcccagccaagcctctctgtaccaaccgatgtgactgctcctctcccctccctgtgtaaaacacaatgccctctgcccagcagactgctctctagaaacctgcacatctgcacctatcagattctgtctaccaatgtcagtggtgttctgaagtttcttccagctgtacttgttactagaattatgtaacttaatgacataatttgtaaatcaaggaagaatgaagagtggtttctctgaaaactaacagctttggaaagagttgatacagaagttgaatcaggtgcggactagacaacttcaaaggctggaaaaaaaatctagaaggattctgtatttagattgcttggaagtgtctttacttggaagttctagctttacttaaaaaaaagaatttcttttatataagacagtgagacttaatcacttgtttatgaaaaagccttggcattagatcagagttctggtaaatgaacgtctatttatgctgtaagttaacatgtttaggtatgcctctgtcattttaaaataattattcacattaatccactttttcaactagtttcaccaagtgccatcagataagagagcttttcatatactattctttttagttctttaccgggtgctgataagattttatttcttgatctgggtgctggtaacatgggagaatttagtttgtgaaaattcactgagctgtacattaatgatatttgcaattgtactatattgtacaacaacagaaagctgaaaagtcatactggtggcatatttatttgccataaattatcactatattttgtgtttaccaggatccaaagccctgtgaaaaggcatggctggatccaagtgcgtgggcaggtggctccgataaacctcgcctgcagtgctgcctctgtgatggggatcaaacggactgtggctcacgacagggtccaccccaggcactggagacttcgctgggatactttccctctgggtaggggtcagtgtcgatttcctttcatgattggtagacttgttagaagaaattgtaactggaaaaaaagagccaatgccacaagttcttaagaaacttgcaagtatgataatatttgtccatttctcaaccattcaaataaagactatattcatgtatttggatcttctctttccactcaacatttaacattcaatattgcaaaatatgaaaatgtaaacaacatatgaaaatgtaaacaactagtagaaactgagatttggagagtactgtcaccttttggatcatagcaccagtattttaccaccttatgtaacattaaaaataaaattcaatactcttctttaaatctcattatgaatcattttgttttttgtatgactttaacattctaaattcttttgtccccacatgtagtaaacttcagttttctctcattgcctgtgttatgcaacctccttcctacccattaatcactagtttcactaattttttccttgctctgttcttccacaatgactttctcattacttcaccaatatctatcacctccctactccagcctctcttctcttaaatgatgttattcaggatggtcagattgtcccaccaataaatatatattcaaacacttattagccatcatcctcaattttttttttttttttttgagatagagtctcgctgtcacccaggctggagtgcagtggcgtgatcttggctcactgcagtctctacctcctgggttcaagcgattctcctgtctcagcctcccaagtagctgggactacaggagcgcgccaccatgcacggctaattgtttttgtatttttagtagagacaggatttcaccatgttggccaggatgggctcaatctcctgacctcatgatccgcccgccttggcctcccaaagtgctgggattatgggtatgagctgctgcacccagccaccctcaattttttttaactgtggtgaaatatacataacataaaatttacaattttagccattttaaagggtacaattcacagtggcattaagtacaagcatgatggctgtgtaaccatcacatctaattactaatattttgatactataaactttaccacaatcaaacaaatctgcctgcccaaagaaagaaatcacactggtttatcacatccccttccaagtcccagcgtgctcaaatatggagtgcccttccctctgcagggcaattcgccatcaaaactaaagctacaagcatttggactcacctccccatccctaacaaggacttccccttctcctcactctgtgctacgcccctcacacccgccaaaacacacttgtacagctcacagtgcccagcccaggacgtaccatgtgagccatcaataaatttgtattataataaaaaatggtaagtggatgcatttttaagggcctcaggttgatagggaccacttggtaaaaatcacttctcaactgatgtagctgccagtagcatggggttatagtgacaacaataataacaacagtaacaccaacaggaataattcacatttatcgagcccttcgtaaatactcggcaccattctaagttctttacatgtactaccttatttgatcttcataacaatccagagaggtaggtcttaatgttacattatgattttacagatcaggaaactaagctacaaaaaaactaagtaactcatctgagttgatgcagtaagaatgttaattcaagcttatgcagtcttgttccagaggctacttacagctttcacaccacactgccgctgaaggaacaatgtcaaaactgacttccagaaaaccttatgcaattggctgaaaatccactctaaaaatatacttactctatagcatttctggactgcatcataatctgcacttgatttaaatatcaggtattttacttaaattatgcctacttttaaattagtagccttccatactcctagactcaagcaagacctgtagatcttgggatactctaaagctgacaatttgatatttactacttgacaaaggtttttttttttttttttaaatgcaataaaaagtatcagaccaagcaacaaaagtaacataccatcagaagttctgttcatcatgggtgagcctctggacatggtgttttgataactcacaggggtcctccgtgcactggtgtcatcataaatcccagggctcagttgtgctttgggagcttcatgcagtgtggacctaagaacggaggggccagagcttaccactgacgtgtgccgggaacgcacggtctcgcctgctttcacatcctcatattttccccgttctaccacttttatgttctctggcacaatttccagcggaggcattccacgggatagtttgctaggccccgtgattaaggatttgacattgtgtttgatggcagattgacctgagttgttgtcaaactttattggtgtgccctaaagggaaagaaacaaacattacaggtagcaaagtcatctggctacttttctatctcaggtctatgtctggcccatggcagttacagttcactgtggtgatcttttttggtctgtttacaaatctcaatcacaaccccactgatcccaagctgcatactttcccacattccacactctatgctatagacataagaaaacctgatgataagaagtacacaaggccaggcatggtggttcacacctgtaatcccagcgctttgggaggctgaggtgggcagatcacctgaggtcaggagttcgaaaccagcctgaccaacatggagaaaccctgtctctcctaaaaatacaaaattagccaggcgtggtggcaggtacctgtaatctcagctactcgggaggctggggcaggagaatcgcttgaacccaggaggcggacgttgcagtgagccaagatcgtgccattacacaaaggccaagcacagtggctcacgcctgtgatcccagcactttgggatgctgagatgggcagatcacttgagctcaggagttcgagaccagccttggcaacatggcaaagccctgtctctataaaaatacaaaaattctgggtgtggaggtacatgcctgtagtcctagctactcgggaggctgaggtgggaggatcgcttgagcccaggaggtcaaggctatatagtgagctgtgatcacacaccgcactccagcctggtccacagaggaaaaaaaaaaaaggtacaggaaactttcatgtttacttccaggaggtctgacatcataagaaccacttataattattaagtcacacttttttaaatgttccataaatatcagttactgacaaaaagagccaaaacttagttacctgggaaatggaaccctcaattatcggccgtgtgctctggaccacttctggagttttccgactttcctgagttaaaatatcttgccttggaatctcatgaatggaacgccccatttctttgatggtggtgatgccatcatatggttttcctttggtaatggcaccttcaaatgctcgtatgggaggactttcccttttaatttgtttgggatatttaaggccatcttcaaagctttcagttgttgctcttggtgtcccttgaaaaagaattcaggaaacattaaaataatgctgatggttgcacaacaatgccacggaactgtgcacttaaaaatggttaaaatggtaaattttgttacatatattttaacataatttaaaataatgccttgacatcttgtagtttctaattaactttctgtttacagtagatcctcaaatcagtatttatcaatcattatttctttagggttgcttgagatatgatattaatgcatcattcataatagtcacagaatggttcttgcataataaagatatctctatattaaaagattaagcaactatcatcttccaataaattatgtagctcagaggcagaaaagtaataaccaagactttaatatttcaaaagggaaaataacttgaaaagcagaaatacactgtaaattaatgtcaaactattttgccagggaggcagttataaataaaaatgcaaaacaagcagaaagtttaccctgcattatggagccagacaatacagtcctttctttgaggtcagaatgaggactccccctgggtaatgctcggcatatcagcccttccaaaacaagaaagcaattcaattattcaacataatgtatatgtcaactcacatatactgaatgctgttcttaaagtctatgtttttgataaatgctctatgaaggaaggaatgtcaatttaagtttgtgaactatccagaagtacctaatatgacatcacacagtcctttgtaaatattttcctaaataaaaaatggccaccaaaggcatctaatgaaaggttgaaaaggaaagataccttcaaagttaaatctaaaatcccaacacttctttatcaagaggaaagaagatacaggattggaaaccattgcttagctttgaaatatacttgtgataaagggaaaacgggaaatatggataccataaaaatagggaaaatgtattaaatgaaacatgcaaattgaaacgaaagagttgtaaataacctcctaagaagcttcacattattgttgctgataaatataaatcaagggttagaaataaccacacatatttacagtaaaagtgtgtgtttttaacatagagaaaaatacagctcttagaaaattacacaggacttaccctgcttttagtatttcatctagcttaaaattggttgaggcaggttaagatttaaacaaagtgggccattaacaaaacaaaatcatactgatcatgtactgaagccatatcacatgagcagcaccagttcagacacctgcctctaaccctcacacagtgttaggtacgatcccttaatttacagaggaagaaacaggctcaaaggaattttaccagggaagggtgaagctgaaatttaaattcatgtctttatccattacaccactttatctgtctcacaattcaaaaagaagttctcataataaactttaccttttttaactcacttagctgaaacaggaataatctgcaaattgtatgagcattcaaatatgaacattctaatagtaacctatgatatgaccaattacgcttaaatttgacttccttccattgttatgtgccactttatatacagatataaacttaatataaatatatatttcaggtggaaatgacagaaattgcatacaacttaatataaatatacatttcaggtggaaatgacagaaattgcatacaacttaattcaacaatgcaaaattactatataaaataacatgtatcaaaataacattctgaaaacaatgctttaccctctaacggtgctgatacaggagactccctcattgacatcccttgctttatatttccttccactgattcatagcttctctttaaactgatttcatgagctgttcttggactcctagtcccttctcgggcattcttaatatctacagaatacacaaacaagacttgctcagacggagcacatggtatacaatgtacagtaaataggttagtttcatagtctatcttataaaaataataatattaaaacttgtcttaacctacaataaaatatgtgtagatgattcatgaaaatattttcactcattcaaatgtgtttattgatgcctactgtgtgctaggcataagctaggcttgcaggtaagattaacaaattaagtccctttctgcatgaaacttacacaataatgtaggtacagattatgtagtaaaataagctatgaaaggagaagtataatgtgctatgaaaatgctaggagagaaacctaacacctccaggttcagataagcctgctcagaggaagcaatgtgtaagctgagaatgaaggatgaataagagttgttcaagtcaaaggtaataggaggaaaaagtacaggcagtgtgaacagtgaacacgaagaccccaaggtgagacagagaaaggtacaataaaagaacgtaagcgtggtaaccggctaatgtgtagagtggagttgggaggaagagtgtgggggaggtaaatataggggactaaagggaaaagtgagaagggaaaaatgtgaagagctaagctgaaagcagctcctggaggggttataaagctaaggtaggggtttgcagttatatccagggtgatggaaaaatcagtcaaggagtgacgtggtacacactttgaatatgggtgagactgaaggtagggagatgagttaggtggctgctgggttaaagatgatggtgacagtggtgaatacagagtaatggatggattctagacactttaggaaaataaacagaaatggcttagtgatttggtggatgtggaaagaaacagaggtgtgtagacttctgatatggacaacgtacattattaatttcttaaccccaaaaacaaaatgtgaatcataatatgccagacgtgtaaaggagagtgaaataagaatgctatcaagcattttgcagcatctggcactatgtacgcacatactttatttctttgtattggaagagaaagcatagctcatgactactccaaggtcacagagtcaggtgcaaataagaactcaaattcactcaaaactttggctaatatttctatcacatttgagtcattcttataaaatactactactgagaaaatataacaagaatacatctaaaaaaatgtacatagacattaaaatagttttattaaggagtatttaatattatcaagattatcagaatattatctaccttctaattctttttgtttgtttgtttgagacagactctcgctctgtcgcccaggctggagtgcagtggcccaatctcagctcactgcaagttctgcctcccgggttcacgccattctcctggctcagcctcccgagtagctgggactacaggcgcccgccaccatgcccggctaattttttggtatttttagtagagacagggtttcaccgtgttagccaggatggtctcgatctcctgaccttgtgatccgcctgcctcggcctcccaaagtactgggattagatagtagataggcgtgaaccaccgcgcccagcctatctaccctctaattcttaattcataaaacatgaatctcttcaaaataaaagtattccattaaagttcaacaaaggctctttacctaagctaaactgactgaccacagtcgacaatcttagctaccacctatgggacatttaatatgagctctgcgttgttaattactttttatcgactaagctgttattcacaaaattctcatgagacaagtattactaaccccatttactgagagaaaacataggctcagcaaagataaactgactcccagagagcagaaatgcgggaaaacccaagcctatgtttttagcacatattgtaatactggctttggtgcatacatacaatacttactatcatatgacaagatatgtccacttttgccttcataaataacatggcctttggatgcagcttcctctctgcctttctcaggactgctgtcttcaatgggcattctcgaaatggaccccttcaccaaagcctctgttggtatgccagtctggggcagagccggggtgccctgccatcaaatcaagcataaatagcagaggagtcactcgagtttagggaaaacacaagatgctcagaaaatttaacctatgacagagtcaggctaatctatagcttcaaagaagaaagcacacatacatgaaaggaaattagacattgaatttttatcaacatgaagacatcctgtaccttcatccttcaactcagccacataacacttaaaattatgacacgtacattaggtgaatcaactttgctctcaccttcatgtgaggactctattacaggatttaactctcagaagtttctcttaaggactaaaatcaagtaaatgtaacagcttttattaggttgttgcaaatgtaattgcagtttttgcgttgttgaaatttgccgtttgatactggaatacattcttaaataaatgtggttaagttcttgttttcttctgaatgtagttacgcaatatatcattttaatgtgcatttgtcactttttttgttaatgacttattacttggtgttttatatttattttagacgatgaaaattatgttatacaaaaagcaaattcaagtgattttcttattcaagttcaaaatgggttgtaaagcagcagagacaattcataacatcaacaacgcatttggcccaggaactgttaacaagcatacagtgcagtggtggttcaagaagttttacaaaggaaacaagagccttgaagatgaggagcatagtggccggccatcggaagttgacaacaaccaattgagagcaatcattgatgctgatcctcttacaactacacgagaagttgccaaagaactcaacgtcaaccattctacggttgtttggcatttgaagcaaactggaaaggtgaaaaagctcagtaaatgggtgccccatgagctgagcgaaaattttaaaaactgtctttctgaagtgtcttctcttattctaggcaacaacaaaccatttctcaactggatcatgacatccgatgaaaagtagattttatacaaaaactagcgacaaccacctcagtggctggactgagaagcagctccaaaacacttcccaaagccaaacttgcaccaaaaaaaggtggtctgctgccagtctgagccactacagctttccgaatcccggcaaaaccattacatatgacaagtatgctcagcaaatgaatgagatgcactgaaaactgcaatgcctgcagccagcactggtcaacagaaatagcccaattctccacgacaacacctgtgtcacacaaccaatgcttcaaaaattgaatgaattgggctatgaagttttgcctcatctgccacattcacctgacctctctctctaccacttattcaagcatctcgacaactttatgcagggaaaattcttccacaagcagcagaatgctttccatggctggctgtggtggcttgcgcctgtaatcccagcactgtgggaggccaagacgggcggatcacctgaagccaggggttcaagaccagcctggccaacatggcgaaaccccatctctactaaaaatacaaaaattagccaggcacggctgcgcacacctgtaattccagctacttgggtggctgaggtaggagaatcacttgaaccctggaggcagaggttgcagtgagctgagatggcaccactgcactccatgctccagcctgggcaacagagcaagactctgtcaaaaaagcaagcaagcaaaaaggaaggaaaggaaaggtaaggaaagggaaggagaggagaggggaggagaggggaggagaggggaggagaggggaggagaggggaggagaggggagggggggaggagggggaggagaggggaggagaggataggggaggggaggagaggggggaggggagggggaggggagaagggagggaaaagaaaaggaagggaggaagggaggaagggaaaagaaaagagaaaagaaaagagaaagaaaatgctttctaagagtttgttgaatctcgaagcatgtatttttatgctacaggaatgaacaagattatttctcactggcaaaaatgtgttgattgtaatggttcctattttgataaagatgcgtttgagcctagttataatgatttaaaattcacagtccgaaatcacatctttgcaccaacctaatataaattttctaataaaaataagatgataaagtagttttaaatttagagtactacaactttttctcaaattgtgatatgagggaaaaataactttcaaatatcaaactgactactaggttgttaggcctttggatgcctctgtgttttgacactgattcagtttaggtcaggttatctatattttcaccatcatcaatcctcctctggagttgccaatgaccatgattctttttacccttcctttaagcagcgagcccttccttcaaggaaaattgttcatagaatctaatacgtagagcattttgcaagagagagcagcttggtgtaaaataggagttagaggcctagactgagtttactcacatttagggtcaccactatactctgaggactgctaaaaccctagagagcacaatctgataccatatgcttaagaaaagcgataagagacatacacttacttgtccagtcattaagtgaactcattagtaagtgtctagaaatccttaacgcccacttcagaagtactcatgtcaagtgcacaaacagattttaaacagataaaatttagtctcctttggcccagttcatactctttcttcccacagtttggatgccagagtgaagagaaagaataatacatacaggcccatttactttcctctgtccatattaaagtattagcttgctgttaaaacagaaacacactgacccaatataaatggagactttttttttttttgagacggagtctcactctgccacccaggctggagtgcagtggcacaatctcagctcactgcaacctccgcctcccaggttcaagtgattctcttgcctcagcctcctgagtagctgggattacaggcgcacaccactatgcccgcctaatttttgtatttttagtagagacggggtttcaccatgttggtcaggctggtctcaaactcctgacctcgtgatccgctctccttggcctcccaaagtgctgggattacaggcgtgagccaccgcgcctggcctaaaaagagagattttaagagtcagtatgtaactttcttttcttctgtttttaacttaaccacaaggaagtagtatgtaaactacatttcagaaagaaatcacctgggaacctcagtaaaatggggattttaattcacatgatctagagtgcggactgacatttctgcattattctagcaagcatcccagtgatgccaatgctctggtgcacaaaccacacttggccagcaaagccctagctgaatcagctaagggcttgggaaaacacagactgccagtccccaccaacaagggttgggtttcagtaaatctggggtaagatctgaaaatttatatgtgtagcaattttctaggtgattctgatgctcctggtgtggggatcatactttgagaacaactgtcttagaggatagtaactagacaaataaaaaacttgtgacaatgagtgaacactttagaaaatgcaaggcacaggtttctgtttacaatgatttcccaaaacagaattttccctcttatgcatatacataaagaggctaagaacttcttaagtatcaagttaaaattaacaactaactgagagaaattttattaatcaaaattggtgatgtatttagcccaaaattggaaggcttctggtgcttttgttaataccatccacatttcctggtttagcattagattctaacaaggcagcccacatactgagattctacaactacatctccaccagggcaaaagtaagcaaataattcgtaatgattttcttctcaatttctatttaggctaaacacatggtaaaagcttttccaggaagacaataagagctgcatcaattagaacatatttctttttccagtttgcaaataagtgaccttttcaaatgaaccaaagtattcataatatagcttgtagtcaaaatgatcacattaacgtctctgtggagacagtttgcagatctaggttatgagacccagtcccataatgcagaaaaatgaacttaagccacaaaatagccaaagtgctaagaattatttatcattttttcctgagcttctgttgagtatatcagagatgatcgtgactaacctgagtgatagagccccgtagggatggaatgctctccactgaaattttgctggttggagttccccgagttatacttccttcttgtatggctcctgcggtacctgaatacaaacaaagctattagcaaattacacccccagcccctgccccaaaacataaaaaaacagcccctacttgggagagtactcaactaagaagaaaagaaaaaagcagcacaaaacccatcatgtttgttttattaaaatgtacttccaaaataatactaaagaactgctgaaacatggaacttcaaggttttaaaatgacttttacatggaaagaaaacaaatttagaatttaaagactatagttaaaaaagcccatcattaaaatatattaataacttactttaataaatttattggggacaaaagtttaacatttctgccaaccagcatattttacctctgactacaccttcatgttgggccctgaccaacagaccctcaggttgtgagttttggcttcggggagaaaattcttcctgcttgatgtagggcaaagtagctgtggaaaggcagagaaacatgaaacaatccagtactaaattactggctgtgatgctacaaacgtagatgcattatgactgtattaactcactgacctgatttggcagattcctgttgccgtggcagtccaagagagatagatcccactgacggcttgggtgtttcttgagtgtaggaagcctgattatgagaagtcaaataagtgcctggtgttccctaagaaaaaaacaaaaaaaaatttaaagattaagcaaacattgtttttttcacaaggtcaatttcacaaagtcagcattcccatttctgtttaaaaaaaaaaaaaattataccccttctacccaaaaccaagaatagtttttgtaaagcaagaaaatcttcatcgtagattgcttaaatataaaaaaaattttaaagggagtaggatatgtcttctaaaattaccatacattacatgtaaatagtatttactattaataaattacataaataaagcacttatatgttgcaatcaaaatgtaagctactattattaatattcattccgactaaaaatgctatggagagtggtatcagcaaatacagcaaagtaataaggacttccaaaaactctcttccataaaagcaacaagaaaacctggaaaaattttaagaatcaacctttttttttcttttcttttcttttgttttttttgttttctttttgtttttttttttgagacagagatttgctctatcacccaggctggagtgcagtggagcaatctcggctcactgcaacctccgcctcccagtctcaagcaatgtaagaatcgacttttaaagaaccctggaaattaaccaaaggcttgtagaaatctggaaatatttatttaaaaaaaaaaaaaaaagctgaatctaggtaaaaacaggtaaaaacaatgggctttgtggcattttaacttgttccattctcattctcctgatcaaactctatggaagtgttgaaaaccaaaagcactcaatcatagtgcaaacctatggtggctgcctggcagccactagaagggaaagagcaaggatggagctccttaaaagcctcattcccagataactgtcattgtttgacttctctgttggttctctgggagactccattcacaaagctgtctttatttgacctgactggagtgggagaggaggtgcagacttgtcaaaaacaatcagaggcaactgattaacttctccactgcctgagacagtagataacagccagggtaaacaacaggctaaccaaaacacttaaaaggaaaagccagggaatgagatgttcatggggtctgaaaaactccaacatattccctagaacctagaatgctacatgcatgtgcaaggctatgaatatgcctaggaaagacatgggaaggccccactgctctcaacttaggctgcccttaaggctctgcacgccaggaagtaaagactaaggcaaagctgttaagtgcccaacacataaagagcacccctcagcaaaggctgattttactgattttagacatttaaggaaatgtctgtctaatcattagctgatcactaagttaatcagacttcagtggctacacacaacaaataatacagactttacagaattagttaagaaaagtcactaagcaaataataacagccaaaagaaacaacaagctctgaaaagaaaagtgggggtgggggggatccaagttccagagttgctacattatacaaaatgtccagtttttgaccaaaaattataagatacgcaaagaaacatgaaagtgtgagccatacatatgaaacagagcagggaacagaaaatattcctgagctttgggctcaggaataaagactttaaatcagctattataaatgtattccaagaactaaaataaaccatgtctaaattaaaggaggccaggtgcagtggcctgccttctttaatccttacactttgggaaacccaggcaggaggatcgcttgaggccaagagtctgagaccagccttaacaagatattaagactctgtctctataaaaaataaaaaaaaaattaaaagccaggcatagtgatgcatgcctgtagttccagctactcaggatgctgaggcaggattgactgagcccaggagactgatgctacagtgagctaagatcatgccactgcactccagcctgagcaacagaattgttttaggagagagaaaaagaaaaaaaaaaagaagaaagtacaagaatgatacttcaccagatagagaacaccaacaaagagaaagaaatcattaaaaagaacaaaatagaaattctggagctaaaaaaatataagaactaggggtgggggtgggtctcagcaaactaagaacggaaggaaacatcttcaatctgatgaaagacatccatgaaaaacttaacattctgcctaacagtaaaatactgaatgccttccttctaagatgagcaacaagaaattcatgtccatgttcaccaattcactattcagtattcctgtatcaagaccatcctggccaacatggtgaaaccccgtctctactaaaaatacaaaaagattagccagacagggtggcgtgcacctgtagtcccagctacttgggaggctgaggctggagaattgtttgaaactgggaggcggaggttgcagtgagccgagatcgtgtcactgcactccagcctgggcaacagagcaagactctgtctcaaaaaaaggaaaaaaaaaaaaattcctagccactcggaaggctgaggtgggaggactgcttgagcccaggagttggaggctacagtgagctatgatcacactactgcaaagcaagactttgtccaaaaaaaaaaaacaaaaacaaaatttaaaggaatcaaatagccaaatataaatcaaacaaaacacatacaaatctctaaagtgaaaactttaaagcgctgctgagagatatagatatacaagttcatagattagaagattcgatgtaagatttccatttctacctcaaattgatctatagatttaatacaatcccaacaaaaatcccagcagatgggtggttcatggtttttttttttttttggtcttttaaaccttaaactataatttgaagcattctcagatgtttggggggaaacatcctcgtaaaatagttccctatgctcgccttctggggaggcagtgctgagcaggtgaatcgtaaagcatttatgcatatgttaaatgctcactgcacccacctcttccccacaacctttgcctcttgggtggtttgtgctactttccccttactttgctacatttctacagttaagttggttttacttaaatgattcatgtttggggggggaaataaacatcacccttaaaacatgtttcaactcctgcaaataaaataaatgaagtggcgaaagaaaagaaaaaaaaagagaagagaagagatcccagcagaattttttttctttaagtagactgacaaacagattgtttctgcctctgctgctgccaggtgcccatgaaaaagtgggggcaaaaaaagaaaaaaagcaggttctgaagtatacccttgactggatctaccccgcagatgatgctgccaattgtgagcagtttctccaagacagaattaaagtgaatggaaaagctgggaatcttggtggaggggtagtaactattgaaaggagcaagaacacaagcaccgtaacttctgaggtgcctttttccaaagggtatttgaaatagctcatcaaaaaatatctgaagaataagctatgtgattggtcgtgcgtagctgctaatagcaaagagaatttcggattgtgttacttccaaattaaccaggacaaagagaaggaagatgaggattataactcatttacctggaatgttttgtatgagttcttgaataaaacttgggaaccaaaaaaaggggggagacagacattgataagctgattatataatttatatgaaaatgcaaaagacatcaaatagtcaaaacaatcttgaaaaacaaaaacactgaagacttatactacatgatttcaggacttacaataaagctacagtaatcaagactgtggtactgacaaaacgatgaacaagtagatcagtggaacagcatggagacagtgcagaaacagacccatatatactgtcaaatgatttctaacaaaggaactgaagcgatcaaatgagtaaaagacgtttcaactggtgctatttttcaactagaaatttaaataaagatgaatgttaatcctgacctcatactatacacaaaaattaatttgagactggtcacatgcctcaatataaaagccaaaattataaagctttcagaagaaaacacaggcgaatatctcacaaccttggagcaggccaagatttcttagcaaaataaaactaatcataggagaaaaaagtgtgtatatatatttagactatataaaaatttgaaacttctcatcaaaataccagtaagaaaataaacagacaaaaaacagagaaaatatttgtaatacatatatctaacagagaactttcaaccataataaagatctacaacacagtatcaaaaagacccagtagaaacagataatcagacttaaatagtcacttcataggtgtacaaatggccaataagcacatgaaaagtgcccaacattgtttgttttcagggaaatgtaaaatacaaccacaataagatattactacacaccaagtatgactaaaatgaccaagacttgacaacagcaaatggagcaatcacgtctcatacattgctagtggcagcataaaattgtagaaccattctggaaaagtataaaacatacacaaacctagtaattccactcccaggtaattgtacaagaaaaataaaaacatatgtccacaaagaacccattacaagaatgaccagctttattcatagctgccaaaaactggaaatagctcaggttttcatcaacaggagaatggataaacaaactggtattactcagcaataaaaaggaagaaactactgattacataaaaccctggatgaattccctaaaaccattatgctgggttaaagaagacagacacaaaagagtacaccatgtttgattccattcacaggaagttctagaaaaggcaaaactaatctacaacaacaggaaatcaaatagtggttgcttcaggcagtggaaggggagatggcctgggaaggaacatgagaaaactttctgaagtgatggaagtgttcaataagttgacaggggtgtgaccactgatgtacagttagtcaaaactgatggaactgtgaagaccagaccatatctcaattttttaaaaagtaatgaaccagaaaaaagatttagtggccaaagtcagaataaattataatactaaccacctacaatttaatattttgagcctttaccatatgttagtgaacaaatattctactgtttgaaactaagtttaaaacttggtaagtttagagtgatgtaaattaaaccaagtggtatgccaagtgccaagtgtaattaaatgggtggtatgttatgaccactcaatctgggtacataactcactgaaagttctgatttgtggcaagagtacagtgactgctgcatcttctggtcattatctcttgaaacttcatattcagacagattattatttattacaactctgacaaatcagtgcgaggagggaggacaagttttaacaaagccatattcaacaagaaatctactgtaaagagaagtcgtttcacctgtgagatggagcctcccattataaaagatggtttttctgaagccactgtggttttggatgacgggatgagagggggcggtggcctggttggtcgagttgtcggaagccgaacgccttcagggagattagttatcacttgatgtggagcaggctgaaggacttttaaaaggaaagaaaaatgattttaaactagtccatttcctagtttacaacatgttacctctctcagtcattcctgaatttttaaatcactaattaaaaaatgtaagatgaaaccaacaatgaacatttctattttaaatttctcattcacgtaagcctgtatacatatttgtcacaaatactatttgtggggttgaaatattcaactccctttcaaaccacagctttcaagctgatgcttatttcaaacttctgcttagcatagcaaacatcagtcttcaaaaattttttctctctcgccaatcactcttagggtacttcttaaaaacagctgataacactacttcagagaatgcgcagacatgactgacaaccagttatacatcctttttgcatcttgcatattgagaaacacttactgattctggctctcacagaacacttgaattttggggatggggagatctcaagacttttacaaattcatgtactcttcttaaaggaagagccagtcaatgtcacagtataaatgtgtgaacacaaatttcccagtggcccagtgaactcaactaaatacaactgatgatggaacgcagagaaacaaagtcattctgaaacagcaaggacacgtcctggaagagcagttcattcacgagattaaaccacccacgtggaacatctgtgggtggatggccagcagccactgcacagaggagtgatatttacctggcgggacactatagcgggctgcactcatatcaggctgtggagcggctttactgacttctcttggagaaagcctacacggtgaggctgaccttgctgcagtattgtgcatctgtgcttcctgttctagagcacgtttgacctcagcataaggcatataggcgactgattttcctatgaaagttaaagttatcaaaataagggaagaaccccaaattaaaatagtaagtgtgaaaggaccaagcccacaccatccaggggctgatccgactataacattaaagtctaaaactcctgggggcaaaattcacccacagagaagttaagaaatcctgtaaatctaaatctcctgtgtatcctcaaaaattcatttacgagttttccctttaaaggaaaaagaacttctctttcctcttaaggagaatcaagtgttttcacatgcaataaaatcacaacaggcaaacatcagattatcaagcaattctgttaattcaaatctggcctgactggaggttattagctttgcgaggatttcacaagtcttataattagcctgttgaagctcactccttgctaatattcacagaaatatatttaattaagaaatggaagaagcctttcaaaagatgcagatcaaactaattcaaaaatcctacataagcttataaaaaccatgaatataactacaataatactaatgaaaattacttctcatgtaagttatctccacataaagcataaagaaactttaaatattttaaagggcacgccagaaatgcagtcatatttaagactttaaaatatatagtttctttttaaaatgaaacatctgtaatttttgaaaatcaaaaaagcacaaagtaaaactcatttgtaaccctgaccacttagatttgtagcattttaatgtctgtcagaataaattcccactcattttatttattattttcattacctagttgtatccatttatctttccaagtaaatctaaatttaaaatcattgagtacttcctctcaaaacaaagaataaatagaattttcattagacttgtattaaatttatgaataaacaggtgatgatattttataataatgagttttctagttgagaaatcttgtttttgtcagatagttccatcccttgcttgttaaaaattattcctagatatgtcatattggtaagaaaaccatctcttttatatatatgagtttatataaataaacctgattactgcagacatacaggaaagatgcggatttctgtgtaataattttttctgaaaaacctaatgaactttccttttagctctaataacttttcagttgattcttttaggctttctaggtgaataatcttatcctgtaaataatttgtcttttcccttcaaatacctaaacctcttatttccttactacactatcttttgtaaggtgcttttaaaaatcagaaacaattacaaaaatatcaactgatattcaagtgctaggcagtgtgcattacatacaatatctatttagccctcaagaccaatgtgattattaataccattttacagatgaggaaactgaggctcagaaaaatcacatctaattgcccaatcaaggtctaccagcgatttttttaaaagcagtataattccggaccgttagctctaaaccacagtgcaatagtgtctcactaaaggactgggtgtggaatttcagatgtctctggtgtatccatcaagacgatggtactttttccttctttgacatattaatataatgaattagagtaagtgtcctaatactgagaaaacagatttatgaaataaccaactccaaaagaaaatcactttcctagataatttaatatgataatgtattaaaaatccaatgtctgattattttaccatttccagtaagtttataactatgtttaaaaaaaaaaatccactggtcatagtagtggtttttttttttttttaaatgatggaaattggatggttctaaacacagctatctacatcaccatgtacccagagcaggaaaagaaaaacagcaacagcaacaaaataaacatgcaacaaactagggtcagttacatagaagcattaactcttattttaattggataattttgttaaatttgcattagaagttcaattctaactctacctccatatgcttaagtttgagttccttcactgtagaaaagaggcttaaaagttatcagtaaagcagaggtcaactcgtataaatgttactggtaagtgaaaacaattctctaaggttttttttcaaccttttctacagatgggaaaagctttaagcaacttaaaacaggcatacctacagtaattatttataccattcacattaagagaaataaatacaaccaaatagttggacaacaagtgctgcctgttacttgctaaaagagaccatgaagggaaaagtaaaaaccatggccctaattcaggtggactgtaccaatatttggtgatactttatacataaatccatactatcactattcttcacattctataaactgttctatgaggttaaatttaaaccatttttgtcaaacattctagacacaagcatcttaactgcaaacatttaaatgttatttgaaaggttatcctatacactgaactacaggatagactcaaggaaaaacttctggtacttgttaaacaaattacaggatgaatacactagggagattagctaaaacaaaacaacctttggataaacttgccctactttgtagagcatcaccttcgaccaaactgtaaaattcttaatgtcatactaatcaaaagtataattacaatttgattttaagatgactgaattatgattaaaaattaggataccactgagatctaaaccacgtgtagtaatgtgactaacacagagaaatacaattcacagtttggagtctcagaatttggggctccagcctggttcagtttcttcagttcccaaatacaactcattttataaagcagaccaataaaagatattgaggctttaaaattatgatatccatatttaaatgacccagatattactaacaatgatgttatgccttgtcataagttcaacaaatgataccatctgaatgtcatttttctaacttttactacttcttcacaaaatctatcctaaataataaatgtaaggaatacatccagagacttttattctctaaagtttcattttccactgacggatttcctcataattcgaatgttcaaaagacaaacacctgcgatgtccattaataccctgtagtgaaacacgataaggatatctccattatgtcattcatttataattcattcctttaaggtgtaattactgagtacatgttgtgtcaattacagaactagcgattaagaattccctagacccaacagagtaaaagcctaaaagttatcaatatttctaccttcattcaaggaaatattcatttagcgccttttatattccttggtggatattatcattctggttcacatttttcctagcacaagatttatgtttaaaaattaacaagtttaaatttaaaactctaacataagaggttcagtgtattaggcaactaataactcaatattggtgtgatctgggcagagtcagcaggatcagttaagtaccacagttcctattttatattaaataacccttggaatgcatggcattgtaaagctaatagctcttatttagctaaataaagtactgtaaagaatcttctgaatcattcagactatttcagtattctgatattctaagcatatcgtagcatataagtagactataaactcattcttaaccagaaacatgtgccaattcttctaaccatgtcagaagaatgtattaaaacataaaaaccacccctttcttctttttttaaagaaagtaaaagtgtatcacacaccaactaaaacagcaacggaccaactcaaatccatcacttgaaataaaaacagtgatgtaacaatgaaaacaggtacctccatagtatctactgtgtatatacagtactaatacactaattaatatgtaataacgtgctacattatacataaaataatgcagagccacctgttatataacaataccgaatgctccttccttaactttacaaccacagcaaggtagacgtgtactattattttcattttacagatgagaaaactaaagctatgaaaggttaagtgacttgcctgtggccacacagctggcaaatgccaaggtgaaggcttagccagcgtctgattggaaatatccactacacaaagttgtgtctctcatctaccagagaatgtgaatattacactgtaatacttgaaggtgatttgcttcaaggacaggacaacaattctcactctgaaaattcagatgaacggaacataaagcataactttatttataatgtcttccagcacaaagatgaatatcagaaaattcacattaactagaatgctattaaaaatgttactggcatcctttagtagttaataatactaacatttcttcatagtttaaggtcaatttaaggaactgtgtctgttaggacaaatataataatcagttgggaggctgacaacttacaaagcacaatggacactgcttttgggtttagctttatttcccttcataaaagttctcttggtgatagctctatctacctaccttcccactctctgtttggactcttggatgtgccacatggacttgtagaacttctacattccaaatctatctgttcttgtctctgccgctgctcctccaggagtgctgactcatgcattgctttaatgtgtcgctggtagagagcatagccgctcactggggttccaattggtatgttacatggggtgcaggatacctataggaagaaaataaatcgaaatatgcaaacaaccaatgtaataattgccatctcttaacaagtaatgtaatgcttatttctgtcatgttattggttgaattgattttatcattttttaatcaaagttatcttcaagaataatgcttaaggcattgcagtggctcatgcctgtaatcccatcactttgggaggccgaggcaggcagatcacctgaggtcgggagttcaagaccagcctggctggtattttgtatctttgtaccaaaaatacaaaaatttagctgggtgcagtgaggcatgcctgtagtcccagctactcgggaggctgacacatgagaatcacttgagcctgggaggcagaggttgcagtgggctgagattgcaccactgcactccagcctgggcaacacagcaagacctagttttctttcagaactgatcacaatataaatcacacaagctgtaataacagaaatcaaaaatcagaaattacaacacatctgtctgattctaatttatggcagccaagtcccttgtggccctaggtcccatccctcatctctctttcaccagggatcagatccatttatatatatatatatatatatatatatatatatatatatatatatatatttttttttttttttttttttaagacatagtctcactctgttgcccaggctgcagtgcaatggtgcaatcttggctcgctgcaacgtccacctcccgggttcaagcaattatcctgcctcagcctcccaagtagctgggattacaggtgtgcaccaccacacccaactaatttttctattttttttttagtagcgaaggggtttcgccatgttggccaggctggtctcgaactcctggcctcaagtgatccactcacctcagcctcccgaaatgctggaattacaggtatgagccaccgtgcctggcagatcacatccatttatgttgatttaaatgtcatccatttgttaatgattcacaaattttctacttcctcaagacactttctccaagttccacacttacataaaatggcctacctaacaactccacttgggatatctcaaggaagctcagaacttatgttaaagggaacttcccatttttgaaactccattcttcttcagttgctctccattttagacatggaaccccaggtgcttcagccagaaacctggcagccatccttgactaattaatctcctcctctcccacaaccaactcattcacatagccattcccttaggatagaaatggactgttccttaagataggccatccataaccatccaataaaacatggtgataccctccctgttttccttctcattgaggcctgttcactgctttcacagtacacagtatttgccagtttgaaactgttttatttttctgtctctctgactttatgaagaaaataacccaagatgttttgtccaatacttaaaaaaatagcccagaacacagtccaggattaaatacctcatgaataacaaatatccctagaaagccctagaggtctgacttttttttagaatctggtaacttaagacttccatagtttttcccctagcgtaagtagtattattcactgatcctaaaacccataactttcttgcctttgtgctttgtcttccatataaacatagcttttcctccttttgctataacgccaaatgagctgttttgatccaatgaaaatattatttcttatgcagtcttctgtaagtgtctaattaagaagacactccctcttctccaaaacatccatagtattttttaacctaatagagcatcgcattttaattcattttaacctttacgataattttttttaatgccttttttttgagacagtgtctcgctttttcacccaggctagagtgcagtggtgccatctcacctcaccacaacctcaaactctcgagctcaaggaatccttccacctcagcctcccaaccacaggcgcatggcaccatgcggagctaatttttttttgtttttttttggagagacagggtttcgctatgttgcccaagctggtcttggaactcctgcggtcaagtgatccacccacctcggcctcccaaaagtgttgggattacaggcgtgagccaccacgcccagcctctttgccttattatgcagaccggtccatacgttttttgaaatcagaggctataatatataaatactctccacaatattaagaacattatcttaaactaatcactcaataaatgtccatttgaatgagtcagtgaatgaacaaatgtttaatgatctttttgtggtaagtacacaattaaaaacttttaccacttattatttgagatagaaaacacatttttgaataaagcaagagctttaaatatttgaataaatagaaaataactaaagaaaagaacaaggtcattttctggtgcctaaagaaaaattgagagtgttggaggtgttcaaacaagagtgactccggctcccctcccctctcccctctcccctctctcctcccctttccatggtctccctctcatgccgagccaaagctggactgtgccgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggctgggctggtctccagctcctaaccgcgagtgatccaccagcctcggcattctgaggtgccgggattgcagatggagtctcgttaactcagtgctcaatggtgcccaggctggagtgcagtggcgtgatctcggctcgctacaacctccacctcccagccgcctgccttggccccccaaagtgcagagattgcagcctctgcccggccgccaccccgtctgggaagtgaggagcgtctctgcctggccgcccaccgtctgggatgtgaggagcccctctgcctggctgcccagtctggaaagtgaggagcgtctctgcccggccgccatcccacctgggaagtgagcagcgcctcttcccggccgccatcccatctaggaagtgaggaacgtctctgcccggccgcccatcgtctgagatgtggggagcgcctctaccccgccgccccgtctgggatgtgaggagcacctcggcccggccgcgaccccgtctgggaggtgaggagcgtctctgcccggccgccccgtctgagaagtgaggagaccctctgcccggctgccaccccgtctgggaagtgaggagcgtctccgcccggcagccaccccgcccgggagggaggtggggggtcagcccccgccaggccagccgccccatccgggagggaggtggggggtcagccccccgcccggccagccgccccgtccgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccccccccgccagccaccccatccgggagggaggtggggggggggtcagcccccctgcccagccagccgccccgtccgggagggaggtgggggggggggtcagccgccccgtccgggagggaggtgggggagtcagccccccgcccggccagccgccccgtctgggaggtgaggggcgcctctgcccggctgcccctactgggaagtgaggagcccctctgcccggccaccaccccgtctgggaggaggtacccaacagctcattgagaacgggccatgatgacgatggcggttttgtggaatagaaaagggggcaaggtggggaaaagattgagaaatcggatggttgctgtgtctgtgtagaaagtagtagacatgggagacttttcattttgttctgtactaagaaaaattcttctgccttgggatcctgttgatctatgaccttacccccaaccctgtgctctctgaaacatgtgctgtgtccactcagggttaaatggattaagggtggtgcaagatgtgctttgttaaacagatgcttgaaggcagcatactcgttgagagtcatcaccactccccaatctcaagtaccagggacacaaacactctgcctaggaaaaccagagacctttgttcacttgtttgtctgctgaccttccctccgctgttgtcctatgaccctgccaaatccccctctgcgagaaacacccaagaatgatcaataaaaaaaaaataaaataaagaaaagaacaatacccaagattggaattcagtatcaaaaatgagtcaaattttacagattattaaggtaaaatataaataaaatatacttgaaatctgtagattattaaggtaaaatataaaaataaactagacttgaaattgtatactggagttagccataatctctacaatttattctaactattcaaaacctaattacatgcttaatgctactactgttttatggctccttagtgctgtggttacaaacaaaaacaggacttactaatatttatggctagagcattatatttctttttttttcttaactggaaatgaccgtttcaatcaatcatcacaagtcatttgaaaaagcaatgtactaaggatataacctttggttatctcaaagagtttactcaaagttagactcagcatcttcctacccttctctcccatatgtcttagcactccctaacccaagcccagcacaagaggatgtaagaaaaaccaaggtgctaaaatcaagggctgaccatacaggtactagtcacaatagtccagaggtggaagcaatccaaatgtctatgaatggatgaatgaataaaatgtgatatacagatacaatggagtattattcagcctttaaaaataaagaaattctggcacctgctaagtatacctggaggacattatgctgagtgaaataagcctatcacaaaatgacaaatactgtatgatttcatttatatgacataatgtggcacaataaaaattaaatatttggtccttctcccaaagactttttttgttccaaatccttagaatttccagagcagtaagagtgtcttttgtatgctaacaagatgactcctggctggggcctctagattgcctcaggataagggctgacagcccaaaaaaccacaaggcaggaggctagaacttctttggggattggggtaggatgtctcttaatattttgcccagactgggtttgaacttgcaatcctcttgcctcagcctcccaaatagctgggaatacagggctgggagtactgttgggcaccaccatgcccagcaagggctggaactttcagctccatccagctcaccccacccccaaccctccagggagaggagaggggctaaaggttcatgcacccatcaccaatggccaatgatttaatcattcatacctatgtgatgaggccttcataaaaaccccaaatgatggggttttaagagtttccaggctggtgaacacgtggagttgctgggagggaggcagacctagataggagacagaagctccacaccccttctgcacaccttgcccgatccatctcttccatttggctgtttctgagttatatcccttataatgaactagtaattataagtaaagcattttcctaagttctctgaggcattttagcaaattatggaacctgacgaggagagtcggaggaatccccagtctgcagcctagtcagaagcgtgagtaacctggggacccaatacctatagaactggcatcagaaatgggggtagccttgtggtactgagcccttacacttgtggtattagatgattacgccaggtagttggtgtccgaattgaactgaactgtaggaacctagttggtgaccaaagaggtggagaattcgttggtgtgaggaaaaagcccatacatttggtatagtaagtattgtgggaaagaacagttcattggtatctaaactgtgtgttaaattcatagaaccagaaagcagaacagtggttaccagtggcaagcggcaggaggaagagaggagttgtttaattaatttcgcattcgaaagatgaaaaggtcctggggatcattttctaaacaatgtcaatatacttaacacacttaacacgagtgaactgtatacttagaattggttacgattattaatttcatgttatgttttgtaccactatttttttaatcaagaaccaattaaagaacagaagaaatatgtctataaaggtctcagtttttcatatttagttttcttcctcacaataaaaacttaccattggtgggataacagcagctcgatgctgaagctgtggcagatccagtggatttggttttaacggagatgagacgagtatagatccagtggggtttaacagtgaaggctttgagtccataggaaacattctgcaattgcaatttaaaaaaaagataaatgaatacatttttaagactcaaacatataatcactataagttcttctaagttagtatgtacatacacatgcacacatggacacatggacacacatatattaacccatataaaatatttggacagttaaggaaaaaggaacctacaaagctgattttccagataaagaaactgaatatcgtactcacttcagcagcgcacatactaaaattgaaatgatacaaagattaccatggcccctgtgcaagaaaaacatgcaaatttgcaaagcattttatattagaaagaaaagaaaaaagaaacctaatactgacttacaggttgaaatttatctgtattgtctatatctaaccaacaaaacaatctaaacgaagtccatttaaaactgttcagtcctaatttaccacaaatatcctaacatgggttaaaaactagttacctgttagaggatgttttattgggatcacagagtatttttttaaatatttgaataagctgctgtgatttttaaactgaaaatttcatccaaaattccagacctctggcttctcatgaaaaatggaaagaaccaacaacatgaaatcagcactccccaacagcagcgacctgccatgcatccagcagccgccaccccgctcacatgagcacacactcctctgctcaccatagtccctgccatctcacactccaccggctgatgttgcccatacctacactcaagtttaggatgcccaatatataaacttgaggaaattttgtactagtgtcatgctttatgggcctggtcatatttcccagtgttgtcatggtcactgggggaaggtgaacatttaaaaatgtagaaattggtaagaaaatcagaatgtatttaaaaaaacaattcacatactatataaagaaagattatattaaagctataggaaattgaaagtgttatttcggtcatttgggagcagtgtagactttagtgtgtcattaagaaaccatcatatttttccaaggaatttctgaatttcaaaactactatcatgttcatctcttaggatgtttaccatttaaaattactgccatcctacctaatttttccttcacgtatagttaccaaaaccaacagtgcaaaacacagataatccttatttagatgagatgtttcaataaggaatgcttaaaaagggactacacagcttgaatccatttatgtttactgcagttaaagactgacaccattaaaataaaatctagattactctgaggtgaaagaaaaagagtgatagtcaaattttctggtaaaccaacacttaagcagaacacctattttatttcaattcatgctgatgaaaattctagcatctactatataaaacactctgaggaatcagcactataatgctccatattattattctagtatcaaatctcattatggagtacataagatataaaatatattggatatgaactgaaaatacagtgacaccaagacacactctgaaagataaactttgaagagaatttagctatctgttgagtagcttgtctctttattcttattaaaaagaaaaaaaaggagtggggtttaattgggttcggattaagtgatgtttcagtctaattcacttctagaatttgcaccaatttatcattctactaaaattataagtgattcaatgtcttttaaggaaaaggaaacaccaggaaataaaatatattaaataaagtaataactgtacctgtaaaatatatatcttttactgtaatttttacaaaaaccataaagatatgatacattttttgtataattaattaacctttaatgactaaagctacctgtaaactgcagggagcggtggctcatgcctgtaattccagcactttgggaggctgagatgggtggatcacctgaggtcaggagtttgagaccagcctggccaacacggcaaaaccccatctctactaaaaatacaaaaattagccaagcatggtggcgtgtgcctgtagtcccagctactcagaaggctgaggcaggagaatcacgtgaactcaagaggtggaggatgcagtgacccgagatcgtgtcattgcactccagcctggggaagaacgagactccgtctcaaaaaaagaaaaaaaacttgtaaattaatctgcattatacctgatattttaaattacaaatatgaacaatctaaaatgttaactgatacaaaaaagtggtcataattatcattactttgcatttaaattatgctttctaaaaattttcagaacactgaacatgtctctcttttcagcattttcttctacctaataagtaggggctggtaggccttgttttgaggttgcactgccttagagaagcgggagtgcctcaatgcctctagcctccaccttcttctaccacatcccactgctgccctcctcaggcacaacagttatctgtggtttattcacaactttattagttgaaattccctgttatgctatcatacagaatacacgtaacaagacagatataggagaaatgtataatctgtttcattaaaatgatcatacaatagtttgtggttatttaaacagaacagtatcagcccaatattaaaattgtacagactacctataacgtgccaatatttacataggagacatgtctgcagccagcaccaccctgtgattcagtcaccaaccagcagagtaagcacggggaggacttatggaacgagcctcacctctgcctctctggctctccatccacatcctcatcagcgctgcacgtggcactggaatcattgtctgactggggctcgggcctttgggcatttatttgctgagctaccaccaaatcttcatctctaggttccaccttctcactggctctatccaagtctctttctttggtattatcaccttcaactttagatgcatggttttctggcaccctcacttcaacgtccacagagtcagctttggtagcgggtgggggatcacaaacagaaccctcttcagcactgtgctcctgctgatctacatccatctgctctgctgtctcagcactgatgctgtcattcacctgggtctccacactttcatcttcagctggttttgtacttggaactgctaaggagggagatgtactgggtgcagtttccgtggtgggctcaagctcaaccgcaggttctgtgtttcctcgagaagtagcattttcaggactgtcctcgctgggcttgacagcttcaactggtgaaggagaaggagcactttctgtatcagaactattttctgcaccttaaagataatgatacagcataaaaatctgataatgaacatgtttcaggtggtgatagaaaccatgtttgaaagtagttgtttaggatgaattctactcctttgatgacctcattgaagtatttacagccattgagaaggctaaagtttcctacagagtataaaagtgaaagatcaaattatcttgaccttctgaaactaaaagcataaaggattttaatgtctgaaaataatttatatgaaattgaaaaagaacgaacaataaaactaaacaaaaaacattcctataaatgatgacattctggtgtatttctagaagcctcttcctgtgaatttccttttacccagctgaactgacactctagaacggctccatccaatagacatataatgtaatcacatctgtaattttaatttttctgatggtcacattaaaaaagtaagaagaaattggtcaaataatttaaactttttttttaatttttaattttttggagatggggttttgctcttgttacccaggctggagtgcaatggtgcgatctcggctcactgcaacctccgcctcctgggttcaagcgattctcctgcctcagcctcccaagtagctggatttacaggtgtgtgccaccatgcctagctaattttgtagaatttatttaattaacccagtatatgtgaaatatcattttaacatgtgatcaatagcaaaaaatcataagattatttttcctttttttgggtactaaatcttcaaaatctggtgtgcattttacattttctgcatatctaattttttttttttggaggcagagtctcgctctgtcacccaggctggactgcagtggtgctttcttggctcactgcagcctccgcctcccaggttccagcgattcttgtgcctcagcctcctgagtagctgggattataggtgcctggcaccatgcccggctaatttttgtatttttagtagagatggggtttcaccatgttgcccaggctggtcttgaactcctgacgtcaggtgatccgcctgccttggcctcccaaagtgctgggattacagacataggccaccgcacccagcctgcatatctaaatttaaactagccaaatttcaagtgctcaatagccacaagtgtctagcggctaccacactggacagaaggctgtagaatactatttcacagatttttaatttaatgttgtaacagatctttccccatatcgtttatattgttctataatcgtttatattgttctataaatagactttcagtgctttttgacatctttacctagatatatcaaaggcagcacaaattcagtatgtcctgtactagagttgtaataaccactcgcaaatcagattcttttctagggtttactatccaattaaacaaaacagagaccaagaagtcatcttttaaaccctcttctcatttaccccatatccagccttgacaaggctcactgattttctctctaaaaatttctcttgaatctatccaatcctgttcaacttcacagctagcactctagtccaaaaccaactctcttcactccacttcagaccattctttacaacaaagatagagttgtctttttaaaagccagattttaccacaataactcactctctcactctcataacttttcagtggacccccattactattaggataaagtcccaaaattgctggtatgatctgcaaggccttgcccagtgggccccctccagcctctccagcttgcacacagctctctgaattcaagtcacactggcctttatttagtttgttcaatgcctcatgcatcttctaccacagagactttgtacatgccattcacctttactgaaaggctctttcacctacttttcctttggtgatcaactcaaacatcacatgcttaaaaagccttctatgggctgggcgcactggctcacgcctgtaatcccagcactttgggaggccgaggtggatggatcacctgaggtgaggagtttgagaccatcctgaccgacatagtgaaaccccgtctctactaaaaatacaaaattagccacatgtggcatgcctgtgctcccagctacttgggaggctgaagtaggagaatcgcttgaatccgggaagtggaggttgtggtgagccgagatcatgccagcctgggcaacaagagtgaaactctgtacccccacccccccaaaaaagccttccatggtttccttaacaaagttatattttgctaatatagttctgataccacatgtactagttacagttacaatcttacatttatttactagaatgatttctggctatttcttccactaggctataaactccatgaagacagagatcatttattttgattatcacttaagtactagcctggtacacagtagactcaaatactggctggattataaagtacatgaatggttgtgaaaacctaagtaaccgtctgggaaaaaaaaatattttttaattgtatataatagacagcaatataaaaaaaacttctacaaattcatcctttcaaatatgatgaagtgtcaactatgtatgtgcagggagctgtctgaggtaccacggacacagcaatttaagaaaacctaagcagatgctctcatggagcccatattctagcgtgaaatagacaacagtaaatatgtgatataggctgagagtggtggctcacgcctataatcccagcactttgggaagttaaggcaggaagaatgcctgaggccaggagttcaagaccagcttgggccacatagtaagacctcatctctacaaaaaaattaaaaaattagctagtcatggtggcgtacaccagtaatcccagctattgggaggctgaggcaagagaatcacttgagcccaagaggtcaaggcttgcagtgagctgtgttcacgctggtacacttcagcgctgggttaacagagtgagaccctgtctcaaaaaaacaaaagaagtgatatatcaggtggtgatcagtgcagtgactaaacgacaaaactgagaaagaagtgggtgaggaggtattatagaaaaaagtgatatctgaacagaggactcaaggaaatgagagaatgagccctaggcacatggtggggaagagcatcccaggtagagggattagaaagcacaaaggctcctgaagtcggggttggtttgcccaggaacagcaaagaggacagtgtggttggagcagagggggccaacaaaaaagcagctggcagaaagttcacagaggtacaaaggtcagttcatgcagagcctcataaattgcagtaaggccttgggtctttatttttactgagatgggaaagtattacagaatttggactagagaagaaacatgatttgattcacattttggaagaattacttgggctgctgtggaagaaaaaacagaatggaccttgtctctacacaaaataaaaaagtacattagtcaggtgtggtggtacacgcctatggtcccagatacttggggggatgaggtgggaaaatcgcttgagcctgggagtttgaggctgcagtgagccacgatcgagccactgcactccagcctaggtgacacagcgagacctcatctctaaaaataaataaaaagaatggaacaaaaagaagcaagagactaatcaaaaaactactgcaatgagggctcctcagaagcagggtaggagcaatggagacaaggatccaattctaaagagactaaagaaaacctaatttattgatatagtgaaagaccagagggaaaagcagcttgtggtggtagagacacatgagtttgctttggctgttaacaacaagatggctcttaggcatccaaatggaaatactgtaggtgatcaaatatatgagcctggagttcacatgagagttcaagtctccaaaaaacaaacaaacaaacaaacaaacaaacaaagacagacaagcaaataattcagaagagtacctcacatgtagtaaggttttaatatatggcagccatggccaggcgcggtggctcatgcctgtaatcccagcactttggaaggccaaggcaggcggaacacctgaggtcaggagttcgagacaagcctgaccaacgtagcgaaaccccatctctactaaaagtacaaaaattagctgggcgtggtggcaagtgcctataatcccagctactcgggaggctgaggcaggggaattgcttgaacccgggaagcagaggttacagtgagctgagattgcaacactgcactccagcctgggcaacaagcgcgagactccatctctaaaacaaacaaacaaaccaacaaacaaaaacggcagccattatcattactgaaagatcctaccaaagcattgaaaagctaacaaaaagcccaacttaaccttcatttctgtttatatagtggtagaaagccccaaatccaagggcaaactaacaaggcatttatcttcaaaatattagaagacatgttagtggttatacagcagatgatatcatttgacataagcacttttccaattttcttcttccaagccacaaaagagtaggaaggtttccaaggcataatgtttcaccaagcagtagccaaacatgagtatctttttttttcctaaaaatacaaaaaaaaaccttaaagaatgatgtagaaaaagagaacaagagcaaatccaaattttggtgaagtttggtctgatttaattcttctaatcatgaaagatactcaaacactcagatgtgttttaggaaaacagatagaggaaccctcccttcagcagctgccttcgttcttcaattggcaagagacttgccacacaataaacagtgcatctgtgctgtctcattgagattaggaataagtatgagatcacaggtcacatgagctgcatttatgttctcttcttgacactttccaaatgaagctaagtcaacaggaagagagagcctacaattctactgggaaaatcatttcctcttaataggaaactcttctagatgattgagcagatgtgatggtgccaccctacacttgatcagacatatatatatatatatatatatatatatatttttttttttttttttttttttttttttgagacagtctcgctctgtcgcccaggctggagtgcagtggcgtgatctcagctcactgcaagctccgcctcccaggttcacaccattctcctgcctcagcctcccgagtagctgggactacaggcgcccgccaccatgcccggctaacttttttttgtatttttagtagagacggggtttcaccgtgttagccaggatggtctcaatctcctgacatcgtgttccgccctcctgggcctccccaagtgttggggttacaggcatgagccactgcgcccggcccagatagacatattaataccagacttgggctttgttatggactgcattgtgcccctccccaccaaaattcttctgttggagccctaccccccaatgtaactgtatttgaagacgaggcctttaaggagatgactaaggttaaatgagattataacagtgggctctaatccagtaggagttgtcttcatatgaggaagagacaccaggagtgcgcacacccaaaggaaaggccatgtaaggacaaagtaacaaggcggttagccatctgcaagccacaaagacagccctcatcagaaagcaactgtgccagcaccttgaccttgcacgtacagcctccagaaccgtgagaaaattaatttcagttgctgcagccacccaatctgtggtattttgttatggcagcccaaggagatttattaacctccagccttcattaacatttataaccccagggaatactagccaccagaaacaaacccattaaaaccaagagactctgacaacctctctagaagtgccattaacacaccaaactaccttccctgtttgcagcactcttaccctaccctcgggtgggacttctctaatactctctctactcttgtaaagatgacctcatttttcacaaaccctcccaaaaacaagtttaaggttaggggttgttcaaagccaaaacccatttcaatacaagtttaagtttaaaagacaacaagaataatctataggaaaaaaaaaacatggaatctaatattactaaacctggaggatgtacaacttttaaagcttatacaaaataaagaccctacacagaaaagagatacaactctaattacacaaactttaaacaaaagtaattgaaaaggaaaacaaaaagaaaatgatggaaaaaattatctgcatatacaaaacatgaacatgtttaatttataatatatgaagagctactaaaagcattataaaaatccccacatcagaagcaatttccaaaaaaaaaaaaaaaaaatccacagaaactttaatcagagtgtaaactgaaataaattaggtatcttttttcttaccaaaaaaatcaagaaaacatttacctttccatgaacttgtcattagtttaaatgacaaagatacattatttcttaaatttccttaagtttcgtgttttttttttctatcggtgcttctaaggtcactaattctttttacgtaaaaacattactacagtacatataaatctctgtaaaaatatgaaaataaatcaaacttaagccaataaaataaagagaaatgtaaccaactatactaactgaacaaataaatgtggcaatgacacagacacacaggtattttattgatgttggcacttgatgtctgaagcaggactgccatttccaagatcttctggaccatcctaggtgctacataaatatttgttgattaaatgaataaaaacattatgttcaagtttgaagtctccacaccatgaaaacactggcacactgtttcctcaatgaagcaactcctacacagtcaaatgactaaaaattatttattctggatagcagatgtcacaactaaatttaaaattttgagataccttcgctgtcttctggattttcttcttcattggaggcttcaatatcttcatcctcctgagcagaaacagtggaagcgacactttcacattgagacacatctcgctcttcacgaggttttcgtgaagtctaaaggaggaaagagtattatttgatttaaataactaaaaagaaaaaaaaattcatttctgaaataatgtagaacattgataagcacacacacacaccagacaaggaggtcacatgtttgacaatagttctggttaaagtgcagataaatacctctccataatcactaactggccaaattttgtgtagatggctcgcctttatcaaactaagcaaaagttacatctgatccacttttggaattactcaccactatacatgtataaaaagccaaaaatcacatacctccatgctttttactcactccagataatgttatctaataaaaacaatatatatatattttttctaaagataatatataccttgaaatgtggaagacataacactacaaaaatcactgctcattattccaacagtaagagatcctaaatataccggtacatttcctttcaatctttcagaggcatatacatgaatataaatatttatgtatacatgtaaacacaaccaggaaagccctatgtaattacatattcacttttttaacataatgtagccatgagcagaacatatcactgttacaaattcttcctaattattgttattaatgatcccatgaaaacattatgttgacataatactgacatatattatgttgacatataattaaaattctcctattttaaggcattttggtaattttcaatttttggtataaataatgctgcaagaaacttccttcactagcattaagaatcacgcaattttataagcaacaactcatcattgatattactactgaatttctttttaccactcaatttatttttcttttttgagacagaatcttgctctgtcacccaggctggagtgcagtggcaggatctcagctcactggaacctccacctcctgggttcaagcaattctctgcctcagcctcccgaatagttggaattacaagcacccgccaccaggcccagctaattttcatgtttttagtagagacggggtttcaccatcttggccaggctggtcttgaactcctgacctcgtgatccacccgctttggcctcccaaagtgctgggattacaggcgtgagccaccgcacccagccaataccactcaatttcttttactataaaaaagcacaaattcagctaagcataggagctcatgtctataatcccagcactttgggagactgaggtgggaggatcacttgaactcaggagtttgagattagcctgcgcaacaaagttggacacctgtccctacaaaaaataaaaaaattagctctgtgtgctggtgctctcctgtagtcccagttacacagtagactgagccagggagatcgcttgagcccaaaaggctgaatctgcagtgagctgtgatcatgccactgcactccaggctgggtgacagtgagactcgttcaaaaaaaaaacaaaaaacaaaaaaacaaaaattttttttaattcctttttaaaaaaaattgtatgctcccttctgcaaagtatgtttatgcaaaattgctcattcttctactggggtcgcatatacgtaagagtacatgtgtacacatttaactataagacgttagctatttacattatatttataacttcatgttactaaatagaaggcttaatatcttctgtgtttgcagacccagggttctggaagtcccagccctgatggtcctctgtcttgtgccccttacagagcctacgtttcacctcatatgagctgtcagcctctcccagtgagactcctcagaagaggaaaatatactactgccctgttaaaaattacccgtacatctactcaacattctcatgcggatgatatttaggatccaactaaaatattaattaactcaagagaaacaatcattttctaatatcagagtcacagaattagttgcaattctcaaggctaatatttctaagttcatagcaggaatgcaagagaatcccagagacacactggctacactttctaaaaagctttcagaagattctgtaaattttcaaggataataactacttttaatttatttgtttgtttttgaatatgaggtgttgctgtgttgcccagactggtctggaacatctggcctcaagcaatccaggtgtgacctaccatgcccagcagataaattattatatggatttttccagagcccagtgtatgtccctctctcaccactatcaacccattctgtttggtcctttcactagtaactagggaagagacaactttttaccctactacaacatccctctgttcacatgcaataattcactacgttgccaagcattttcttcaatatatgatagtattcactaattcttaatgtaaagtcaaatatatagaaacacaggccaggcgcagtggctcatggccagacccagtggctcagacctgtaatcccagcacactgggaggccaaggcgggcagataacttgaggccaggagttcaagaccagcctggccaacatggtgaaaccccgtctctactaaaaatacaaacattagtcaggcatggtggtgtgtgcctgtaatcccagctacttgggacactgaggcaggagtatcgcttgagcccaggaggcagaggttgcagtgagccaagatcaagccactgcactccagccttggtgacagagcgaaactccatctcaaaaaataaaattaaataaaaattaaaattaaaaaaaaaaagaagacattctgccaggaaaactgcctttggggtccaactgcaactcttcccagaatctccaatcaaccagcctactccattagacactggactcaccaaccctccacaatcacaggagccagttccttaaatctcaatctttctttctatatatatgcatacacacatcctgttaactgtgtttctgaggaggaccatgactaatataacatacatttatttatttatttttatttttatttttcagacggagtcttgcactgtcacccaggctggagtgcagtggcgccatctcggctcactgcaagctccggctcccgggttcaggccattctcctgcctcagcctcccgagtagctgggactacaggtgcccgccaccatgcccggctaattttttgtacttttagtagagaaggggtttcaccatgttagccaggatggtctcaatctcctgacctaatgatccacccaccttgacgtcccaaagtgctgagattacaggcgtgagtccccacacccagccaacatttatattttaaatacatatctgactcattttttacttcactttttctcaaaacattttggatgttacctcctgaagtcaagtctttatcttgtcagtagactttttcatgttttggttgctacagcatatttttaactctcacattcttattattaacctaaaggccgctttgtatacacacttttaaatcagtcaatgttatactttgtatactcttaataaattcaaatcttattagctttactatcacactttaataattctcaaattttttggtctaaggatgcaacactcttaaaaagtattaaaggccgcagagaacttttcttttttttcttttgagacggagtctcactctgtcgcccggctggagtacagtggcgcgatctcagctcactgcaacctccgcctcccaggttcaagtgattctactggcctcccgagtagctgggattaaaggtgcacaccatcacacccagctaatttttgtatttttagtagagacagggtttcaccacgttggccaggatggtcttgatctcttgaactcgtgatctgcccgcctcggcctcccaacgtgctgggattaaaggcgtgagccactgcacctggccaaagagcttttctttatgggagaaatatagacagccagatagacacttactatatcagaaactaaaactaagaaaacttcaaaattttaaattattaaaaacaatataaactcataaattattatttatttatttattttgagatggaatctcgctctgtcgcctaggctggagtgcagtggtgcgatctcggctcactgcaagctctgcctcctgggttcacaccattctcctgcctcagcctccccaatggctgggactacaggcacccaccaccatggccggctaacatttttttctgtatttttagtagagacggggtttcaccatgttagccaggatggtctcgatctcctgaccttgtgttctgccctcctcagcctcccaaagtgctgggattacaggcataagccaccgcgcctggccaagaatttatttttttaatgaaaagtaaccattttccaaaaaaaaaaaaatgacttactaaaacagtggcacaaccttccccttttggaaatctcttccatgtctgatctaacagagacagcacaattctcaaggtgcttccacatatgatctaatctgtggattacattaagtaatctaatgttttggttgaagtataagaaaacaatgtagcctcacacagatatgtcgttggaaaagggaagaatattttaacagatttttcagatacttatgcatactattttttgatactgtaccaaaactcaccaagtgtcacttcttatttgttagttacaatatgaaatcttataccatatcaaggaacccttcatactctgttaaaatctataatctggccaggcgcggtggctcacgcctgtaatcccagtactttggaaggctgaggcaggcagatcacttgaggccaggagctgaagaccagcctgaccaacatggtgaaaccccatctctactaaaaatacaaaaattagctgggcatagcggcgtgcgcctgtaatcccagctgctaaggaggctgaggcaggagaattgcttgaacctgggaggcggaggttgcagtaagccaagatcatgccactgcactccagcctgggcaacagggtgagactccatctcaaaaaaaaagaaaaaagaaaaaaatctgtaacctatcttacgtttggtatattaaaaaaacattatcaatcttttatcaatgcatgatccattatgtattagttcattttcacgctgctgataaagacatacttgagactgggaagtaaaagaggtttaatggacttacagttccacatggctggggaggcttcacaatcatggcaaaagggaaggaggagcaagtaacgtcttacatgatggcggcaggcaaaaaaaaaaaaaaaaaaaaaaaaaacttgtgcaggggaactcctctttctaaaaccagtagatctcctaagacttattcactatcacaaaaatagcatgagaaagacctgccccatgattcaattatctcccactgggtccctcccacaacacatgggaactgtgggacctacaattcaagatgagatttgggtggggacacagccataccatatcattctgccgctggcccctcccacatctcatgtcttcacatttcaaaaccaatcatgccttcccaacagtcctccaaagtcttcactaatttcagcattaacccaaaagtccatagcccaaagtctcatctgagacaaggcaagtcccttcccctatgagcctgtgaaagcagaagcaagttagttacttcctagatacaatgggggcacaggtattgggtaaatacagctgttccaagtgggagaaactggccaaacgaaaggggctatagggtctatccaagtccaaaatccagcagggcagtcaaaccttaaagctccaaaatgatctcctttgactccatgtctcacgtccaggtcgtgctgatgcaagaggtgggttcccacggtcttgggcagctccaatcctgtggctttgcagggaacagcctccttcctggctgttttcacagggtagcgttgagtgtctgcggcttttccaggcacacagtgcaaactgtaggtggatctaccattctggaggatggtggccctcttcttacagctccattaggcagtgcactagtagggagtctgaccccccatttcccttctgcactgccctagcagaggtcctccatgagagccccacccctgtagcaaacttctgcttgaacatccaggcgtttccatacatcctctgaaatctaggcagaggttcccaaacctcaattcttgacttctatgtacccacaggctcaacaccatatggaagctgcaaaggcttggggcttgcaccctctgaagccacggcccaagctgtaccttggcccctttcagccatggccagagctgctggggtgcagagcaccaagtccctgggctgcaaacagcaagggggtcctgggtccagggcatgaaatcattttttcctcctcagcctccaggcctatgatggaaagggctgccataaagacctctgacatgctgtgaagaaattttccccattgtcttggaacttaatattcagctcctcattacttatgcaaattcctgcagcaggcttgaattcctcttcagaaaatgggattttcttttctatcacgttgttaggctgcaaattttccaaacttttatgctctgcttccctcataaaactgaatgcctttaacagcacccaagtcacctctagaatgctttgctgcttagaaatgtcttccgccagataacctaaattatctctctcaagttcaaagttctgcaaatctctagggcaggggcaaaatgctgccagtctctttgctaaaacataagaagactcacctttgctccaattcccaacaagttcctcatttccatctgagatcacctcagcctggaccttattgttcatatcactatcagcagttttgtcaaagccattcaacaagtctctaggaagctccaaacatttccacattttcctgtcttcttctgagccctccaaactgttgcaacctctgcctgttacccagttccaaagtcgcctccatattttcaggtatcttttcaccaacaccctactctaccagtaccaatttattgtattagtccgttttcacgctgcttataaagacatacccaagactgggaagaaaaagaggcttaaagggcttacagttccacatgactggggaggcctcacaatcatggcagaaagcaaggaggagcaagtaacatcttgcatggatggggcaggcaaaaaaagagagcttgtgcggggaaattcctctttataaaaccatcagatcttgtgagacttattcactatcacgagaatagcatgagaaaaaggcctgccccatgattcaattatctcccactgagtccctcccatgacacatggtaattgtaggagttacaattaaagatgagacttgggtggcaacaaagccaaaccatatcacattataacatcatgaaatggccatttggaaagtagagttaaagcaagtttttcaaatttggatacatttcatcacacagtaacaactatcgcatttgctattattaccactgatctcatcagaaaatctgtaatgagaaggtgtgaagctcatggttagagaaacatattttccaaaattctcattttttgcttgaaaactcaaaattttaaagtggcaacaaacactatcagttattttatttcaaagacagcctcattcactaattttcaagaaaatgtctcccaaaatcccagtctgaaaacatagtttgtctgtcattctttcaatctaaaatgacattccatgaaaaaggggaggctggtgcaacttagaactcgaacaattgccaaagtgcttttccctgagagaaccatcatattttggtatagagcagaactttatgtttacttcccattacatgacacgaagtataaaaagacatactcaatgggtgagatttaataaaattaacttttactgcgtcatcaaggacattcttaagtgacattttaagaaaaaactgcaaatgctcagcgatgaaaaatacattgagtactagcaccgtttggttccctgccaagatttatgcttaggcatcagcaattttatctaccacagctttgacaccataaatgcaaatgtcatatactgaaaaaaagtaaataacatttgattgatatttttatgaaaacagtcttgacctcatggaatcatcaaaaagctctatggtctttgacaaccactacactggaacttacttattaaggaatttccaataatgttatactctctggtttttaatatttataccatggaatcttctctctgaaaaaatgtctaatataccaaatcaattcactcgatattatcaacagacctccaactaaagttttcaattcaatctccaaaaagtttgtatttttcaaatccagcctacagtaattcaagagtatttaattccctttactacaaatagaaacttcggaggaggaaagataagctggggcaggtcatgatgggccttgtttggactgttaggaatacaaatagaaactttactccttgagcaataaatagagaaacagctagcctatactaaaaatttagcataccttttacatataagtgcaataaataaaaatataagatacaaaaaggtttctcttaaaaccaatctctggagctcagaaaaaaaaaaaaaaaaaaaacatcaaggctagatgcagtggctcacacctgtaatcccagcactttgggaggctgagacaggtggatcacctgaggtctggagttcgagaccagcctggccaacatggtgaaacactgtctctactaaaactacaaaaattagccaggcatggtggcgggcgcctgtagtcccagctactcgggaggctgaggcaggaaattgcttgaatccgggaggaagagtttgcagtgagccaagattgcactgctgcactctagcctgggtgatagagtgagactccatctcaaacaacaacaacaacactctaagtaaaaaacagtaagtaaagagtcaccaccccaatatactcactttctgtttatgctgctgtaagaggttgtcaagattgtgtcgccttttatagttaaaatagaagtttttacattgagcttcacttttcgttcccaccattttagcaattgctgcccagttacgaccatgttctactagacctgcattttaaaaacagaccaaatgttaattgaacagtcacctgatcaagcaaacaagagaaataataaattaacttaatcactgtattcacaaccattgacactagaagtgtgctttcaattacttatcatatatactttgatacttataaaaatacttattgaaacaaaactcatttacagttctatatttttccccctcaaatttaaaacatgctcattaacagaagggctaaaccttgtccttcctatgtatctctcacagggctaggacaacattagacacattagtaatagctcaaatacttgcaaactaaatgattaggtacatctagatctctggacacaatatatcaagccaataagataatcatatataaatgataaacacaatttaaagacatatatatgactccacttataatccatatttgtcctcagtcaattcacaatcaagcaatgccatcagaaaaatactagccaatttaaaaaaatcctatggtaatacaatgcattacagaaacctatgcaatttaacacttctctaatcaatatatatatgcacacacataaacacacacatacgtgcaaagaatatgtatctatgcatttgtatacatatataaggggtgatacaaaaaaatatgaaatgtgtcactcaaatgtcaagctatttacaataatttatctttacaactgcaaggtaaatatttaaccaccaaaaattagctaatctttctcaatattaccaattatttatcctattagaaattttagttcaatttcaaattatagtacattaacaagcaacgacagaaaagcacaaagtccataaagtgccagagtaagaggaaggccacaaagctatgaaagtggcagagacaggactcaaaccttcgctggcctggttacaaacttcatgctctttcctctgaatcacagagcaatctgctagtggtttataattacatgacttaccaaatgcaaactgacaaaagtatttaccatcctatcctattaaatacaacttttaggtaatagaaatatagactttatatcaacattcattccagaacaatttcaatagcatagagtcataattattctaaaaaagtgaaaacgacctacttgttctttaattaaatgacattcaaaataaaactgcagagagaatcttaaatcccttaaaactgggcatcttaaacaaggcacactgggggtactttattgggtaccatactaccagaaaagaactcttaaagtcacttctgagtcctctttgcctttttgaaagaattttttttccaattaaaacaattagttccatctcactcattactaataaccctaaaaaacaaaacaaaaacctgagaaaccagaactactacaatttaccttttttagcaacttccatttcttcttctgtccatcgagaggtctccacaggctctgtagaaactaaaataaagagagaacccaatcaggcagagaaaaacaaagttaaatcctttattcaaaccaatcatataattatatctctttatctgacataaaagactatgtaaaagcatttggtgaaagaaactgcagaaataggatagtaacctctcctccaccaaactagaagaaacaagtcaacacttcaatattatgatctttttcagtgttgttaaaagttctcttcatgtctacatttttaaacattttgtttttttctggagaagtcctacctcacccagtagcttcccacttagtgatctccacctctcctctcctgcagtgtcaaaggaagaagcaaccctcctccttcctgtccaagcacaattccctctcctctcctctgagcctccatcttgtcctaaaactcctggagcccctttagttcatccccgagtgtctgacatccagtgggtaaagatggatcatgaactgaatatgttctcttttgcttcaggaaaaaaacaaaacaaaacaaaacaaaacctgagaacatcaggcctgatatgagctcctgccatattccctttctcaatttatagtaccagcattcacccagtcactcaagttaccaataggctccttagactgatagactaatttttgaatcttgcctcccatttaccactcacatccaatgacatgcatcaactctgaatccatcccctccttgcttgggccactgcatacatgctgggccctctgcctccagcctttattctgtctaaactgacctccacaattgctatcagttaacttccaaagacacaaatctaatcacagcattcctctatttaaaaacctctgcaagttccccacttcataatcaaagcaaaatacatttcaaacaaggcccatcatgacctgccccaacctatctttcctcctcctatctagttagtgcccctatctcattcttgccattccctaaactgcattttctttcatacttcagtaacaatgatacctctgaatcattaacagtggtactctatcattaatctagcctttttataaactaatgagacaatacttaatgagagagagaaagatgctttgactattagatccagtattcccttgcctaagaatttattccatgacaaataatttaacataaaatactatgtgaataaagatttttttattacagtgctatatacattggtttaaaagcagggaagagggcagacaacctaatcattcagcaataagagaatggttaaagaagtcatgcctcaatattacacagccattaaaaaataaaaatggtaattattagaaattagaaaatatttatggcacactagcataacaactaaataaaaaacagctatattggggtggcaagactgggtgatgttctttttcaaaaaactttgacattaaagtttaaaaaatttaaagaccacacttcaggattatttctaggttgtcaatattaaaagtcctttctaccctatcctagcagtgaaacagaatcccgaacaaaattatggcctgtttatgccaattgtttccactcactgggttctggtggcggtggcagaggtggtgggggctcttcagtagccgctgcggctgcagcactggcagctgcagcttcgtttgtcatggacctggtgatccggcccttacggcggccctgactgttggcagtctttcgcccccggggtgtggcttgctctctttcctcagtttcttctgctgtaccatctatcttgtccttttccttggtattttctctggacacaaaagcaaatgaaaacttgtgtgattccaaagtatacatacatcgaagaaggttttagttttgaatattatctaaatagaaattgaataaaactacctaatctctcactcaaaaaaaaaaaattatcaacaattctgccataccatagtttttaaaagttttgaccagctaaaattaagatattttataagacctattttacatactaatggacttaaaatttaaacacatttcaaaccaactgatttagaaaccagaactactccatgagaaagtaacaaatgacagcagaaaagccctagacctgcaatccagagacaacagcctacaccaaaaggcaggaattctggggttttatttgcctttagtctaggttgcctcatgtatgaaatgaagaagctaaaatagatgatcttcatgatagatgccttttctatagtaataatccacaatattgttttacagtaataatctacaatattgttttataaaatcagactcaatactctaaatcatgtctgatactaattatgtacaaattgggcagtaatggttaatacttaggaaacggcctctggagccaggctgcctgggtttgtaccacagttgtgatttactagccatgtgatgaccctggacaagctgcctcacccccatgggcctcagtttcctcatctgtacaatgagaaaaagtttatttcatgggactgttgccaggactgaaggagttaaataaagtacccagaacagtgcctggaacacagtcagcatcaagtaacagtttgctattattcaagctaaaactccctcaggatataaagtgcttaccatcgtctcaggcatgtagaaacatggtggttcctattaatagcaacagtactacatgtaatactggaagaccattttctgtactacttacctcccatggttgttatatttaaggaaacgtactcaatgtacatttttgcaaatgaatggatagatggcaatactcaaagactcaattattcttgcttaatggaagatgctgatttttttcaaaaataattctctccccttcagtcctaaattgaagtacaacatagtcctttccctttacttacttattcccttataaagctggcttctattctgaagcctcctgttaaaagatgttttctcaaaagtcaccaatgacttgcaaactgcaaaatcaaatgacctcttctcaattttccccgcaagtctttctgttacaactgacgctgcagttaattcttctttttatatcacttgaaactcagcttttgaaatatccctgctgctactctggctttccttcaagggacagacctttctcctctcatcctttcttttgggtttctgttttttgtctttgagaaagtgtctcactccgtcacccaggctgaagagcagtggcgcgaacacagctcactgcagcctcaatctcttgggctcaagtgagcctcccacctcagcttctcgagtagctgggactacagacacgtgccagcatacctggttaatttttgtattttttgcagagacagggtgtcaccatgttgcccagggtagtcatgaattcctgtgctaaagcaattctcccaccttggctgggattacaggaatgagccactgtgctgggttcctctcatccctttcatacggggatttcccaaggctctcccctagagccttagagctatgtaaggttacccattctcataagttctaccgggaggactccaatctctatctttggactcacaccccaactccaaagactcaggcttatcttcccaactacctgctggaacggccacctggattttccatcaatagaaactgaacatatccaaaatcatattcatcctcacctctgctccttgctccacgtcactctctaatcatttgttgttaacattcctaccatgttcatcatcattcaggtttacagatttgatatcatcctttgctgtctccctcttcccatacttcctacatgtgatctaatgccaagttttggttatttcatctcagaaatgcctctctcactaattttaccatctctatttctactaccactacacttactcaacaccttagtaccccaatcctggcctttcatactggcctccctgattcatatctctagtctattcattttatcttgccaatgaatcaacattctagcaggatagctttggcaataaaccactccatccattctaatccctttctaactattcccagacagacacacagcacagcctcctgaatgaagtctaccatttttggctttcattaaagctctacataatttaattccaatccaccttccacttctcttcttgatgcacactatgttaagtctaatgaaatcattatcttccactagctattcatgtgattccctctaccctacccacattaaccactagcatctgctaatgtcctccaaattatccacagagaagtagcctcgacctcttcttaatctgccaaagcacttaactggtcgtctgttgacttcttactgccaggcttttatttcttaaagtaatacttgtactttacctacttttcccctactaaatcatgaactacctgggaatagtatacatcttacgtattttcacattctccctaagacctagctcacatagataataaataaaagcttgttaaatagtttagaaattttaacaaaaaaataaaatcaagttatgacagagttccatgtgagaagaaccactggctacatggcccaaaaaatgtttaacccaaactaaaagaaaaaaatatattcccttagaggtatcttcctcaggtataaaattacaatgagaagaatatctgtctcttttaaaacatggcaagtgactagctactttagcttccacaaaactaggtaaatcttaaacagttccacaaggactatagatataacataataaatattaaaaaggaacaaactactgatacattcaacaacctaagtgaatctcaaaggcattcatgctaagtaaaagaagccatacatactgtatgatttcaatttttatgtaattctagagaaagcaaaaaagatacatgacggccagaggctggaaatgaggaaagagaaactgactgcaaaggagcatatgggaaccgtttggggtgatggaaacattctacatcacaattgtgataatagttacacaagtgcatatgcttgtcaaaacacatcaatgtacacatttcaaactggtgaattttgttccatgtaatttacaaagctagttcttggggaaaaaaacaaccaaaccaactgtcatgcccccactcctaccacacccctgtatgtccacaaaagcatcaacaataactccctgagtggcagaatcataggttaattttcactatatttttcttttcctgtttttctataatgtaattttataactaagaaaacagcagtaacaacaaacaaacccaaaactccattttatatgacgaagtcaataaagctggaatctaaaatataaaaatgaactcttcctgtcttagcatttttatactaatatatactacctgaggctcaaaaacagaacctgaggaatcttccaaatcaaaaattaaattacattcaatatatcctggaggaaagtatatattactataacccatcccttctgaaaagtaataataactcatgacttgcaaataagttcattaagtcaaaaattacatttactgtaatattctattccttaatcacatcaacttaatcatgtaactattagatgtttctaaaatttcggccaggcgtggtggctcacgcctgtaatcccaacactttgggaggctgaggcagctggaccacctgaggtcaggagttcaagatcagcctgggcaacatggtgaaaccccatctctactaaaaacacaaaattagccgggcgtggtgacgcgtgcctgtaatcctacctacttgggaggccgaggcacaagaatcacttgaacttgggaggcagaggttgcagtgagccaagattgcgccactgcactccagcctgggcaacagactgaggctctgtctcgaaaataaataaataaaataaaatttcagcagattaaatttcattatttaaaaattactaggctgggcgcagtggctcacgtctataatcccagcactttgggaggccaaggcagatggatcacgaggtcaggagatggagaccatcctggctaacagtgaaaccccatctctactaaaaatacaaaaaattagctgggcatggtggcagatgcctgtaggcccagctactcgggaggctgaggcaggagaatggcgtgaacctgggaagtggagcttgcagtgagccgagatcatgccactgcactccagcctgggcaacagagcgagacgccatcacaaaaaaaaaaaaaaaaaaaaactatacttttgcagcaacatggatcaaactaacggctatcatcttaagtgaaataactcagaaacagaaggtcaactatcacatgttctcacttataagtgggagctaaataatgtggacacatggatatagagagtggaataagagacactagagattcaaacaggtgagagggtgcgagggggtgggtgaggtataatgggtataatgtacactatttgggcgatggtacactaaaagcacagacttcactactatgcaatatatccatgtgacaactgtactccctatatctacaaaaataaaaataaaataaaaataaacatttaacttattatataactaattatttaactcacttggagtcttctttttcatctttttcctcttcatctttcttttcttcttcttttttttctgttttttctgctttatcctcttctttttcttctactttttcttcttgcgagggtcgagcaatttgctgctagaatgaaccatcatttgtaaaattcaaaggcaaacagaaatagctccttatagtgtgataaattatgtctatctaaaaaaattttaaatgattgttagtcatttacaatgtaactggtgatcgtgtgttaaaaaccagtctagaggtttttaatgtattctatatgtactgcttgaagggtcctacacgcagacacaaatgctcatagcatttggacccacgagaaagtgaaaatgttaagattctactcggaaatctggggttggttcccttttttggcaacctccacatttaatctgtcactcaagcattccaattctaccttaaaatttgataacccatacataatttatcatgttttagatacttaatatgtttccaattttttcatcactatctataatgctataagaaacatcttcatgcatttatacttttgagcgaaagtctacttaatggaatatgtaaacagctatggtcgttactaagactgaagtaatttggaaaaatactaaagctataataaggtgaaaagaagtaaaatgcttaaatatttctaagctaagcagtcacactaggaatccttttatctctgatgtctcatttgcaaaacctgtgactctaaaagaaaaaagtgaaactaagtgtgcaatgaatgctactacagtagcccccaccatatcaggagtttctctttctgtggtttcagttacctggagtcaactgcagtatgaaaatgggtaagtgtagtagcgtacagtatgatatttgaaaaaagaccacactcatgtaacttctattacagtatattgctataactctattttattatttgttactgttaattccttactgtgcctaatatacaaatcaaagtttatcataggtgtgtgtgtgtatatgtatatatctgtatgtatatatacatgtatgtatatatctgtatgtatatatacatgtatgtatatatctgtatgtatatatacatgtatgtatatatctgtatgtatatatacatgtatgcatatatgtatgtatatatgtgtgtgtatatatgtatgtatatatacgtgtatatatgtatgtatgtatatatacatgtatgtatatatgtatgtatatatacatgtatgtatatatgtatgtatatatacatgtatgtatatatgtatgtatatatacatgtgtatatgtgtatgtatatatacatgtgtatatgtgtatgtatatatgtgtatatgtatatatacgtgtatgtgtatatatacacgtgtgtatatgtgcatgtatatacatatgtgtatatacacacgtgtatatatctgcatgtatatatacacatgtgtatatatgtatgtatatatacatatgtgtatatatgtatgtatacatacatatgtgtatgtgtatatatacatatatgtatatatgtgtatgtgtatatatacatatatgtatatatgtgtatgtgtatatatacatatatgtatatatgtgtgtgtatatatacatatatgtgtatatatgtgtggagatatatatatatatctctcatagtatattagggttcggtactatctgtggtttcaagcatccactgggagtgttggaacatatcccctgtgaataagggggaactgctttattttgcttttaagagacaacatctcactctgtcacccaggctacagtacagtggcatgatcatagcttactgcagcctcaaactcccaggctcatgcaatcctcccacctcagtctctcaggtagctggggctacaggtctcaaactcctgacctcaagtgattctcccacctcagtctcccgaatgctgggattacatgcacgagccattgtgactggcctgcatttttatttaattcagaaatcaaaactgtataaccaaattaaaacagaactccaacacatctttccagcacagcaggctggcccttgcacacctccctccaatcaccatcctgccacatcatcttcgctgttctggactcacctaaacatgcccagcacttgcatagctttctacccttccctttcctgataaagtcccacatagtctctacaattcaggtcaaaatgctacatctcctgtgaagcctctcttgatttccacagaggaactctggggccatgtccttccctctccaccacagaccacacctgcttgtagcactgtcactaggtggcttagtgcctgcttatcagcatccatctggctctctgtgttatcatctcatcaagaacaagaatccaatcttacttctctaagcatccccagctcccaggagagtgtctggaccatgatgataggtgtatgcatatgttggataaaacaaaaatcaaattcctttattccagttatctgaaaagtttttaccctccaatctcgactgttcattctgatccaggctaatgtcaatcttgcctcatagcaactctacctgtcctcttacttgtttttaccagacaatatggaagtaactaattaattttaagaaaaatttcccttcttaatagcgctccaaagtcttttacctattcatcaaaaccaacacttagctttttccttaagataatgaaggccttattcacctccccaaaagaagtcccatccacattatgcctccttctaatccaaggggcaaggaaagaagaaaatgaatccttcttggtccacttccagaacattgctgaactgtgatattttaaaaataattcctttttcacgtttcataaaatctccctagatcaacattctcttttggtgttatggaatgacttcttaaatattccctagaacatataagtgattgcatcacatggctcattatgccttgacattatttttcagatttcaaaatgcatgtcaatggcttttctaacactcgccactcaatcaacataacatctcacagttaaaatacttttaggtcatggccattaaactccccacatgcaaaatcacaattgcctcctcattagcagtgggcactgctttgcctcctagatcctaaaatcagaaagtcttctctccaactacaaccacccatcgcacaccttcattgtgtctgatcctgctttgtcctcattgtgacctttgaacccttattctatcaaattttcacagtccagtgagaactgtacctactattctacttgctaaagcatttcaataccatgattccttcacttgctttatctgaccttcctaacttctcaccctggctaactgccagttcctctttcttctggatatttattgctagagaaaactgataaactagggagattttaaaatttaaactttcaaaccatgagtaggtctgctttataattgggcaagttttactcagctctgactccctgggacactacagtggtcacaagacctgtttaaatgctaataacctaaccctgtaaccaatgtagcatccatgtgtcactctgaaccagtaagatggcatagtaaggacaaatcatgccctttgcctagcaagtgagctgtgtaacccagaaaacggtttatggcctaaagatacgacggggacatgtcaactcagcagaacgtaaggaaagaaattcagtatccccttagagttgggtaacacatgctaatcttatttccccaatacttttctgcttctaatgccaatcagagcttcaaagtaatcccacgcattccctgctgtctaaaatccaaccaacagataacttcactcccctttccctggtgctagggaataagaaacaactgcagcacctgcttaaaccaatcagtgtaaagaaggaaacagctcctggctctgcatagtgtggaaatgatccaaagaaatggacagagttgctgcattagagtctagagaagtgtttggtacctgtccagcagaacctctcacccctctgtatactgaccaggcagtggtgagcggagaggaagtgcagtcagcagcaactggaggacctcacctttgtgcaatatgcataaagacctatcataacaactgccactgacattcaagagagtaaggaattacctctaatttaaacaagagatgcttggaactacttttgtttcaggcaaatctgtaaagagaagtgccagtcaatccacatggtctaggatgaaggttacaagttacatccctcaactccacagggtggctggagcaaaagaggtccaccccttcaaaagaaacccttctaaaagttccctacacagacacaaatattcgcaatggctcgttgtccaggtttttccttttctccccttctttaaactcaatacttgagagccaataaaacaagtttaattctgtcagggagttaatataacatgaaacatttctgtcaaataacaagctattcactatgaatgaatattctagaacacatataaaacaaaatgaaaattcaaagaaaaaagtaaaagttaagtgtatttctttttatttttatttttattttcattgtgagacagggtcttactatgtcacccaggctggagtacagcggcgcaatcttggctcactgcaacctatgcctcccaggctcaagcgatcctcccacctcagcctcctgagtagcttggactaccagcacacatcaccacacctggctaattttttttttgtattttttgtagagatgaggtttcaccatgttgcccaggctggtctcaaattcctaggctcaagtgatttgcccacctcagcctcccaaagtgctgggactttaggcataagccaccgcacctggaattttttttttttttttttaagactggatctccttctgtcgcccaggctggagtgcagtggcgtgatcacggatcactacagcctcaactcccaggctcaagcgatgctcccacctcagcctcctgaatagctgggattacactacagtgcacgccactgtgccaggctaattttttaatttttttgtagaaaatcaaatttttcagttttttaactttttgtataaatttttaaagtttttgtccaggctggtctcaaacctcccaggctcaagcaatcctcctccctcagcctcccaaagtgctgggattactagtgtaagccacaatgcttgacctggtaagtgtatttcaacataatttaagaacaggattcagtttcatatgggtcccctttggcaagatcaaataatagtttatgctaagattcattactactatatataaatgaatatctaactatatatatgtgctaattatatttgttttaaatgttcaccttttttagaaaagagaaacagacaagttcccactcaacagaaaataagttgccaaaaaacgaaattactaaatttaataacaagcagcaattgtaaataaaaatttacacgaggaagaaaatgaaataccgtttcactactggacaatattttctttaaaaatatacttcgggaaataaacagacaatatcttaagcctatcttatcaaaatttattaacaattagtgctcctaagccaactgaatttcagactaacttcctgaagagtgaaagctgtcaatcaccaaaaaacacactgtggcaatggcaataaagataacagtggctaccatttattgggcactctctgtgcctgactctgcactccagggactttacacacatacccagttcttattaaccatgcaacctaagtatcactgaccccactctcatgaatgtggaaaccaaggctcaccaagtgaaaggacccacctagagtcacataggtacaattgggcagagcactctggggctagagttcttgctgatataataaacttcttaacttgtctaaaataatctttctatctagtgactagctaacagtttagtcagaaaattcctccaatttcaaaattgctatatttacctaagtatatgcttctgaatacctttagggaataaaaacacactggcataaaggggaaaatggtgttagcataaaagaagggcatgaattcctgtggaaagtaatcaagcatttggaaatgaagaatatggtttctaacatgacttgctttactgcaggtaactagcaagtaccacagtaattctacctgcacagtgacagacttaccagatggcagtttatgttggaaaaatgcagcatttactaggggaagaaactcttactgctagcaagaacaatgtacatagaatcaaactattacgtagggcataatcctagatcctaaataataacattcaacagtggtttttggcttccaatctccaatatgtattcattacttcaacaaaaacatatagagaaccacactcactctccatggaatggtaacaagctgaactataaaaatgggttggggtagtctctatcagaatttggagagaagagttaaaattcctgccaagaataacctctgaacacaattttaacaaaaatataaacatctgtctcattttcctatgagtctaagattaaaactcattttcagagtaaacactactaagcttccctatagcaacaggttttaaaaaatcaaactttgcaaacttagaatctatcaatagcaaactacacttttttttttttttttttcctgagatggagtcttgctctgggattctaggcatgagccaccacgtccagtctggcttttcttgctttccttccttcctttccctccttccttccctccctcccttccttcttcttcttcttttttccctccctcccttccttccttttctctttctctcttctttcttttttttccagacggggtcttgctctgtcacccaggtgggagtgcagtggcatgatctaggctcgctgcaacctctgcttcccaggttcaagcgatttttctacctcagcctccagaatagctgagattataggtgtgcaccaccactccaggctaatttttgcattttcaatagagacagggtttcagcatgttgcccaggctggtctcgaattcctgacctcaagtgatccacccgccctggactcccaaagtgttgagatcacaagcgtgagccatcgcacccagccacacactatacatttatctgctgaataaaaattacttcctacaaaaaggaggctgggagtagaggatagggagagtaatcaaactcatattgacaggatcaagcataaacttcagcagaactttaaagaatctttaagtaaacatgccataatggctgtgagatcacctgagctaaaccctcctgactagagcttggttacatagcagagaagtaaagtgattttcaaattagttggatctctgtatccaccagggtaaaatcaagggagttgatacatagattttgaaaatcttaaccttgcaattcaattctgtttttaaaaagaagtattctaaccttttttctatatagcaaattctatatctttaacccagatctttttcctacactccagacttatatgtctaactatccactttacttggacctcatttggatctctgcttagacacctaataggtatttcatattcagccatgtcctgattttcccctcaaaacctgctcctccttcagtcatgcctgtcacagcaaatggcaactccacaggtcaaaacttgttttccttgattattgtcctttcctcatccccacaatcaatccatcagcaaaatctcgtggttttaccttcaaaagtacatccagaaactaatccgttctccccgcctcctcactgtagcctagtccaagtcaatgggattattaaaacaacctcctaactggtttctctgcttcttctcttgtctccttacaaactattctcaacagagcaaccagagtaatcatgtcacaactgaaatctggcagccctcttttgctcaaaaccccagtggcttcttctctcacctggtatcagctcaaaaggccttcagttttacacagagagcccttaaactaacaccacctaatttctgaaaagctgcccctctattttgacacaaataaatggaataagtatacaaacaattaagaaacaatggtaaatctggtggcatgagatgatggtctaaattcatttaactcacacctctcccaaattccccgtgaaacaaccagagaaatgtaaaattggaggaaaaatcttcaaagcaataacttaaaagctaatgagggcagagctagcctaccagaagtgctgaccaacccaaaactgagcctacctgggggtaagcaacctaaggctcaggtcaaggtgagggtatacatggcaattctcacatctgcaaatacattctgagacaggtactttgaaacatgcaacaagaatgtacagaagagaacaccaacatggctggatcttaacaaggatcggtgtgccacagagaggagtgaaactgtgtcccagacaactttaggaaagaaacgactgtttcagaataacaaacatccgtgccccatagaacttcctgctagagctctctcctctatcatcatgggcaactggctgctaatctggcaaaggttaaggtacactgtataagtatcaccttatctcttacgttaatgtaggactgaacattttaaacagtaacatatataatttctaaagataaagttataaatactatttggcaattaggaacaaaactgttagaaatttgcagctgaggccgggcgccgtggctcatgcctgtaatcccagcactttgggaggccgaggcgggcagatcacgaggtcaggagatcgagaccatcctgactaacacggtgaaaccccgtctctactaaatatacaaaaaatgaaccagatgtggtggcgggtgccggtagtcccagctactcaggaggctggggcagcagaatggcatgaacccgggaggtggagcttgcagtgagccaagatcgcaccactgcactccagcctgggcgacagagcgagactccatctcaaaaaaaaaaaaaaaaaaaaaaaactgtagctgaaacttgtttaaaacatagatggtccctatgatctctagctaaaagggtattacaggaccttgattccacattctttaggggaagcaggaagaaaagccctggcaatattcttctctctggtggaatagtgcttcctatttcactgtcaacactcaatttattccttttctgtcagtacatctttatgaagcttggcaagcacccatcctttgtcttacggtactgcacccatcagtgtacaagtatgccctttatcctcccttctctgatcctcattagccctaccgacccatttcactattccactttataaaaaaattttaaaaacaaggttgcacttgtactaatgccacttcctcaccttctgtatcttcttcaactctgtgtaaccgtgtttctgccccctcactaattcactgaaaatccacgtctaaggcaccttggcttactcaacctctaacagcattttacacagttgactcatgaaacactcgctatacttttttaaacaagaaatactgtttccaaagagcatgtaatcacatcatgtggggtggtggtgttctgtgggaaataatgacccagaaaacataaaaaggttatagctgtgaatactgagagaactgggtcaataacctatatctggtaaccaggggctatcaaacgaagaaagggagtaagaccccaccccaacaaaagggtggctgagtgggaaaaccagaagagatttaataatgctaatgaatcgttgcagtgtcggagctcatgcatgcaagtccttattgtaatatctatccgggtgtagacagcaaaagcctccatattaactgtggtggtggcagtagcgcagcagtctctctggtaagcacctgtgagctatggcagctgctgatcagttatttggggaaaatcattttgaaattactgaattgcaactgtgaaaactaacctttttcagttttatacttctggaaaactacctttagtaaaagtgccttttttattttttggagacagaggtcttgctctgtcactcaggctggagtgcaatggcacaatcatggctcactgcagcctcgactttccaggctcaagccatcctcccacctcagcctcccatgtatctaggactacaggcatgcaccatcatgcccggctaattttttctattattttgtaaagacaggatgggtctcgctatgttgcctaggctggtcttgaactcctgggctcaggcgatgctctggccccagcctcccaaagtacggggattacaggtgtgagccactacacccagacagaaaaagtgctttttagaaattaaattatctaggctgggcgcggtggctcatgcctgtaatcccagcaccttgggaggccaaggcaggtggatcatggaagtcaggagattgagaccatcctggccaacatggtgaaaccccatctctactaaaaatacaaaaacttagccgggcgtggtggcaggcgcctgtagtcccagctactcaggaggctgaggcaggagaatcgattgaacccaggaggcggaggttgcagtgagccaagatagcaccactgcactccagcctgggcgacagagcgagactctgtttcaaaaaaaaaaaaaaaaaaaaaagaaagaaagaaattaaactatctgaactccacaaatgaagttaatatgaaacaaaatcaggttccaggtttttgtaaagaatctctaatcaaggtaccatgttgtatttctctcccttactctacctgacccctcctcagataaacagactggctaaagatagtgtattaaaagtattaatggcttcatatttaattacatgattattgctgacactgaaatgcatgactcagatgacagaatggtataaaacttttctaattaattttatcatagtagaaacttaaaatatatttgaaatacaagatttaatacattaaatatataaatataacttcaaaataattataacatcctcactaatttaacagaaacatcaatgtttaaactacacactaagggcaggacttctgttttaacactttttgcttgcctatttcccccaatcctgaaatatcttccatacaagtaagaaaacacacctggtttctgcctctgcgtttcccataattccttctgacgagggctttataattctcatttttcttggttaaatagtaatacaaaacacaatcaggaacactctgtaagaaataaaacaattatttttgaggatccaatgaaataaagaaattttttaattaaatattacttccaaggaaaatctctggtattctgaaagtaaaattaaagaaaaagaacaacatacattgctagcattttaaggcatatctaggctctaaaattatttacattataggtactattttaatagacagttacagttgttaatccaaattatgtgaaagatgccaggaactatcagaaacattcaaatattttcttattaacaagtaaattccctttctgattacatacatgcaaatttttaaaatgtctttaaatattttgttcaaaaacattaaaatcaactttatattaaatatggaatgattcacaaatttgcttgtcatccttgcgcagaggccatgctaatctctgcatcgttccaattttagtattatgtgctgctgaagcgagcacgagactgatattttaattagaaatttaatgaggctccaaaagcattgtaatctatgtgttttagggaaataaacatcaggtcatctttcattaaccatttagttctgtgttctgtgttacgatttctctaataattgtaattatcattacattaatcacatgagactcttcgcagtctttttaaaatcggttctagttaactacttatatgtgtcagagcacaagaatttcaaagtaacaaccatcacaaacctacaaacactcccaatgcaaaccatgtcttaccttcctctccaagtatgatgcaattagtccaaagttttttggatgctggataaacctgagtgaaaacgaaaacaaaaacacacttgcgtacaaatatttcaacaactaaaaaaaaaaaaacttgggaaaagaaagactatgtataggctgggcgtggtggctcatgcctgtaatcccagcactttgggaggccgaagaaggtggatcacttgaggtcaggagttcaagaccagcctgaccaatatggcagaaccccatctctactaaaaatacaaaaattagctggggatggtggcacatgcctgcagtcccacctactcaggaagctgaggcaggagaatcgcttgaacccaggaggcagaggttgcagtgagccgagatcacaacactggactccagcttaagcgacagagcgagactccgtctcaaaaaaaacagaagagaaatactatgtatagggctttctaactgccaatctgaggaacaattgtagaatcactggagacttttaaagggcacagatttctgggcaccatacaccaggaaatgattagtctacggtaatacatagaaatctgtactttataaaagctccccaaaagttcagccagcacccaagtttgggaaccactcttaacatgactccataaccccagttcttatctgttacctcttttcccacctataaacttacaggaagatcaatattctctacttttcacagtattgattcaaacaccaaaatgggaccaagtttttgtgaaaacagttcaatttacaagtaaatgccaaatactttttactaacttatgtagatgtctattagagaataatttaaaatataaattacttgtccttaaagatctccttttcatggtcagtccaaacattcataaactgcctatctttatacactttcatagggtcctccataagcccattcatgttaatgaacttgactcgtctttgttctgcatcaaacatcataggtggaatcacagagagctgccgcatttgtttctcattattctggaaaaaaaatacaatttacttagaataaaacataaactagaaatttaaggagggccatggaccaatgctcttaatgtgcactaaaaaaccatgtatgcagtttaataacaatagcagtgtataccacagcatctaacatacaataattactcatatatctaataaatattcactgtatgaattacagaggcagagaatatccatatcgttttttaaataatctactcctttgagaagaattcttttcttaaactaagctgatacttaacataataaaattttagacctggaagataaaaagtaatgtcaagttcactgaagtggtgaccttatggagcatttaattatcatattagtctcattttttaaagtctcaacatcattttatagaacaacttttaccgtcatattacagaacaataaatagaaaaataagcaaacaggcatcaaaatttaagtcagcgattttaaattaaactcactttactattaaacgcttcttgctaattttacatcatctttccattgaaaatttaaggttgttattcttagaaatgaagcttgtttcaactaaaactttgttacacgtgcagaacttatttttcccaaagtttaactgaggaaatttttaagtacaaacttctatttaaaagcttttacccaaattacaagtatttacccaaatataagaaaaggtatttccctaaaaattttcctcataaaagtggatactgcctaatagtcaagtccttacaaagtctctaatttcctgggacactctcaatcagtttgaacactatagtgtttagactgaaattacacattagattgaaattacctcaatacataaactaattttagatgcttacaaatgtttcctcatggaatcagtcaaagagcaaataaagaaatttaacagagatttactcatcattgtagaaataatggctacatattccaagggctgaatgtcatttcaatcatgtacttacagatgtttcctcatggaatcagtcaaagagcaaataaatttaacagagatttactcgtcattgtagaaataatggctacatattccaagggctgaatgtcatttcaatcatgtactttagaggtaattttaaaagcaatatagagtaagtggttatgttttaaagctcttgattatactgctacaaaagaaatgaaaaattgctgggcacagtggctcacgcttgtaatcccagcacttttggaggccaaggcagaaggactgcttgagcccaggagtccaagtctaatctgggcagtatagtgagaccccatctctacaaaataatttttttaaattagctaagtgagaggctgggtggggtggctcacacctgtaatcccagcactttgggaggccaaggcaggtggatcacctgaggtcaggagtttgagaccagcttggccaacatggcaaaaccctgtttctactaaatatacaaaaattagctgggtgtgctggcatgtgcctgtagtccctgctactcgggaggctgagggagtagaatcgcttgaacctgggacgcggaggttgcagtgagccaagatcgtgccactgcattccagtctggctgacagagcgagacgccatctcaaacaaacaaacaaacaaacaaacaaaaagttagccgggcgtagtggtgtaccagtagtcccagctattcaggagactgaggtgggaggatcacttgagcccgggaggtgaaggatgcagcaagccaaggtcacaccattgcactccagcctgggtgacagagtaagaccctatctcctatctcaaaaaaaaaaaaaaggaaaattcacttgtcctgatattatgcaatagtatgtgcaatatgtatttagggcttgagataaaatttagcaatgataacatcataaatgtattccaaaagaagtacatctccgggaatctgggcacagtgaagctggtatgctctggaacactgataactcaaaggtgtctctagaaatggctaagatcctgaaatcatataacaatgcactgaaaagcttgagtgtgggatatacctctgactaaatattgtaattgtccctaaagagttatgtatttcaatgcaccaaaaatcaccttggaatcctctctttgggaaaggagaatatcagaaataagaaaggaaagaaaaaccacctgtagaagtctattttgatcagtataagaacaatctgagaagtaaaatggtttaaggaactctgagatatagtttatatagttctatacctcctccagggctagtttaactagaattctgaaacacagtaacttataagagcatactatatacttttataagagcatactatatacttttatttagttatgaatgcaaaacagggtatcataattaaatactgatagaatcctacaacatatatcaacacaaagacaaactctgtacaaagaggctattttttcatcctggagaaaaacttactgcaactgtctcacaagtaatttttcatgagatcaagcaacttgatggtttaatttaccattgtattcccaatgcttaaaggaaagtttggcacataataggctataaatatttgttgaaagaatagacttgattgaatatagatatggaaaagaacacacagttccagagtcagactgcctgggttgagtatctggctccactatttattaatttgtaaccttgggtgaattatttaacctgcagctgggctttagtttcttaacttgcaaaacagccattaattatagcctccatttcacagaattttcacagtttaaataatacatatgaggtgcttatcacaattggcaattttaagtagtaactacccctcaaactccccctcctcaaaaaccaaagatgtagttagtccaccataacctaaaccaacaatacccatagaaaaaggagaaaaagtactggctaggttaactagtagtaaagggtagagcagaggaagtcataacactgctttttacttctaaatgtgctaagtagtatgaaaacaggaattttacttatctaaattatttctaaatcattgaacattttagattaaatccacttcacctaattttgcaaatcgagtattaactgtatatttaagtctacttaacatttattttgaagtatacagcatggtaaaaaatatctttgatcattacttaaggccactatttcaaataaacaagactctcagaattttgagatgaggtttaagaaaaggcatataataaaatcaaaactagcaaaactcagtcaatactagatggcttttggaacaatcttgagagtttgaacagggctaaaaagattcaatgttagaaatggaaatttattcttattctgcatttatttattaatatccaattaaacactaggcaacaggaactcaaagatagcctgacccaaaggtttaaaataaccgcactcatgaagatgacactttagctgatcataaatatttattaaacagaaagagaagcacaatagaaataaatgtaaactgagactagacattgagttctgttttgggaaagtgagtgaggaagcttcacaagggaggaaatactgcttttgggtctgaagatatatttgtcaaacatataccttggtctctactacctgtttcataattttattaattctgctctttatacaggcaggaaatgcctgaaaaacaaagtaatgccacttgctacaacacagtatcttcaccttaaaaattagtgaaatggcgttcttgttcatagatgaatctcctccatatataaacttaatctctatattctcattcacctgcccctttcacttcatgttaccatacttacctgggactatatcacctgcagacagatgactctgatatctaaccatccccagttcaactctctcccaggttcacttgctagacaacaccctttgaagaacatactgccatttgtaaaatacatgctcctttgctactttaggaaacggcaccaccagcttactcctctaacctagaaacaagggagtcacattctattcttcctctttctcatctcccacatcccatccatcttggcctgtccattctacctttctattacactcgcctatacatccctaccactgttgccctgattcagaaccttatttttatcctaacagcctcctcacctctctccaggtctccttgctgccaaagccatctttgtaaaattccagtatgatcgtgtgactgcctcgtttaaaaaccctttaacagacactcaaatctttgacagtctaaactctagcactcaattaagttcccacatttacatacaaaaaaacccttagctcctacagagttaaaatgctttaataattaacgaattaacttgaattaaatttattttcttacctcctgctcagagagcccatcaataatttcagaaatctcatgctcactcctagcaatggtggctgaaagaccagctcccctctgcccaactctaaacatgagggagaaattaaaaatatatttaaagaccttatataaagacatatcaattaaattaactatagattacttttctgaatggaactttttaaccaagttaagagaagaaacataaaatactattgagtatatacttttaagtaatatgctgtgtcacctattaataacaatttaaatgttacgattgagatttgaaggttacatgttcatgttcaaatggtggaactagttagggaaaacttctagaaagtcataattattgatgccaattccatttcaaatggcattctttgtatgccctgtagtagacttagaaaaatacatgaaacatttttaaaaggagagaaaaaactcaaccaacatcccttacaaaaatttaattgtgagttaaggggcttacatgactcttacatgagacaataaaaaagaaaattaaagcttttaaaatctttgtaaaatatctgtttgctaaaagtaaaacaaatcagaatctatcaaagaatttcttaattggccatcagctgaatatagtttgaatatgttggtaacgaaggactaaaggatatttaggtctgttcttactcactgtcatgtccaaaggatgtaatacttttaggaacttcagaattaatttcaaaataatcacttacatttagattcaacaggataatataaaaattaaatttactaagacataatgtttactggttgataataaagttttcttttcaacataaaagttcttttaacttttaagttagtgggtacatgtgcaagtttgttatataggtaaacctgtgtcatggggatttgtcgtacagattatttcatcactctgctattaaacctagtacccactagctatttttcctgaaccctctccctccttccatcctccaccctccaccttctaataggccccagtatgtgttgttccccctatgtgtccacaacataaaaattctttataaactttcttcatgatcagtttcaagaaacaatagctctccctctccctctctctcctctccctctccgcttctcccgctttccacgatctccctctccctctcctcccgctttccacggtctcccctctacctctctccttctcccgctttccacggtctccctctgttgccgaagctggactgtaccaccatgatctcctccctctccccttctcccgctttccacggtctcccctctccctctccctctctccttctcccgctttccaccgtctccctctgttgcggaagctggactgtactgccatgatctccgcttgctgcaacctccctgcctgattctcctgcctcgtgcctgggattgcaggtgcacgccaccacgcctgactggtttttgtattttttggtggagacggggtttcgccgtgttggacgggctggtctccagctcctgaccgcgagtgatctgcccaccttggcctcccaaagtgccaggattgcagacggagtctcgctcactcagtgctcaatgttgcccaggctgcagtgcagtggcgtgatctaggcttgctacaacctccacctcccagccgcctgccttggcctcccaaagtgccgagattgcagcctctgcccggccaccaccccatctgggaagtgaggagcgtctctgcctggacgcccatcgtctgggatgtggggagtgcctctgcctggccgcccagtctgggaagtgaggagcgtctctgcccggccgcccatcgtctgggatgtggggagtgcctcggccccaccgccccgtctgggatgtgaggagcgcctctgcccggccacgaccccgtctgggaactgaggagcgtctctgccccgccgccaccctgtctgggaggtgatgagcgtctctgcccggctgcccagtctgagacgtgaggagcccctctgcccggcagccgccccgtctgggaagtgaggagcgtctccgccccttccgggaggtggggggcagcccccgcccagccagccgcccagtccgggaggtggggggcagcccctgcccagtcagccgccccatccggggggtggggcgcctccacctggccgctgccccgtctgggaggtgtgcccaacagctcattgagagccggccaggatgacgatggcggttttgtcgactagagagggggggaaatgtggcgagagtagagggagatcagattgttactgtgtccgtgtggagggaggtggacatgggagactccattttgttctgtactaagaaaaattcttctgccttgggatgctgttaatctataaccttacccccaaccccgtgctctctgaaacatgtgctgggtccattaagggttaaatggattaagggcagtgcaagatgtgctttcttaaacagatgcttgaaggcagcatgctcgttaagagtcatcaccactccctaatctcaagtacccagggacacaaacactgcagaaggccgcagggtcctctgcctaggaaaaccagagacctttgttcacatgtttatctgctgaccttccctccactattgtcctatgaccctgccaaatccccctctccgagaaacacccaagaatgatcaatacatactaaaaaaatttttaaaaaaaagaaacaataaatatttgaagaaaaatatcacagtcattaaacatcaaactactcaccgctgaaatctttcttgctgttctctttgttttcgaatttctggaaactgcttttcatagtattcccttgttttgctttctttagctttcctccgaggattattttctattctgtccacttttttctcccatgcctccatgagctgatcataacgctggcagattttttgttcctattaaatatccgtagcaaattaataataattaaactaaactctgattctgacaaacctaatactttaaaataaatgctacttcttaaggttaagtcagaagtacatttggcttatgactcaactgtgaacgaaaagcacaaagaggagagaggaaaggtagctctgtttcctactaagatcaacacatagagcacaggttggctggattttttagttaacattaagactatgcatatttataaactacttgacacctactactagtagtagctgaccagttacttttattttgcttaaaacattatgtcattgttgtcccaaaaaaatggaaaattaaaaatacaaacatgtaaatagttcataatctgaccaattacccaaaggcaaccatatgaacattttgttgttatccttccaatctgcgaaacaaaacacacacgctttaaccgatctattattggaggttctggttgattgccattttttgctataataaataatgctatataacaaacattttgacagtatgaaaaaggcagaaaatggttggttgtgctttatcataaaaagaaatccaggctgggcgcagtgactcacacttgtaatcccagcactttgggaggccaaggcaggtggatcacaaggtcaggagtttgagaccagcctggccaatatggtgaaaccccgtctctattaaaaatacaaaaattagccaggcgtggtggtgggcacctgtagtcccagctacttgggaggctgaggcgggagaatcgcttgaacccaggaggtggaggttgcagtgagccgagatcgcaccactgcactccaacctgggcaacagacaaaaacaaaacaaaacaaaaaacagaaatccagtgaactacgtgaaattgagaattaatgcttttagagaagtaagtgaattatgataccattttctaaatagagaagaaaagacagacgaaccctccattatggacaaagaactgtcaacatatctgatgacacatggacagaggaaagtgaggaagggttcatgaaaaactgctaacatggtcatcttaagaaagtggcattggagaacagaatattatctttctcacattccacaccacaccccactcccacttctcaattactcctatatgtcttctgtgtccttcatcttttctcctttctactgctacccttataatccaggccaacaccatccctcacctagatcaaaacaatagctcccatgcattcttaatgttgtagctaaatgcaaattcttttttttttggaaccaagtttcactcttgttgcccaggctggagtgcagtggcgcgatctcgctcactgcaacctccgcctcccgggttcaagttattctcctgcctcagcctcctgagtagctgagtttacaagcatgcgccaccacgcctggctaattttgtatttttagcagagacggagtttctccatgttggtcaggcgggtctcaaactcccgacctcaagtgatctgccctccttggccttccaaagtgctgggattacaggcgtgagccattgcacctgccccgctaaatgcaaactcttaaaatgcaaacccaaacattatgcaacctccaggacagtatacaacctggctctggcttccctcagcagcctcatttctcaccacactgccagctcagtctacactccctctggctcccagaccttcacttaagccactccctctgcgtatacaagtttgcagagaattggttttcccctgaaatgtcccctcataattcctatctgccttaggtgtcctcctcagtcatccgtagtccatgaccacggtgtgatccaatactaggactgacctgtctgacttccatcaccttaggctccccctaattactaaaaccatatggctatcttgctcacctttgcagaataatatatgggacagagtacacagccaagtgatatttaagcaaatcggtgaaaatacaaaccttacagtgtttgcatcaccagtgaacttatttagtgagtaccagaattacaacaaaattacttggaaaggaaaaaaaaatacatgagctaatttcttacttgatatttatatgttcttggcaaaaaaaaaaaaaaaaaaaaaaaaaaacaactcaagaccagtaatttaagacagtatctgatcagactggcaaattagaacattagacgttttccaccaaataaagctgctgactcttgagctttacaactcaaactgtcaggtcattaactttaggcacaaagttcatttttgatgtcgatttaaagagtagcatttatttagcagacacttcagtttaaatgtattaacagtgtatctgtaaaattagtataaacatattatgaaaataaaatcactggcattatattttctataatttaattcccatgaaaattatataaccacaaaacttttggactgcaagtcataaaaaaatatggaaaaccatttgaatttgaaaaagctgaaccctagctgaccccgtttctaataaaagaaagaatagtaatgtctcatcagcatgactgcaacttacctacaactgtttgaggcttaagaaactaaattatctttcatattcttttaaactactcaccgttttattttgactaaatgaaaatgttctagaaagatgaccaatgaaattaatttgataatattaaatgtaaggtatggtatcaaaatgttactagaattagatttaagtcatatatatatatatatatatatatggttactttctaaatcagcacttatcctcaaatggagtcaaggaccactctcattaacagtaggaaagtgaatgcctaaatgagcatgaatgggaaagctgtataaatttcagttaacaaggataggacctcaccctttgttttcttgcatgatttcttcttttaaaaaataaaatgagtttt

SEQ ID NO: 9868 - DNA, 1372 bp, Homo sapiens
tgtaaacctagtttgatatactgaaccattcttttattcctggaataaatgctgtttggtcatcttaatacatctgattattccatttggtaatattttgagtaaaaaattctatagtgaatcctgtttgcttcatggactgagtatagtagcgtatctttttctgtgactagaagttatttatgaaagagaatcatttatgtttgaagaagtaaatatgcctcagtttcaaatggtcctttaagggctctgtataaacgattccaatatatttctcagttgttattaaagtacttgatttttttcttgtctaacttttagcaatttttatattaatatttcaaagaaccatgtttaagtaaattactagcaaaggaactctttgggggaactttatgaaattttctcttggcagttgctaaaagttttcttacgttttctaaaagttcagtaatagtacatttatctttagaaaagtttgcttttcagaaagtgtttccatttttcttgtggtcagaatgtgctgtgaattttaaatgtatttttaagatattatagctaaattgtacctcactgttttctctaaaaagttttactgcttttgcttccactccactattcagtgataacaagggtaacaagtttccactagaattgcttgtcactttattcttgtacttttgttttactactgaacatctttttaaatcgttgccacaaaatatctcgcttttatcattttcacattgctctagtatatcaactttggaaacaagacatcattctatttatagcattctgtttttagtagtggtatttccatttacaaaatacagtaattcttgatcgctgaagacgtcaaatcctagaaaacatagcatgcctacgcgtgatgttaacatcattctcgaatagttgttggttgaagattcatttgatgaatccgatttttcagaaatagacgagtctgatgatacagacgattctggtgttagttctctgtagaaataactccaagaacacttttaatagtttattttcacattgaaaatcagatttgctccagcctcaaagagtatatttatgtaaaattaggtaagcgatatagaagcaagctgcactttttttctaaatgggaaggtattaaaaaagaaaagtctcattttagtaacatagtcttccttaaactctatgccacttgtaagatttctgaaaactgaagacatagaagggaacgggcttgatatgaacgacagctttgctggtaaataaacccaactgaacctaagattatctaaggtaacctctttttctagtcttttattgtgtgaacagttacctcctgctgagttgttggcagaatttccatata

SEQ ID NO: 9869 - DNA, 39567 bp, Homo sapiens; identical to SEQ ID NO: 7088

SEQ ID NO: 9870 - DNA, 654 bp, Homo sapiens; identical to SEQ ID NO: 7089

SEQ ID NO: 9871 - DNA, 511 bp, Homo sapiens; identical to SEQ ID NO: 7090

SEQ ID NO: 9872 - DNA, 9740 bp, Homo sapiens
ttttctgctacaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggtaaggacttcttaagtattttggtttggggcatatgctttaaagccaagtatcttggctttcatatttaaataaacagctggtattatttgtccagatactttcttggtaatttaaatatgtgtttgtcacattttagagctcatctccctgaaggtttatgtcgttgctttacaaaccattaaattacagaactttagcttcctagattaatggcccattttttttatcataatgaagcattagttgacattatctgaattatagttctaaattatttgggctgcataatattatttgttttaaagatttcagagttcaacttatagactctttaagaactcgttactatattcaggcttttaaaatttgtattatatttgctttctttttattagaaaaaagaatgctctttttcatttgttttattctttaagtttttaatgactgtagtggtatttatgcttattgagcagaatgggatgtgggtgtggatataaaaaccttattggatagtgtgttagtgtccagtagtgctctttttctaaatgaataatttttctaaatgaataggtgcaggctagatacataatagcttttgtatgctttcattttcaagtaatttctttagcttaaataatgggctaataaagaaaactagggagaccgtaaatggttatacttttggtctgcatacttatgtttttaccctcaactatatgtcaaatgaatacaagaaaaatcactatttcctaaatgtaaccatttcctctctttaaaagcattcttcacagactgttataatgtagaatatttcaaatacaataaatcctaaagatgatagacggtaactgttctgtggtactgcagataacttcatttcttcagcctttgctaagtgtgtttttagcttaagtagtagtttttttttaatctactatatactatatattttcctatagtgtccacccactgaacctaccaaatcaggaatgtttaaaaagttaaaaataagttatttttggtcatgaccattgcttcttctagttgttattttctgatctttacttttcacagaccttagttgcaacgcagaattataaaggtgttgtcgtttttaaatcatttgatattagcccagaatggtgggagatgagaaatagtttggtaacttctaaaattttttgtccttgggaaggaaaaaaaaaagcacttaaactttaatagtatcatttctaaaattttttattgaactcctacagtgtgtagaagtttcaaaacatgatgaatgtatgttttgcctttaaattgtgtaatcaaaatacatcagaaatatacatcaatattttgagaatatactcaagcagggaccagtgtgatttcaggatataccacactaactgagaatagttaggaaatataattttgttaatggtgctgtagctattccagaatattaaataagaatatgatcagatagtagttttcatattttaaggtatgggtctaccatctgtaaggaactattatgcttttccactttatataaacatttgaagtatggataattcccgtcatgcataatggggcttgaagacatatataaggcttcttatttaatttttcttttgaaatcaaatttatttttctaaagtttaattaccaataaataagtatttccaacagatccttttaaggatgttttccagggtctatacaaacaggattattagcgttttcttaaactattcctacactttgttgttgttgattgagtatgaaaatggccgtatgaccctaaattcttccttccttaactaataagatctacagtcagttctttccaaacccccgcacacactaaagttaagcatgatggggcctttttcttttacaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacgtatgtatctatttaaaatttattttacagttaactgtattctataagctctgtaggagatgtcaaaagaccagaggaacccaacagaagaattttgtccttgagtgaagagtgtatataaacttttgagtgtgctagggtcagtggcatatttatgacctggacctttcccttacaccagaaatggcttgaacttacaccccatgggaacctctttctttctggttctgcgtgcaataaatgcctatgaatgagacacatctgattgattcgtcaactcataaaatgtttttgtttgagcggtcaggaaatgtagaggaggaggggggagtttatgaccagcaataaatttatccttaagtagaaatattagatattggctcatggcattaataaatcatgcctccctagttctttttaggtgtaaacttcctaagtacatttagattcatgtttattaaataaaattattcttaaatcaactgcttttaaaaaggcaaagtgtgtcaaaaaggtaaaatgctaaagaaataactggttagccagtttttctgaccttgtagttaatgatggaacacattcaatgtagccaaaggaaatgtgctaatcattgaataatggagagggcatgagggcacgggttgtgagtagtgacattaaagctgatgaggacataaaacagatgataccctagtcgtaccttttatggaaacatccaaagagctttgataagaaaagtcacttgatcatatggctggattgcccatcgttcttcccttactagaacaagttactgggtgaatacgttcactaaaatgctatgccagagttgcatcaaaactctcgtgcttaaagttttatatttaggaaatattgccaaactacaaaacatggaagtcttcaactccagctactgctttttttaaaattaagaaataagatgccaggcatggtggctcatgcctataattccagcactttgggaggctgaggcaggcagatcacttgaggtcaggagtatgagatcagcctggccaacatggcaaaatcccgtctctactaaaaatacaaaaactagctgggtgttgtggcgcgtgcctgtaatccactactggggaggctgaagcaggaaaattgcttgaacctgggaggcggaggttgcagtgagccaagattgtgccacagcactccggcctgggtgacagagcaagactccatctcaaaaaaaaataaaaaataaaaaaataagagcttaattataaaatatgattaattatgtgcatttatctatgattcccacatatttttaaaagatttaaggaagcataatcaataacttctttccagtgcaaataatagaaaagcaagttgtcttgaaatttgtcttttgctaaagatgtttaccaactttgctcccttttatgtgaacctctaccttacttcccataaaccctaggctcaaaaagtgttacagcatactagttggaaaactgattcattctgctaattattttttatttctaaaaaatctcttaaaagagaagccataaccataaaaactctaggtttctaaatttttacatctttattcaggcactatcaatgtaaattaatattgattttttacttacttttttgttcaaagtaaaaatataaaggagttctgcagcttctgtattttttaaaactaggtgaatattcagtttcaggaatatttaaaaacttacaagacctagcatttctttcattttatatatattgagcttaaatttgaattctctatgttcccttcaatgcccttaaattttcacaaatgaaaagctagtgtgaatataattatccaactctcaaaataaatgttatattatttccttttaaaaatgttacctagtccaggtgtggtggttcatacctgtaatcccagcactttgggaggccgaggctggtggatcgtctaaggtcaggagttcgagaccagcctgaccaacatggtgaaactctgtctcgtctaaaaataccaaaaaaaattagccgggcgtggtggcgcgtgcctgtaatcccagctattcaggaggctgaggcaggagaatcatttgaacccgggaggtggaggttgtagtgagctgagatcgtgccattgcactgcagccagggcaacaagagcgaaactctgtctcaaaaacaaaaacaaaaataaaaacaaaaagttatctagccagccaagttttttttaataagaatttcttcccaattttgacattttaagtgtttgataattagaatgtgtttaattggaagctgaaaaactaagcctatggaccatagaaacacaaataacacatgttgtcactcatgtgggagctaaaaatgttgatctcatggaggtagagagtagaatgatggttatcagaggttggttaacaagtacagaaatacagttagataggataagttctaatattcagtagtacagtagggagactatagttaacaataatttattgtatatttcaaaatagctagagaagaattggaatgttcccaacacaaagaaaagatattcctcagcagcaacatgggaggcctgggttccttccctagcccaaaaagaaacaaaaggaaagataaatgtttcaggtgctggatatcccagttactctgacttgatcattacacattgtatacatgtgtcaaaatatcacaggtaccataaaaatatgtacatgtattatgtatcacatttttaaaatcagttttaaaaaagatggagaggagcagaagctcataataaagtaactgaagaaagaaagaaattatgtctatggaaacaatgtgacacagtttgagcggtcagaattttaagaaatgactttttttttttttttttgtgagacggagtctcactctgtcaccatgctggaatgcagtggcacgatctcagctcactgcaacttctgcctcccaggttcaagcgattctcctgcctcagcctcctgagtagctgggattacaggcgcacgccaccacacgggctaatttttgtattttcagtagagacggggtttcaccatgttggccaggatggcctccatctcttgaccttgtgatctgcccaccttggcctcccaaagtgctgggattacaggcgaaaaaacgcttctaaacattaaacttcagattgcagatagcggggacctagtatgtactctgcatgtgaattataggaggaaggggaatttgtgaaagttttttctaaaccttcaggagatttagatatacataaagacatgctgtctttttatatcattaacattatatttggagaagaaagtggtatgtaaatggaatttttccaagtcaaatactgtgttttaatgcatgatgatagctgagtctataaatctcactacgtgcagggcagtgaagacctagtttttactgctgtcccacttccgagctgtatgccggtcacttcacctggatgagcgtgtgtgtttttcctaaaaacaggagccatgctgtccacctcaccttaacagagaactttgaaaatgagagtggtgactgtcaaaccatttttaaaacaatacataaatgtaagacaaaagaattgttaatacttcagagttaatcattgtgccttaattatgttttataaagttgaattcatcaaattgttttttgttttttgagacggcgtctgcctctgtcgcccaggctgcagtgcagtggcgtgatctcagctcactgcaagctccgcctcctgggttcacgccattctcctgcctcagcctcctgagtagctgggactacaggcgcctgccgccacgcctggctaattttttgtatttttaatagagacggggtttcaccgtgttagccaggatggtctcgatcgcctgacctcatgatccgcctgcctcggcctcccaacgtggtgggattacaggcgtgaaccaccgcgcccggccggccatcaaattattttaaagaagagatataaacaataattatagagagttactcttatgccaagtttcccttttgttgttgtccttactgttgtttggcgtctcttggtttaagttagctgctgaaagcacaagcctgtgtgccagtaccaccttcacaatcacaaatgtcagtcttgggagtgtatgcagaagaatgtattaaatctcagaaaaaaataactaaactcgattgtctgtgtatatatgcataatgctgcaacctgtgaattaatatcctttaacacttgggtccacatttatattctcagtttcattatttatatattagtggctgtgaacagagcaacatgaggtattaaacttgacagaatgatagtacttttttgttaccagagcagcataaagttcttagtgtagatttaaagatggacatgtgaatagtaacagatactattaatttcctgattgcctgaggcccattataagtttgtgttttacttacgcatatataaataataattaaagctaggtgtgatagaactagttaatatttcctgccagcagaggtgtgaagaaagaaaaaagaattatttatcttcgaagcatcttcctcttcttttttgttcccatattacaagtttttatgaacctcaggaaatggatttcctctaaaaacgtgttttttaatagatatcctcattttcttatatcctatcagaattgaaaggaataaaatccatgttttccccgtgtattaataaattacccataatcattgttcaacttttgttttctacccttctagacattttgtgcgtatatgtacacatatgtgagtagtaaatgagcacttaattagaataatagacctttctcattagtatgagttcttttacttcctgtaaacaagcacactaaaaactttaattttttcagatggactgagctgtgtccaatgattgaagccaggaagaatcatgggctggtatttgtaaaagacaagatatttgctgtgggtggtcagaatggtttaggtatgtgatgttaattcactgttccactttcctgatgagtttgctgatacttccttaaattattgaagcatttttaaaaatctagatagaagcatttaccatgtatattattatatctatttttatagtttctgggaattaacatacttgataaaatatcgcaggatgttaaacattcctgtttatgaaatgtcgcagtagtcaccagtcattgtgacaattttagatggctcctatacattcccagatacctcctggggaatgatgtcgcaccagcttaagaactattgagcaatagaaatatttgaactttaaaaaacctttaaaaactttttaaatacaagttttaaggcttgtatccaggtcctaaatggtaaagtttcctaaatatttttaaacattgcatgaaaatatcaatattgtaatttttaaatgactaaatttggcattttgttttcataaataatgtactaaagaatcttaaataattgtcttaaatgaaagggagtcggaactgaatctagacacaagcttcaatttagtcagtactttaagcatcacttaagtgtaccagtaacttcttttccttcttctgtccctgtccattgctattttccataaagtgctaaaaggaggaaaaagaaggacatttgagtaattataatcaaagttaatcagaggggaaatcaccgattggtttattttgcatttttccagaatagataaaacatgtttaattttgtagaaaaaaatcaatatttaaaaagaaatattaaatgtctattgtgttaagagtaagaatttaggtggtggctatgtggacattcactgtaaaattattacagtttttctgtgtgtttgacatttttcacaataaaatattggaaaaatacaaaaagttattactttaagaaaccttagaattgttgatatagtttttcatgttgttcatgttttattcttttgaaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaatag

SEQ ID NO: 9873 - DNA, 2636 bp, Homo sapiens
gttcaacttttgttttctacccttctagacattttgtgcgtatatgtacacatatgtgagtagtaaatgagcacttaattagaataatagacctttctcattagtatgagttcttttacttcctgtaaacaagcacactaaaaactttaattttttcagatggactgagctgtgtccaatgattgaagccaggaagaatcatgggctggtatttgtaaaagacaagatatttgctgtgggtggtcagaatggtttaggtatgtgatgttaattcactgttccactttcctgatgagtttgctgatacttccttaaattattgaagcatttttaaaaatctagatagaagcatttaccatgtatattattatatctatttttatagtttctgggaattaacatacttgataaaatatcgcaggatgttaaacattcctgtttatgaaatgtcgcagtagtcaccagtcattgtgacaattttagatggctcctatacattcccagatacctcctggggaatgatgtcacaccagcttaagaactattgagcaatagaaatatttgaactttaaaaaacctttaaaaactttttaaatacaagttttaaggcttgtatccaggtcctaaatggtaaagtttcctaaatatttttaaacattgcatgaaaatatcaatattgtaatttttaaatgactaaatttggcattttgttttcataaataatgtactaaagaatcttaaataattgtcttaaatgaaagggagtcggaactgaatctagacacaagcttcaatttagtcagtactttaagcatcacttaagtgtaccagtaacttcttttccttcttctgtccctgtccattgctattttccataaagtgctaaaaggaggaaaaagaaggacatttgagtaattataatcaaagttaatcagaggggaaatcaccgattggtttattttgcatttttccagaatagataaaacatgtttaattttgtagaaaaaaatcaatatttaaaaagaaatattaaatgtctattgtgttaagagtaagaatttaggtggtggctatgtggacattcactgtaaaattattacagtttttctgtgtgtttgacatttttcacaataaaatattggaaaaatacaaaaagttattactttaagaaaccttagaattgttgatatagtttttcatgttgttcatgttttattcttttgaaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaggtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaatag

SEQ ID NO: 9874 - DNA, 546 bp, Homo sapiens
ggcatatcacagcagaggcaagaaaggctgactaggaccaaggaaaataggactttatacatggatgtgtccacatgtgtacgtgtgtataatgagagatatatcaaaatttaagaaatccttctacccatatcttttccaggctttccaattttccgcatttcacatctcagcacctaagtataagaacttgcatggaatagatactcagtaaaacttaagtgaattaaatcatatttttagggtaacagctccctgaccctgcccacacacatataccgtcccatctgtgactctactgttatttgtccatcttcttgctaacatgagaactgcatattcctctagatttccctgtagatttccctattgcagggagcaataaatagcactgccttcacctgcaagcccaggttggaactagtttcatcactagggtaatgcccaacagtcatagccactgagctgacaagactgacttcccatctattcttccccaccccaccccccgccaactacatacagtatctaggtactataatcagc

SEQ ID NO: 9875 - DNA, 282 bp, Homo sapiens
aattgttttttgttttttgagacatagtctcactctgtcgcccaggctgcagtgcagtggcgtgatctcagctcactgcaacctccgcctcctgggttcacgccattctcctgcctcagcctcctgagtagctgggactacaggcgcctgccaccacgcctggctaattttttgtatttttaatagagacggggtttcaccgtgttagccaggatggtctcgatcgcctgacctcatgatccgcctgcctcggcctcccaacgtggtgggattacaggcgtg

SEQ ID NO: 9876 - DNA, 5138 bp, Homo sapiens
tgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtca

SEQ ID NO: 9877 - DNA, 5138 bp, Homo sapiens; identical to SEQ ID NO: 9876

SEQ ID NO: 9878 - DNA, 704 bp, Homo sapiens
atgagacgtttatatatatgcagccattttccaaaagaaaagggtagtaatgcagtacaaagtagtggtaatattcctttttaaaaaatttcggtagtcatatagcaacattttgctacataaacactttgggatattctgtggtcacaactaagattgtgtcgggcagctcttttttgcggatgtgtgtgtgtgattttcaacagaggtattaaaggcgagccctaactgttgtctaaaaagattgtacagtatttaagggattttccttttagcttttcatctccagtggcattaaacataaaaagaccctggcattttttcacatacttgaatccctaaatgcacctgtctttcactttttgagacagagtgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggacaatcccttattttttaaaaa

SEQ ID NO: 9879 - DNA, 521 bp, Homo sapiens
aggacagattgctgagttaaagggtattatgcatagtttttaaagcacctttcatgtgctttgccaagttgctctccagaaaaattttatccatatgtaactccatcagcaatgtacggaaaggcctctttcttcacatccttggccagcattggatgttccttttctaaaaagtcttttatcccaatagattttgacaaatcaggtttcttttctgagcattctggtttcacatggcttatgtgctcacccaatgctaccggtttgtttgtttgtttttgtttttgctaaataggagtaactgagtaccctgcatccactgagaaatcttctgcttcctgaaagctctaaggtaaagataattagctgaatgctctgttataacaggatggaaaaagaaatggtggcctcaggtagccaatccactgagtctctccaggtaaaattacactggtttcgacaagttatgttacctttcatagaatgtaattttaaaatgatattagtctgggtgggtagta

SEQ ID NO: 9880 - DNA, 521 bp, Homo sapiens; identical to SEQ ID NO: 9879

SEQ ID NO: 9881 - DNA, 2642 bp, Homo sapiens
gagccaaccgagggcgttcctgtcggggctgcagcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactgggtaagggcaagctcgatgccccgtgccctacggacacgggggtaggtcgctcataccttgccctctgatagagactcaagcgaacctgggtcgcggaccttgggccatcagcgtgcaaactgccccaggacgatctctttgcttctgtcgatggggactgaccctctccacctctgcctgtcagctcaggccaggaggggagggacctgggcggagccccgggtggagacaagaggaaggtgacatcatcttgaagatacaatccagctttacccactcgtgtccaccctggcacacgagacagatgggggagagggtgtttgggctgtatgtctgaggtgacaccagggacaagggcatagaactcaggcatggagcccatcgcttgaagtgggattggaccaggatggaagcgggctccttcagatgctcccatctcacccctggctgcagtgcaggtccttcctttagacctcatttatccattttgctccactggacaggtgctggcagcccaatgccccaaaagggctggggcaggcacctgaaacctgcacttaatctttccccagaagctgagacttgtaaatgtttggccagcatctgagctgggccccaccctgatttagggataggagttgggcaagactcagccctggatccaggccttcccttgatcccctttcctgccaggatttgccaagactcactggagggtcacacccagtacatctacctggaggatccctcctcccaggatttgacctgggaccagttttcatagatcttcagctctgggggagggatccagagtctggatgtcacctgggtgcaactgataacctcccttcctccttcccagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaaggagccctcatatacacacagacacccacagctttgctaaggcaggggctgggtgggcctggtccagtctgcacagagtccccactgtcctgttaagggagtgaagggtgtggaggtgggcctctctctgcctgtgggccttcctgggctcagcagcccccacagtgctgtgtctctgttgcaggtaatgtatgtacagaagaaaaagcggtgagtgtccctgtcccccacccgccctaaccccacacccgttctgaaattcctgctcataggctctgacttttctgtaagatgtccctcagccatcctgatacaagcctgaaatttgttttccctgccccagcctcaggttactcactggggaaagcccctttgtagaatcagggttgtattcttggaggtatagtgtgtcccaaaaggcacccactggaattgcccctgcctgggaaagggaggagacgaggcagccaggtgtttgatgagggttggggggacctcctagctgagtcccctcccctgctccccagggtggaccggctgcgccatcacctgctccccatgtacagctatgacccagctgaggaactgcatgaggctgagcaggagctgctctctgacatgggagaccccaaggtgagcacttgggggccagggggagaatgaggcaaggtgggagtcagccctgttcccagccatactcgtccacactgaaaccagagcctggttctgcttacttgggctgtaactgggtgctgcagactcccagggaacacagcccagccttgtggtgtggtctcctccccgacaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggctaggggttttgatttca

SEQ ID NO: 9882 - DNA, 2642 bp, Homo sapiens; identical to SEQ ID NO: 9881

SEQ ID NO: 9883 - DNA, 283 bp, Homo sapiens
cagcttgttttacagacgttaagacaggcgcagagagggtgggcgtgccagggccctcggtagcccagacctgccgtactctaccagccgagcacagcccgaaggccagggaacaaacacagacggaggccgagtgggcccggagcagggtcttgccgcgaagggcctgggctcaacgttagagcgtggcgcgaccctattctggctgcaacgagaggggtgaatgaagtgggcgccggggacctcccagaatcggagctccagacgcgggcgggccaggggc

SEQ ID NO: 9884 - DNA, 6286 bp, Homo sapiens
agtccagaaaaggatattttttttattcaagtaactgcaaataggaaaccagagagggagccccaggctgggacaaatcatggctacccctccccaacagaacagggggaggaggtggcccctacaccctttatggtcgatttgggcccccttgctcactctgctgcagcatcctaggggcagggccccaccttccctgggactggggtagtcggtcacccagcctgccatgccccagcccctcttccccacaaagagtatcttgggggaggggatcgtgggcagaacaggaggcaatgaggatgaacatttggcgctggtagcagcagcaatgacggatgtcgaagaatggaacattgaacaaaaaacaacacaactgtccagaggtagtttgtgaacagaggaaaaatggaaccagaaccttggggggcagggaggagcaggaggggggttgggagcgggcagggtgagctccttgttattggtgccccatctgaggagggggaaatggctgagtggcggaagcaaagtagggttaggggagcagccccagcccacctcaggtggcggccacagggctcttgggcctcacctggacaataagtgactgcatctccatcaccacaatatgtactcagatcccaggcggagggcaagggggctgtggccacagtgaagagggagtaggggactcacccctcctgccttcctgtaaccgaagggggctgtccaacctagtacggggactagggaagttggggaaggatgaaaagtgagccccacgtggtgacaaagacagtttggctgggggaatcctgggggccagcacccccctccattggccacacctgctgctgccagggcagtggagtagggcgtgccaggatgagatggggcttgggccccttttaaggccaggggaaccctcccaggccccactatgggaagccagagggaacagtgaaggagcagagagggcgcccccaaaccaaaagcccagagagcaatgtccccaccaccaagggagtggggacgcagcaggtgcagggtgcggctaagtgggatgttagccttgtccaggagggcatgtgtgtatgcgtgggtgggcggggggagctgggaactgaggccaggggaaaactgctccccactcagcccatgggagccctgcagcggctggtgtgctgtgtagtgtggtggtgagggcacaggtggaagatgggggtggcggccagaggcggtggtgatggtgggcctggggaaggggtgggggcggtgggagcggagcaaagctgtccagtcccagaaggaagctgctcctccagtgaggagcaggcggcacgcatgggtcactgctcctcctccgaggactcctgcgagatgccctcctcttcctccttctcctgtgaggtgggcagttgttggtgtgagctctggcccggtccccctcttccacccccagaggctggccccacccgctccctgcactccctggctctcctgaagagggatgagtcagggctgagtgtgtgggtgactcagcaacctccacggcccggcttcattcataaaaagaatttaaaaggaggaaaaaaccccacacacatgctgctctcacccagagccaggagccaagcccccttggcccccaggcccagggagggcaggagggcagagctcagggcagcaatgagcttcaggatgtgactgactccctaggggagaagaggaggtgggggaagaggtggctgggggaggaaatgggaaggggtggctggaaggtgcaagagcccgctggtgggtgcaggggaaccaggtccttggcccacaggggcagatgctgtgctgtggtgccctggccctccggggtggccgagggctgaccctaggccggggtggggaggaaggggaagtgtgtgccgccggggctcactcactgggcgggaatgtcgggacaccacacggggctacagcccccgtgccaggcacaaactccaaaacaacttgtttcctgttactcactcttggggcctggccagcagcaccccctaacccccccaccccagcagtggctcagctcaaggaatgacagcttcagggatttgagggggcaggctgggggtaggagagggccaggagctggaaggctggggtgaccctaactgcagtggccccctagaggcagcttcttgactcagcccaccgagcctttccaccagctgtttggggacccagaattggatggtgccctccagtgcagtgtggtgggtcacatcagaactccagcaccgacccctcccagggcccagctccttcgctgtttctcttctgcagaggctcataggaaggacaaaccttccccctatggcttcctttcctcatctctaattgagggggacacaggctagatgacttccaagatctcccctagaagttctgagtattctaggagcaggagagggagggacccccacacacaactagggcagggcagggcagggggatgtggtctgatttatacctgggacccctcacttctcatgggcacagcccaggccaggtaccttcccctctctggacttctgtaaaatctgatgtcccagcaggtcaaggagagcctttccatagggggtgcatagcatcaggtactgtgtactcaacaccctcaactcaaaagagcccaggaggcaagcagcagtctgcttcttcacctaccagttttttgggtctgccccttggtttccttcctggagttgtggtggttttctagagggttagagaaaatatctcctaagtccaaaatgctcatcagtgctcacccgatgcccaatagtgatggggggcagacctacctgcctgttcagggtgacccaacactctcacccaacaggcccacccaagtccagctggcaatgactggccagccacatttgccccctcgacatacacacacgccccctactcccacctccgcccatgactcagaggatatgagtcgtgtcttagaaaaaataaaataaaaaacaaaacaacttttctgaaaggctaatgtcactgtgaatctggcctttgctgcctgtccccaccccttcaggctccagggaaccccaagagaaggtaacattctcagcccagggactggcagggaccctccattctccccactctgcccttctctagatcaggaaagctgtgggacttctgacctgatctccgcagtgtcctgggcaggaccaaccccccagaagtaagaccttagtcatcgccccactctccccagttagcaaagactcactgccatccctgtaccagggaagggggtacacaactgagatgactgagccccttcccagacctccccacagccgtggccatggtgccaacaagaggatcctctgctagtcatccacccaggggtagtcccatctcaagtctcacccgggtcttggcagcacccttgtttttgcttccctttggtcggccccgaggtctcttaggtgttggcacttcgctgggctccttctgtaaagacagagggggtagtcagggacagtcatcacctgtttccaccccctcagaagacacagccctctgcctcctcaacaaggttaagtcagcaagaaccaagaaccacaaaccatccctgacctaggaatcccttcaggatccaaagctccagtttgagcatctttgcaaagtgcctcccacctctccccttgcttccctgcaggtttctaagatgcaaaatgacaagagcccagaagacccctaggaaaggcattctggggacagaaagacagttaggtggctctgcccaagtctcagttctgacacttatcttgggtgggacacttaatgctggagcctcagtttcctcatctataaatggtgaagacttcccttgcagggtgtcatggagattaaatgggtaatgtatggttatctagcactgggccatgatcactgcccaccctctcagatgacctatgctggacacacactccctgcctgcacttgcaaacctggagcccatccaggctgcccccagagaaggggaattatagccggactccagagatccctgccatcattcccactgaaattttaataagccgtagatagaataaaaagctgctgcataatgcatataaggtgtgtggtgaaggcgcgccagctactgtttcctagggggccgcccatggtctgtctataaccagggtccagtaaccctgcacccctcctgacacctcccactgaccatggctaacaggtggggtaggaggggaggctgagggagctaggctaagaggacaaatgaccccaccccaggctctgaattccaacacagcagactcctcacagctcgtgtctccctgggcccaggtcagcacagaccactctccaccgtacggacagggaaaacctgcaggtgaacaacctgtatcatgtttaaggggcagaggtcgaactcaactcctcttacctctctcccagggaagggaagtaactgggcttcaccaacagccacccttcacttgggtgacagctgcctctgtaagaggccaatatggggtcccccccatgcccaaatggccatgctccctagggtgccccacagcgccaggctggcagcctcatccttctatgaggactttgtggggagagcagcaccagggttctgagggtcactgccaccaactccccaacatttttgacttcttgggcttcaatttccatctaaagagccaggggcaatgcccattccagaactactcataactggcctgtgcacaaacaggtgctggcccacgcaggcacccgtttctcacctgggatgaggaagtacaagaatcgaccataagtattcagcaactttacagcaaattgacaaaaatcattttacgtgcactgaatctaatgattaaaaaccctgggcttctatgttcatttttgttcattcgtctttactgcattttaaaattactggtccacagtggattggaaattaagaaaaaggcgagtgttttaagcactggccatgtgacctctggggtgctttaggtttggactgtttgccattggcttcagaatttatcttgaattcctcggcccccggttctctcctggggtctctatagagatctgaccagggttgcaagtggggcaggagtacacacaggtgggaggacacacccacacgcttactgcgcagaatcattctgcaccctccatgcatggtctcgcctgctgaatgaaactccaggcacctccctagccccaaagggtaaaccaagtgaagcaaaggtttggacacccacctgactccctaccagcgctgtcccgggactcaccggaggctgcttgcgcggcctgccccggccccgcttctcagtgccgtccttttcctgcttggaggccaagggctggctggacttcgagctcgactcactcatcttcccttctctaaggagcaggtggaagagtgatggctgggatgctgggagacagaaaagtgcttttagacaaacatctcgcttcagccactttctaccccctcatcacccacaccttcaaggcacactgcagaaaactgtgctcccatgggcccccaggcctcctactctgcccaggatggaggggtctgcccacccccagatgctgccaagggcggggaagggccgttggccctaatcagcttcttatctatctcctgttcagaagggctctttgttgtcctgccttaacaccgccccagtgcagcgtggtggggggggtcccaggaggtacagccagcccagacctagctacatgggtgaggccaccctgggacaaaggtgtggggaggtgagatctgacgtattgccagcatcccctccttctgtagtcaactgctgccctttctctttaagagaaaatccagcctacgcagttcagtgggaaaatggaaagaatgagaccttgcgatctggcagctatggacattgatcccctgcccacctcactgacaatattgcctatctggcaaggtgcaagactcaggaccaaaaagagccaatcacacagccaggggtggtgcccaccaccagctctcttctctgttctcacccagggtaaatccctggagaattcagattggtataattgagggagggaggagatggttgaagctagtgggtgaggtgggggaggaaagtgagcccaaagccaaaggccaccctcctctttccccttacccctcctctgcccaactggagtcagatgggactttgtcagatgggtagggaat

SEQ ID NO: 9885 - DNA, 6492 bp, Homo sapiens
agtccagaaaaggatattttttttattcaagtaactgcaaataggaaaccagagagggagccccaggctgggacaaatcatggctacccctccccaacagaacagggggaggaggtggcccctacaccctttatggtcgatttgggcccccttgctcactctgctgcagcatcctaggggcagggccccaccttccctgggactggggtagtcggtcacccagcctgccatgccccagcccctcttccccacaaagagtatcttgggggaggggatcgtgggcagaacaggaggcaatgaggatgaacatttggcgctggtagcagcagcaatgacggatgtcgaagaatggaacattgaacaaaaaacaacacaactgtccagaggtagtttgtgaacagaggaaaaatggaaccagaaccttggggggcagggaggagcaggaggggggttgggagcgggcagggtgagctccttgttattggtgccccatctgaggagggggaaatggctgagtggcggaagcaaagtagggttaggggagcagccccagcccacctcaggtggcggccacagggctcttgggcctcacctggacaataagtgactgcatctccatcaccacaatatgtactcagatcccaggcggagggcaagggggctgtggccacagtgaagagggagtaggggactcacccctcctgccttcctgtaaccgaagggggctgtccaacctagtacggggactagggaagttggggaaggatgaaaagtgagccccacgtggtgacaaagacagtttggctgggggaatcctgggggccagcacccccctccattggccacacctgctgctgccagggcagtggagtagggcgtgccaggatgagatggggcttgggccccttttaaggccaggggaaccctcccaggccccactatgggaagccagagggaacagtgaaggagcagagagggcgcccccaaaccaaaagcccagagagcaatgtccccaccaccaagggagtggggacgcagcaggtgcagggtgcggctaagtgggatgttagccttgtccaggagggcatgtgtgtatgcgtgggtgggcggggggagctgggaactgaggccaggggaaaactgctccccactcagcccatgggagccctgcagcggctggtgtgctgtgtagtgtggtggtgagggcacaggtggaagatgggggtggcggccagaggcggtggtgatggtgggcctggggaaggggtgggggcggtgggagcggagcaaagctgtccagtcccagaaggaagctgctcctccagtgaggagcaggcggcacgcatgggtcactgctcctcctccgaggactcctgcgagatgccctcctcttcctccttctcctgtgaggtgggcagttgttggtgtgagctctggcccggtccccctcttccacccccagaggctggccccacccgctccctgcactccctggctctcctgaagagggatgagtcagggctgagtgtgtgggtgactcagcaacctccacggcccggcttcattcataaaaagaatttaaaaggaggaaaaaaccccacacacatgctgctctcacccagagccaggagccaagcccccttggcccccaggcccagggagggcaggagggcagagctcagggcagcaatgagcttcaggatgtgactgactccctaggggagaagaggaggtgggggaagaggtggctgtgggaggaaatggtaaggggttgctgaaaggtgcaagagcccgctggtgggtgcaggggaaccaggtccttggcccacaggggcagatgctgtgctgtggtgccctggccctccggggtggccgagggctgaccctaggccggggtgggtagtaaggggaagtgtgtgccgccggggctcactcactgggcgggaatgtcgggacaccacacggggctacagcccccgtgccaggcacaaactccaaaacaacttgtttcctgttactcactcttggggcctggccagcagcaccccctaacccccccaccccagcagtggctcagctcaaggaatgacagcttcagggatttgagggggcaggctgggggtaggagagggccaggagctggaaggctggggtgaccctaactgcagtggccccctagaggcagcttcttgactcagcccaccgagcctttccaccagctgtttggggacccagaattggatggtgccctccagtgcagtgtggtgggtcacatcagaactccagcaccgacccctcccagggcccagctccttcgctgtttctcttctgcagaggctcataggaaggacaaaccttccccctatggcttcctttcctcatctctaattgagggggacacaggctagatgacttccaagatctcccctagaagttctgagtattctaggagcaggagagggagggacccccacacacaactagggcagggcagggcagggggatgtggtctgatttatacctgggacccctcacttctcatgggcacagcccaggccaggtaccttcccctctctggacttctgtaaaatctgatgtcccagcaggtcaaggagagcctttccatagggggtgcatagcatcaggtactgtgtactcaacaccctcaactcaaaagagcccaggaggcaagcagcagtctgcttcttcacctaccagttttttgggtctgccccttggtttccttcctggagttgtggtggttttctagagggttagagaaaatatctcctaagtccaaaatgctcatcagtgctcacccgatgcccaatagtgatggggggcagacctacctgcctgttcagggtgacccaacactctcacccaacaggcccacccaagtccagctggcaatgactggccagccacatttgccccctcgacatacacacacgccccctactcccacctccgcccatgactcagaggatatgagtcgtgtcttagaaaaaataaaataaaaaacaaaacaacttttctgaaaggctaatgtcactgtgaatctggcctttgctgcctgtccccaccccttcaggctccagggaaccccaagagaaggtaacattctcagcccagggactggcagggaccctccattctccccactctgcccttctctagatcaggaaagctgtgggacttctgacctgatctccgcagtgtcctgggcaggaccaaccccccagaagtaagaccttagtcatcgccccactctccccagttagcaaagactcactgccatccctgtaccagggaagggggtacacaactgagatgactgagccccttcccagacctccccacagccgtggccatggtgccaacaagaggatcctctgctagtcatccacccaggggtagtcccatctcaagtctcacccgggtcttggcagcacccttgtttttgcttccctttggtcggccccgaggtctcttaggtgttggcacttcgctgggctccttctgtaaagacagagggggtagtcagggacagtcatcacctgtttccaccccctcagaagacacagccctctgcctcctcaacaaggttaagtcagcaagaaccaagaaccacaaaccatccctgacctaggaatcccttcaggatccaaagctccagtttgagcatctttgcaaagtgcctcccacctctccccttgcttccctgcaggtttctaagatgcaaaatgacaagagcccagaagacccctaggaaaggcattctggggacagaaagacagttaggtggctctgcccaagtctcagttctgacacttatcttgggtgggacacttaatgctggagcctcagtttcctcatctataaatggtgaagacttcccttgcagggtgtcatggagattaaatgggtaatgtatggttatctagcactgggccatgatcactgcccaccctctcagatgacctatgctggacacacactccctgcctgcacttgcaaacctggagcccatccaggctgcccccagagaaggggaattatagccggactccagagatccctgccatcattcccactgaaattttaataagccgtagatagaataaaaagctgctgcataatgcatataaggtgtgtggtgaaggcgcgccagctactgtttcctagggggccgcccatggtctgtctataaccagggtccagtaaccctgcacccctcctgacacctcccactgaccatggctaacaggtggggtaggaggggaggctgagggagctaggctaagaggacaaatgaccccaccccaggctctgaattccaacacagcagactcctcacagctcgtgtctccctgggcccaggtcagcacagaccactctccaccgtacggacagggaaaacctgcaggtgaacaacctgtatcatgtttaaggggcagaggtcgaactcaactcctcttacctctctcccagggaagggaagtaactgggcttcaccaacagccacccttcacttgggtgacagctgcctctgtaagaggccaatatggggtcccccccatgcccaaatggccatgctccctagggtgccccacagcgccaggctggcagcctcatccttctatgaggactttgtggggagagcagcaccagggttctgagggtcactgccaccaactccccaacatttttgacttcttgggcttcaatttccatctaaagagccaggggcaatgcccattccagaactactcataactggcctgtgcacaaacaggtgctggcccacgcaggcacccgtttctcacctgggatgaggaagtacaagaatcgaccataagtattcagcaactttacagcaaattgacaaaaatcattttacgtgcactgaatctaatgattaaaaaccctgggcttctatgttcatttttgttcattcgtctttactgcattttaaaattactggtccacagtggattggaaattaagaaaaaggcgagtgttttaagcactggccatgtgacctctggggtgctttaggtttggactgtttgccattggcttcagaatttatcttgaattcctcggcccccggttctctcctggggtctctatagagatctgaccagggttgcaagtggggcaggagtacacacaggtgggaggacacacccacacgcttactgcgcagaatcattctgcaccctccatgcatggtctcgcctgctgaatgaaactccaggcaccttcctagccccaaagggtaaaccaagtgaagcaaaggtttggacacccacctgactccctaccagcgctgtcccgggactcaccggaggctgcttgcgcggcctgccccggccccgcttctcagtgccgtccttttcctgcttggaggccaagggctggctggacttcgagctcgactcactcatcttcccttctctaaggagcaggtggaagagtgatggctgggatgctgggagacagaaaagtgcttttagacaaacatctcgcttcagccactttctaccccctcatcacccacaccttcaaggcacactgcagaaaactgtgctcccatgggcccccaggcctcctactctgcccaggatggaggggtctgcccacccccagatgctgccaagggcggggaagggccgttggccctaatcagcttcttatctatctcctgttcagaagggctctttgttgtcctgccttaacaccgccccagtgcagcgtggtggggggggtcccaggaggtacagccagcccagacctagctacatgggtgaggccaccctgggacaaaggtgtggggaggtgagatctgacgtattgccagcatcccctccttctgtagtcaactgctgccctttctctttaagagaaaatccagcctacgcagttcagtgggaaaatggaaagaatgagaccttgcgatctggcagctatggacattgatcccctgcccacctcactgacaatattgcctatctggcaaggtgcaagactcaggaccaaaaagagccaatcacacagccaggggtggtgcccaccaccagctctcttctctgttctcacccagggtaaatccctggagaattcagattggtataattgagggagggaggagatggttgaagctagtgggtgaggtgggggaggaaagtgagcccaaagccaaaggccaccctcctctttccccttacccctcctctgcccaactggagtcagatgggactttgtcagatgggtagggaattctccaactgaaatgcaccgcctaacagaccctggctggccctcatcctttaggatgaggtttagggctcatcctaaaaccttcttggtcattttctagcatcttccttcttcttagaggcctgttggggtttaattaaccccatcaattttgagttttcctaaaacttctcattggaaggagggcctgcaacctgtatttgggaa

SEQ ID NO: 9886 - DNA, 283 bp, Homo sapiens; identical to SEQ ID NO: 9883

SEQ ID NO: 9887 - DNA, 15926 bp, Homo sapiens
gcggccgcgtcgccgctgaggatgtcccgaaaggggccgcgagcggaggtgtgtgcggactgcagcgccccgggtaagcgcggcggggccgggggcgggaccgcacagccaggccgccgccgggcgggcgccggggcctggcaagagcgctgtgcggggccggagggctgggcggggcggggggctgcggcctccaggctgggcccccgcctcggccactgcggagctgcgcccttggcgggagggccggcctggggtgcccatgctccctggaggccgtggactagcgaggaaggacgttcccggcgccgcctcccgctcctcggtctgagggaggcgggcagctggctgctcctccacctccatctctgtatccgacggaagcgccagcctggggtggcaggagggccgtggcggaggccgtcagggcttgggaggtgggggcgagtgtggttttatgtcatctcagtgccacccccgcgtcttgcacctgctgctcgcgtggtcggtacgcctgccggggtggtggagggcaaggagcagagggccgggcagatgcgccagtggggcctgaataccgtctcctcaggagcagatgagcggtggctactcccaggactccctgcctcgggttcctaaggctagcgctccttgccgggcctggcgttcagggccagtctagacccgggtgtcttctcgggaggcatccccaggcctgctggtggtgactgggaacagctcggctggaccctgctgttcctgttcaccggtaaggcctgcttgggaaagtgagcttggcatcaagctatcctgggtgcgggcccctccctgtcccctagcccagtctggccagaaatgggtgggaggccgtgccgagattccccgtatcctgctggcttcctggcctgtctcctggctgtatttacatggtggttcccttccttttcctaacagagttaggactgggctggagtgaaaccccccaggcctgctgaggaagtcaggggtaatgatccaagaggctgctcccttctgatgagggaggacagccagtgacggggctctgcagctggcctgggaaggaagctctagcccacatccattctttctttagcaaaggagctatctccctggtaggcccctgggcaggctgcggaggtccgtgaactctagcggggctgtgggcatgattaagagtgagagtatggggtgctggtttgtgggcccataactttcagccaccccttgagcaggcccaggaccccaccggttgagcctcacagatgctctggtggttctgggggtgccaagctagagtatttgggaactatgacttagcagggcttgggcacaaaatactccataggtggttatgaccaaggcctcctaggggcttatcatggtttagagggccctggggttgagggtccatacccctaagaaactgtgactccgttccccgagctgcaggcaggtctggggatggcagggctgaggatgcaccttgccttataaatgtctccccactgttccacaactccgtggggtaagcatggcatggaatgtggaggagagtcttagcaggcgcccaatcgggggagtctggggcttagtgttgcctttgttcccagcttactctgtaatcccaacaagactttcctcactgtggggtcctcagcttcctcaattcagaggcaaagaagttggagtagaaatggtttttggggggctgccatctccgaatctgtggtctgattctggggtggaggggtgaagggcagcaccagcaaggcagttgtcctttgtatgttgcgttgaatgtccgaccacagcctctggatgcccagtgggctcagggaggaatggtgggcatcagatgtgttggattgcccagctcctcctcccaggtcctcatctgtcagaggaatttgtgccccagatgcctcctttcccctgattcacaatagaggtcaggaaggtggtgagaaggtgaggatggtggggtggggaggatgtggacagtcttactcatcagcccacctagcacccagcgaggtgtccagcacatggcaggcactccctgagtgtttggctgcttgttaggaccctggctggctgcttgggactatcccacacctggaccctaggatgctggccctggcatgcagcggcatgtttggtctgggtcctgtggcatctcaggcagagaggcatgagggtacccagcagtccggagtccagatccagtgccagccccatggtgtatcgctccaccccagggtcacaggcttcttttattatgataggagccctgcagtcctaaccacaggagtggggccagggactttttgtgcttggttaatttggggggtcatggaggtcagaggtgagatgcagcctgtccccagagagccccatcctccctctgctcccgggcatgggcacacaggacaagtgtgagtgtgttgctaggcagctggacatgacatggctgctctggcagcttgtgccacctcgtcaggcaccgtatgtgttcctgcctgcctggggagtccaagagaggaagggggcagggagccctggagaatgtgcatcttcccctttccttagccttggcccacctcgccacacgatctcagtcaagggcctctcctcaccccatgggcttctatctcagccttttccactttggcaaccctgggggtgagagtgaaggcctcaagatgcctgtcctgtaggtatctctggtgagcaaggccggggacatgttacgggacaagctacaggctgatttgtctcttcatagtgtagattgcagagtgggacaaatgttgggctcctcttcctcccttatggaggtagaatttgtgtgtgtcaatgcctgcacctgagtgttcatcctgatgggcttttacatgtgtgtatacccatgtaactactgctctgatcatgttatagaataagggtatccaatctttttgcttccctgggccacattggaagaagaattttcttgggccacacctaaaatacgctaacactaatgatagctggtgagctaaataaaacaagcaaaaataaaaataaaaaataaagtcacaaaaaagtctcataatgttttaagaaagtttatgaatttgtgttgggccacattcaaagctgcctgggccgcatatggactgcaggttagacaagcatgttatagaacatttccatcaccttagggggcttccaagtaccccctcccagtccgtgcaccccagaggtaaccaccattctgactctaccccaaggactactctcgcctgccttcatgatgtgggcttttcccttagtctagtggagatctggcccttagctcaggggagggaggcctgaggctagcctgtatgtgcaaacctactggccctggaggccactgatggcttcaggtggtggcaggaattcaccgtagtagaggcctccatggggttggcactggttaacgtgatcccaggatcacgcctgctacctctccacacatacagacccataccctgccggtggagccagaagcgcagggggagggctgacgagttcccttacagttcctgtcctttccgtcccaggtttggtccaaggagcttcttgacgcaaggatcccttcaccttaaactacaatctgggtagtcccaagggcacttgcacagagggaggagacagaatggttagggtgggcgtcccatctgtgtcatccagaaatgagctgacaccaatagcggctgcccagaccaggacagtgtcctttgcctaccattcttctcaggtcacctggaggagaaggagaacccctcccccaggctgggggaaagtgccaggcaaacccttggaccacactcctgcatcctggtcttggttactgccatagccagggtcactcaccacatctggtctgcccatggcttagggctctggagccattggccgtggatatatagtcagccttccatgcctggcttctcctgtaggaccacagacctcagatcagcccatttatgatcctgccctgggcggctccccacttacaggaaaccccaccaagaggaatttgggctgcatcatttccggcttcctgcctgggctgctggaggtggctggctggcagccccctgacccagtggtgtttggagtggggagagggaggtctccacacctggggtgcctcactatttgggtaaagccagcccagaagtgcatgctagggctccccctcttggcgaagaaggctggtcccttcctcctgagccctggagtcagccccccaggaaggtgttggcggtcaccttgggcatccctctgttgccctgattgggagggggtcccttaaaaagcctaaacccgctgcactccagcctgggcgacagagcgagactccgtctcaaaaaaaaaaaaaaaaaaaaagcctaaacccaaagacaggcctctctcctttacttcctgttttcatgcctcagtgggggtcacttgctgtgggcagagctcaggctgggcccctgactcagagtctcctcaattttcctgggaactttggtggaagtccttagaggggaaaggcctgagaattgccttctagttgggagagattcttatccccctaagcctgtccctcccctgatggggatacttctgaacaccctgagcgctacagggcaaggcagagagccagtcccccacccccaccccaggacagggtttcctgagacagggtgggggccgctgggcagagcaaagtgtcctgggagagaggcgccctgcccccactctcaggcggcacacaatggctgctttctcccccgtgacctttccgcagcctgagtcgtatgcagctgtctcccaaggggcctaggatgggtggcatctcctccacccttgagaagaaccccggaactcccacccagtcctggccctgcttcttctcccaagttcacttttcccaaaagagtggagagcaggctatagaggcagagggacagcagcaagtgtggacatggcatggtctcaggcatgaaagtgccacatcctggcaattctactcattagcctcgcatccttgaataagccctttaacctctctgagccactgtttcttcatcacagaggcagcatgtcctaccttgcctgacagttgcaagcagcatcacacataatgtacccagctggtacctagtgggtgcccagtcaagcccagctcctttgctctgtccatcttccttaagagggctccagcttacaccctcagtgatgatggcaggaggctccagcatgaaaggacctcacctgctggcaggaggccagaggcaggacctgtggacgggtgtgatctgtcaggcatgtttcaacagcatctggcatgcagcagcatctgggttgcatccccttggggatcccttcctcccttcgggacgggctggggcagagacctcgtttcctgggaaaaggctgagagactggtagcagtggctgcagggcaggaaactgtgcctgctgaatgggccctggggactgcatatcccagaggggtaaggatgtaggaaagggcatggctctgtcagcccccagctgtgagctcttggggagatccctcactggtaacctggccgtagtgatggtcccagctcctaggctgttggagactgagtgagtgaatgtgtggagagtactaggcttggcacgggccagagcaggtgctcaggaggtctggcccatcatctggctccggctgacccttgccctcaccctggcagaccctggctgggcatccatcagcaggggtgtgctggtgtgtgacgagtgctgcagcgtgcaccggagcctgggacgccacatctccattgtcaagcaccttcgccacagcgcctggcctcccacgctgctgcaggtacagggctcagtcgggtggttcttccttcccctcaggcagagtgtgctgagcatgagggcgtttccccctcacccacatacacccccatctggaatctgcagcttccaaggggcagcacccccctagggcagaggctaatcctgaccctttcctcccatctactcacttcatgcagaagagtagctcacacccctgctctgccacttatcaacgtggtcgtgtagcattgagcaagttgcttcacctctctgagccttggcacactcatgggatctgtgtctttgggcagctggactagatggaggtgtggtggtgcgggcacacagtaggcccccttggtaccgtttccagctacgccagccacagcaggcgctcaggaagtgtttcccccattgcttagcacgcagtgggcactctctcacttggcatctcttccctgcagatggtgcacacgcttgccagcaacggggccaactccatctgggagcactccctgctggaccccgcacaagtgcagagcggccggcgtaaagccaacccccaagacaaagtccagtgagtggggctggaggggtggtgggcagagactgcgcagtccgggacagggccctgggaggtggcaaggtgaccaccctctcccaccatgctccccattcctcctgtgtgccccatgcagccccatcaagtcagagttcatcagggccaagtaccagatgctggcatttgtgcacaagcttccctgccgggacgatgatggagtcaccgccaaagacctcagcaaggtttgaggggccctacaacagatgggtggccccctcctcttcttcccatccacgactctctgaaggcctctcctttgtccccactgagccctgggccccaaaggcagccaggtcagggtaacagtagacagggtggagagagcagattgttgggtcaggccgtgtgtggctgaggctccccagcaaccaagtagacacacaaggctagaagcccacagctgccactcagaagctgggaaaacctgggggtagttgcttagccactcatagcctcagtttactcatctgtaaaatgggaaagaaataacagcatctacttcataaatagtatctaagcagggcacacagcacacgtggtagatggtgactgacggcagcgtttattaattggcattaacccctagcgggaagcctctgtcctcccgacatagtctggtttgggcaggcctccttggagctgctaggtgtcccaggggcagccagggtgcagcttgtgggtggggaggtgcgcctcacgcacatgcgtattcactgcacactctgctcctcttagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggtgagggtcggctgaagggtgcagtgtgggtgggtgggggtgtgggtgagggctgctgctgcaggtctgagccataccccctcctcacaggcaggcggggcaccatgagctggcggaaaggctggttgagtgccaatatgagctcactgaccggctggccttctacctctgtggacgcaagccgggtgagcagagcttggggggcgcctggctgtgacaggcctggctggggctgggcaggtgggacctggacgcacccggcagcaggtgccatggtgacagagcggctggggagcaatgttgctaggcaactggctcctgtgaaattactgcaggctctgggccatagcatcgctggggctagggagtgggggtgggcatcctgcatcctcccacgagctcccagcattcttgggggtggcctgccctccccactttcccctgacacttctgggtgccagccctgctcatggcagtgaggtgggctcccagctgctgaggccacccagcactagtgagtgacttggcatttttatttttgttcagatcacaagaatgggcattacatcatcccacagatggctgacaggtgagtgcccacctgatgcccctttccagaggctgttggatgccatgtgggtggctgacccccagagctcccagcccaggtttcagaggcctaggaccctgctccctccccccagagactagaggcacagcttagtcctcagtccctaatgctgggccccaaggcaggtaaaaaatgtcagctccatatgtggcccgcatagcctgagccccgtgactgtcaagtacatggagggcttgggtgtgagaagctacctgtgggccgggcgcggtggctcacgcctgtaatcccagcactttgggaggccgaggcgggcggatcacctgaggtcgggagttcaagactagcctggccaacatggagaaaccccgtctctaccaaaaatacaaaattagccaggcgtggtggcgcatgcctgtatctcagctactcgggaggctgagacaggagaatcgcttgaacacaggaggtagaggttgcggtgagccgagagcacgccattgcactccagcctgagcaacaagagcaaaactccaaactccgtctcaaaaaaaaaaaaaagaaaaagaaacagaagctacctccggctgggagggtgggccactgggttctgtcccagtggcaccgaccccactgtctttagagaagcctctgctcttcgctgaaaagatgggtgggcttcagggatgtgactaactttgtgactgctggctaggcctctagcgtgctcagaattaggcacgtgcgctgaggctggttgaatgaggtgtttctgcttccgtctgagaggcagtgtgggacaccccctgccactcacccagcacataagatggatgctggtgccacctggtggccacctctgatggccacgtcctcatgccaggctgtgcctgctggcctggatctggagagaggaggtgctctcctccccaagggcctgtgtgggcagatgggcataaccaggcctgggcgactcagatcctaaacccagacctcttccagaccccaaggctcctacttctatggtctgattctacctgggctgtgtgtgcatgcgtgcatgtgtatggtaaatacacccaaatatgggctccattcaacagcacattaactgagcaccttcccggagccagctactgctcttggcactgggagcacagaggcagctgagacacaatccctgcccttaaggagctcacaatctagctggggaggcagcctagccaggtgattctagtcctcatgggggagtgcagcaagagaggcagaggcatggagggtagaaatgctgcatgggaatggaggcagcccccgggctggagcacagcatgggaggcagggaaccctacaagcaagactgggatagagacgagctggagaatgagcagccccgagagcatcagcaggagcagtgaccatcccgagagcggagagttccaggcacagaagtgtgaagtcatctctgctgcttactggctgtgtgacttgcaggctgcttgacctctctgagccttggttatctctcctggaaatggagatgacagcatctatttttcagggaggagaggattagataagaatgtatgcaaaatgtttagcctttttttttttttaagagttggggtctcgctctgttgcccaggctggagtgcggtggcttgatcatagcttaccacagcctcaaacgatcctcctaccatagcctcttgagtagctgggactacaggcacatgccaccgtgctcagctaatttttaaattgcttttgtatctctgtgttgcccaggctggtctccacctcctggcctcaagcgaacctcccaccttggcctcccaaagtgctaggattacaggtgtgagccactgtgcccgtccctagggtattctgatgaagtatgtttggagtgtgccatatgcacctgttatcactgcagtgccttaaggcaaggggtagtgcagccaggtgtatccaaaaaatcaccctggctgctgggtggaacaggattgtagggacaaaactagaaggagggagattaagaaacttacaaagcccaggcaacaggtgattgaggaacctggggagcttcactaggactggagggtgagggaggcttcaggtgactgccaggtggctgacactggtggtggacaaacaggtcactgagaggaagagcaagccagaggaggaggggtgggggacgcggtgagatgaattcagctttgtcccttctgggccgggtgtgcgtggagatgggtctgggcctgatgtgaaaaggcgtgtgctgccctgctcctgggtaactgccgcctctgtcctgttcttccctctgctgccttcctctggacttagatctcggcaaaagtgcatgtctcagaggtatatggtgcctgccggggcagcaggcctgaaggtggggtagggcggggaggcatttggtgtgcagcatctggggtgccatctccccgggatccctgcatgttggggaggttgctggcatgggcctggccacctctcaggtctctcctctcctcccaattcccatctccctctgccctcagccttgacttatccgaattggccaaagctgctaagaagaagctgcaggcggtaagtctgctccaacagtgccctgacacttgaagctggcccctctctgatcccccaccctctgctcttgcttcccctgcctctgactcgatgaccttttccaagtctttgacctgtcccctcactggcctcagcagtcccctctccctgacctccctacaaggggatggactggtcccttctctcccaccttggagtttggaacatgatccctttccactttcccattctgagactgtaggggctgggcagcacaaggaaggccaccggttccccaaggctcacaacatgctggggagctggccttggcactgggagccgatgcatctgacaacatctgggcccctctcttcctccagctcagcaaccggctttttgaggaactcgccatggacgtgtatgacgaggtggatcgaagagaaaatgatgcaggtgagtcagggagcaggagtgtctggcgtggaggacccgagcggcccaggcatgggtctctggtcctttactgggctaagaaggggtgcctggggttggggctgctcagaggcctgcagatgagcccctgctggctgtgagcctgcctgggcagcatcccaggctgggtagagtgctgagggggaggcggctagcgtgctcctcccccagcctcagactggggctcctcttgctctggcagcctcccactttggctgtctccctggtaccgctccacccccctgcatcactccttcctggccacagccggattccagcccaaactctgggtctggatgagtggcactggccttgttccatttgtctgtccccagccggccacgcccagccttgccctggcccggcctagctctgcgtgcccaaagaccacccctgttctgaacaccagtgctcagtaggcgtgggggcagctaggaaggctgggctcagtgcttccccacccccaccttgggggcctggccaccgtggctgatctgctcctgtccgtcccctacagtgtggctggctacccaaaaccacagcactctggtgacagagcgcagtgccgtgcccttcctgcctgttaacccggaatactcagccacgcggaatcaggtgagggggctggattgggggcctggggtggtctacttcatccccgcggtccctcctcatccggcagtgggctggggcctgagccagctctccagcatttgccagggcctccctcagggcacagctggcactgggatttgggaaggtcaggaggctgttgttttgagcacttggggagcagctccggtgggtgttccggcctctgctcaggcaccctactctatcataccctgccacgggtggccttggctgctgactagccaggtgaagctaggctgggacgctttagctggggttaaattaaatggcagagccatgccttgctacttggtccctgccgccctgcgtcagtcataaggggtcccctgaagccagcctggccctttctgccttgcaggggcgacaaaagctggcccgctttaatgcccgagagtttgccaccttgatcatcgacattctcagtgaggccaagcggagacagcagggcaagagcctgagcagccccacaggtgggagggttgtgtgggagggtgtgggaagcaggcggggctccaggggtctttcctgcatggctctccctgccagtggtgacctgagagatgggttgtgtggtggagtgtggcctgagtgacactcctgtgtcctcagacaacctcgagctgtctctgcggagccagagtgacctcgacgaccaacacgactacgacagcgtggcctctgacgaggacacagaccaggagcccctgcgcagcaccggcgccactcggagcaaccgggcccgggtctgagtcccaccctccttcccactcccctgtgccctgacccaggccttcgctgaggcccagctctgtcctcttgtagcccaggggcctgagggacaggtgggctgctcctagcctcaataactgccccctgcgggtgttggcctccctgcccccaggtgctgaccagcttaggtctctctctgcagagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagaggtgagggtgcagcctcggtgggagggggagccccaggactccagggggttgacagcactttgcacccatagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgtgagtcacctatgggtctcaaggtgtggggagatgggtggggctgccgcagggtccaccatgacgctcgctgtgctaacatccccaggagctagaggacgacgccatctattcagtgcacgtccctgctggcctttaccgggtaagcctggggaaggcgtgtccatcttagccagtaggttctgagccccagggggttctgggctctgtgctgaattcggggcttaagatgattagactgacctggtccctgctgcactgctggtgagcaggggggcagtggggcacactgactccatccagcgctgccctgggtttcagatccggaaaggggtgtctgcctcagctgtgcccttcactccctcctccccgctgctgtcctgctcccaggagggaagccgccacacggtaatgtttccatgcccagtgcccacagggtggctgggggccgtgtgggctaggggcagtgtgggtccaggaacacggcgctcacagccccttccctccgccctccagagcaagctttcccgccacggcagtggagccgacagtgactatgagaacacgcaaagtggggacccactgctggggtgaggctccctgggtctccagtccagcctgctcacatgccgaggcggggaggttgagagggcccccagtgtgtgaggaccaaggcgggcggctccgaggctggaacgtgtctttctctatatgtatctttgtctctgttttctggacctgggcctcaggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacaggtactgagtggagggggaggtgagggggatgcagttcctgttggcttctagggtgttgcagagagcatgaggggccctgggttctgctgtccctgggaacttcccttgagagccccctgctttatagcctcccttctccccgcagcttcgtgccctgctcagagaagatccatttggctgtgaccgagatggcctccctcttcccaaaggtacaggggccaaagagaggaccaggagtgggagggcctcgagctggggcaggcgtggagaatcccatctgatcgctacctgggtggagacacagacaaactgggccctgatctcagctggcggcttaaagtccaaggtccagcctcactcctgccccctccagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggttgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 9888 - DNA, 1522 bp, Homo sapiens
tccagagtctactaaaaataatttaattagaaacggagttttggcaagggaggcagaagcggctccttttctccccttggccgcccactcagcaaccaacaaggaggaaagcccccgcagtgctcggccagtgccgcgccatcgccaccagggagcgccccgcgcgcggtccacgtggcagaggtcgcggcctcgcggcgcggggaggagccgcacgccacagtggcaggtcccaggccgtcactccgagctctcgccttccgggccgctgtccggcgtgggcgggaggaggggtctccggcgcgagcgcttgacccggcgcgagggctgcagcagcctccgcttcagcacagctgtgggccgggcgccgagcagtcaagggcgggagggcagggaagctacggggggcggcgggcgacgcgaggtggggcgggggcctcgggtagggtagggagggaactcctcaccagccactgtgtcctggctgtccgctgtgggcccccagtagatgctctccccgcgtcggaagtttctgtgcagccgtgtgcagagcgtggccagggtgagcagcaccagcaggaaggtcagggccatggcagcccaggcggcctcttcagtgcgtggggtggggccccgggctgcccgtggaggcgctgctgcgcgaggggccggggaagcctgacttgaacagacacagccccctgggctgccttgcccgttgggcacctgagcctctgtcctggagctggcattgcctccaggcgcccccggcagcagggagacagtgggcacagatggggcattactctccctaccagggattcccgccatggactgcttggccttcaagctccctggggaagcagagggaaacctcagggctgagcgagtgggctggggaccaagggcagcccgcagcctccgcctcttggcaccactagaagagggctgcctgggcccttgagatgtcacctctgtgccagggggccgccagctccgcagagcaaaggccagagccagggcctaaggagaggagagagagcaatcaccctgctgcccctctcagagaacccgagggccaacaagcctgggcccagcgtctctcacctgcacacaccctcttcggcacagcctccctctaccgggagttggctcggagggagcaggccctgaaaggctttcacagtagatccatgccttcttcttcctctgcttcctcctccgcctcctcatcagccagtgggcagcccaggctggctctacccaggccatctccagcgccagcccccatgcagtcagcaccaggggctacgagaggaggtaactgttagagctacgaggaaggtggggacaagcaagaggaaacccttgaattttccattccctgcacacggggccatagccttctgccagggccaggcaagcgcctttcatcagctacatacccgatcctgcgtgaggctgaagtcaggggtgagggaagggttagccatacaagcataggccaggagggcaagctgga

SEQ ID NO: 9889 - DNA, 446 bp, Homo sapiens
tttaaggtgcaattataaataaagcccatggatcgcgatttcaaacaaacttgtcaatctgggccgcagcaaaaggcgatggaggcagctttgcatgtatttcgggtggtgtgactcatgagcattacttgtctcccctagggaaggagcctgcccacccacaaatcactgccgctctggcaccgctgggataatcgaccaacttgagcacccctgccaaaggactgcccccatcttaacaagcaggagtctctgactcttggagaacccctcctcaattgtcaccactgacctggcccccaggtctggccctggggacctctaccctctccccacaagcagagtgcccgggccttttgctgctgcagggattgggggttgggtacacgcgcggcacacgcgtatgggggcgcatgctcagtgcgggggctgcgctcatgtgcggc

SEQ ID NO: 9890 - DNA, 7025 bp, Homo sapiens
ggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaaggtgactaactgaacgctagcttactagctttaaactgcttaccaaaaatactgtatctttttcaattgtatttgatgttataataaaaccaatataattataaatagtgtgtttttagtaaatcttctctaatgagtctgatcctctggtttttttttaattacatagttttattcaggcttgtaatcaggcctgagatgaataggtgaatgatgaatagtgttgttggttttgttgttttttttttggatactgggtctcactttttcacccaagctggaatacaagtggcacaaacatggctcactgcagtctcaacctcctagactcaggcagtcctcttgcctcagcctcaacctcctgtgtagctgggaccacaagcatgcacaccacacctggctaatattttttagagatggggtctcaccatattgtccaggcggatttcaaactcctgggctcaagcagtcctcccaccttgacctcccaaagtggctgggattacaggcatgaaccaccatgccctgataatttttttttaaagataacctccttttttgtgtgtttttaattttactagatttaaaaaaagaaaaaaaaaacactaaaggtcctttgtgatttttattaccctagatgtgctttctagaaaaagaaacttttggtaattcaaggagtgttgtggccaaaaattgtaatatctatgaagacacagaaactacatttatacttctcattcagtaaagctatgtgttttttctgtttagtacaaacagccaattttgtagttgtatctgactattgatatgagcctattgaatatcctagtgttctcataaataattagaaactgctattatagagggttaaaaatgtaatttttgcagttcagtttggccacagaatctcttgcatattcgtgaaaatagtgtggatggaatttcataaacttttatttaaactgagttgttgctttatgtcattctgtaaaatattttcttttcccatttgctttattttttagaagaaaatggtgtatttattaaaactacagatgacaccacaacagataattacattgcacaaggtatgtatgcatatatgtgtgtacatatgtacatatcaggtcaaaaaggcatatagcaaaagggtaggaagagaagagattgccatggtagcctacttaaaaatacatttcatattatatgacaacaaaactgtagtaaaacttgtttatcagcattcacacataggaaatttctgttaacatatgctttgttcacatctgtaatatatggttatccctttgaacgaactgtatgatcttgaaccatgtgaataaaataagatcaaattatatatgataaagttatatataattttatagttaagataaaattttattctaattcttttaaaaattgctcattaatatatgatttatagcaattccatttaagtaaccagaagacctcattcttcagccaaaagaatttattatatggcctttcatataatttaggatatgtgcatactttaaatctagctgtggtagacactaaattcatattaaaggatgttaagatttaaaatatcagtgccctaatgtctaaggttttgttttgctttttaaaaaactttagattctagatgtgttttttgagtacagatgaaaagaagactgtagagtgttaagtttgaaagagcagtggcctttagttatcagctgtaattttttattagttgctcagcagtttaatgttgaccttcaaagacaaggaaacttaaatttcttttaatagtatatagtttaaataactactgcatactctttgcaacagccatgttcatttggcatcttcaactaatttgataacttaaattgatacattctacctaatttctctgttggagggaagacaaagaagcattatgatacactataaagaatattagatttgctgggcatagtggctcatgcctataatcccagcattttgggaggccaagttgggtagatcacttgaggtcaggagttcaagaccagcctggccaacatggtgaaaccccgtctctacgaaaaacacaaaaattagccaggtgtgtcagtgcaagcctgtaataccagctacttgagaggctgaggtgggagaattgcctgaacccaggaggcagaggctgcagttagccaagattgcaccactgcactccagcctgggtgacagatcgagactgtctcaaaaaaaaaaaaaaaaaaaaaattagatttaagagtattatcctatgcaggcgttgttatataaactcagccaggtccctcccattcagcaaaattatcttaaatcctttttagaataaagtaaaacataaataagctttaaaaatattttcaaaagccaagagcacagtagcacacacctgtaatctcagctactcaggaggctgaagtgggaggatagtgtaaggattgtgtgagcctgggcaacacagccaaactccatctcaaaaaaaaaatttgtttttaatctgtgagcctttctcataagtaaattaaggaaattagactaatttttgtgggctcttctataacttttaaattatatggttattctaagaccattggtcaacacataaaatcttaaaatgatagtactatgcaaacccaaaggaaaataattcattctgtcaaagatacgttatatgttcattgcagtgctattcacagtagcaaagacagaatcaacctaggtgcccatcatcaatggactggataaagaaaatgaacatatgtactaaggaatactatgcagccataagaaagaacaaaatcatgctctttgcagcaacatggatggcactctaggccgttatcctaataaaactaatgcaagaacagaaaaccaaagccccatgttctaacttacaagtgggagctaaactttgggtactcacagacatcagatgggaataatagacactggggactactagatgggggagggatgggatgtggcctgggctgaagaaccacctgttgggtactatgcccactgcatgggtgctggggttgttaggaccccaaaccccagcattacacaatatacccacgtaacaaacctacacatataccctttaatcgataaagaaagttgaaattattttttaaaaaagaagaaattaccaggccaaaaaaaaaaatctatatactgctgatgatactcactattaacgtattacatcagattttttgcctcagatgctcctagaacttgtactaaatctggatatctatcctttgactaggtgcctcattagatttcatgcagtttcaaattttagatttcaaattataattctgatttgatggatggatcccaggttgtcctttttgctttatgtttttatgtaaagaggcaacagttcagcaataatttatatttattttgaatgtaatttatttttatgtatcaactttgccttttcaatacttttttttttttaagagacagggtctcactgtgttgctcaggctagactcaaactcctaggctcaagccatcctgccacctcagcctcccaagtagctgggacttgggtcccagttacacaggtgtacgctactgctcctggcagcttctgaatattttgcttaagcagatgttaattactttccctgaagagataagatttgaccataacgttcatatataaataatcaagggttgaacaccaggcaaaatctcattatagtattggatatctcagttgttttcatgttgtgatttttggaaggatacagttctagaatcttagctggcctcctttcactcaaaatgaaaaaactaagtgctgtgatgagaaataggcaatgagatcataacattgaccttatgtcagtttctgtgtccaaactctcaagactttgtgttgtttttctttgttttgtgattactaaagacccactgtgtatccaatactgatcactcagtagaaatacaggtataaaaatgaaagacattgtccttaggaacttagaatataacttggggagaaaggacttacacacattaaggaactataagaaaagaaaaaaaaatgacaacttaatcaaactctgagtagtgtagtgtagtattaacaacaatgaaatgtatgaagtgactagccccagattgacagatggcttcctacaggagacgaaatagagtgtggcttgaagttgaagaaggtagaaaggaagttctgattcagcagtttaatatgaaaattacataagtgaaggaccgtgaaaatagaataaattataagaattaagattggatagtcaggttgaaataatgtgtcaggatttatacttgagataaatatatagttataaaagtatttggcttgtaatttttaagagcatgctaactttgtatgtgtatgttgcaggaaagagaaaaagtaatgaaatgatcacaaatttaggcaagaagcaaaagactgatgtcagtactgaacatcctcccttttattacaacattcacagacacagcattaaaggaatgaatatgccaaagtaagacacccagtgaatgacaaagtatatatattttatattttaataatattgtgatttaaataaaaatacaagaacctgattattttttctttcctttcctttttgcaggttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacaatgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaacgagttaagga

SEQ ID NO: 9891 - DNA, 443 bp, Homo sapiens
gagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaa

SEQ ID NO: 9892 - DNA, 38855 bp, Homo sapiens
ggaaagggaagcggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcagtaagtgcagaaggcccagatctttctgctgcagaagagagaaagtgcgccttgctgggaagtaggggaggcccttcaccgggatggtttttatggggcaaggcaggtttaggaaaatggtggggaggaaagaggggcccgtgtagcggctaaagcagggttacagaatgggagacggcatcttcataagcctcgaggatgtcacggtgagggatatgcggagagcaggaatgctgcagatagaaggaaataatgaggttaagggctttttcttaaaagggagtctttttaaggtacaaaaataggaagttacacataatttggtagtttcccgcagtccagtctgccatggttaactaagttctttcaaatgtgacatagtaaccgaggcaacctgtttacggtagtagatcctagctgccaacatttctaaaccattactgtcaactagcttttctgcttcgacagccacaaggagatgagtttttctcatttcagttttcttttcccccgctagcagcttgcctccgaaaagattttgaggctgagtagtagtttaggaaagagtcgactaaatttacggatgttttcccccatacataaataccaattgagttttgtactccattccatcagaaatagactgttgagaattaatggcccatattattgtgcttctgaatgtgcctgcatgttttctaagtggtggtttattggaccatataggaatttaaaagactgatgagtaacactttcttaaggatcttctaacattttaaaatgtaaggtctaagaaagacataatttaagttcttttaacatttagtttgtggtcataagttgacctttatgtgctttctgaattggaacttaaaataatctttaattcattattttttctacttctaggccagttttgagtttaatatttataaaaggttagatagttatagataggattattttgcagttttgaaacaacatacaaattgttatagatttcagagtagggctaatcacaggaaagacaaaagtcagaatgcttcaggtaagccccttctcattatataagatcagagcttgtaggtacaaaataaggccagttgtttcttcaactacagtgggtagggatcggggaggcatggggagctgagagggttccaccctcctaagtagcctcctacctcacttcgaagttgtatttgtttatattagtcagaagtggttcagcagctttgggaaatgcatgcattctctacctcctcaccatcaaaaatatgttaaacatagaaaagacttatctatatattccaaaatttacaaatatgtaatttgaagaaggtatactatatgggaaactgaaaatgcattagtaggacaaatatgtaatgattgagaagtctgaaatgcattagaactaatacatatattaatcacattttaaacattatttttagttgatctagttagtcctttgaaatcagtcataactaggtaagatgaagatagcctatctgaaatagaattgaaaattgaggaaaaagtaatagaataagttgtaaaagaccctcctagcatcttggagacatctaatttaacaagaagtttgcctgttgacttctggattaatagtgtgttacaaaaagcagattgagtattttgcatacagattgtctgatacgcactatcttaaaccagaaggtgatttcagagatgtttataggcatatcatgcatttttaaacagatcttcaagagtttcttcagtagtagaccacaggatttttagttttctaacttaaccaagctcctttctcttattttgtgctatttaatagaataatttcaataggcacgtctttattgattgctgtttatcttgttttacatacacagatctttgaactctggaaccaaaagcctttatggttacaaattagataggttagtttgtacacatggattcatttctggaatattgctgtctgacctagcaaaagatttttatgaaacatgaagaagttttacctgtttatagaaattatatctcattataactcatttgaccagtatctgatataggaaattaaccaatattgtttgttgcttctttaaaaatgaggtgaataaccaggcaccagcctatactcccagctactcaggaggctgaggcaggaggattgcttgagcccaggagtttgaggctgcagtgagctatgattgagccactacattccatggaggctgggtgacagagcaagacccatctttaaataataataatatgaaaaattaccttttaataaatttgagcaggagtgtctgatagtgctgaattggattccaaaattattgacacagtgtgctactgcatccaaaaagtctaacaatttttttaacttcttgtttaacaaactttagtgcctcctatctgcaagctactgcattaggcacttagccatcagaaagatgaacaagaaataggccttgtcttctgttgattatttgtggggaaagcgaacaaggacacaaattatacaaatgggtaaacgaactgatagtgaagctcggagaggagtagtcaagaaggtgctaatatcaagaattgaattttaaagtctcaaggttttaaattgtataacctaataacataatattagagagccctgtggtttatcccaccatctcctgtctccttgggctctttacatatcagtttctcctaatcttaatatatattcagtccccactttgtaattgttcctttctcttggaatgcacatatattcaggttccccatacttaaaaaaaagcaagttacagtctgattcatttccttttttataccgtcaaacttctcaaaaaaagaaaaacctaattttctgtatttcctttccccttccaattctgtttctactctgaaacacctccctgaacctgttttcttaaaggtcaccagatgtgctttcttgatctctacaactgtttgtgatattcagtgttgaacgttttgcgtttatagactcttctcccttggcttctgcattaccttgattccccttaccatttattctttctgaatctacattcctgattccttctacttaatttttcttataaatatctacatctctcatacctcactaccagattatatctatctataataatcagtagcgggttcagcaacaggtagggaatgtatcccctacccaccccagtcagaacatgttaaacttattttagacttattcatgtatttccaaatttaatttaatttgaagagtgtgtaatgcttgagaaacctgaaaatgcattagtgggacaaatatgtaatgattgagaaatttgaaatgcattagaattaaaatataaatcacattttaaaattaattttacatagcctagttggttgtttgaaatcagtcataactaggtaagactgggtcttggctttttctcttatttttcacactttttttcttaggctttcttatttattctcatagtttcacctaatgtgttacttacgatttgtatctctagaatccctcctgagctccaaaaacaaattgccagctgcctattatacattattgctggaatactgtaccagtagtacatcaaacacaccatgtcaaaaactaaattttcctttctcttttccccttcctttctgccataagagtttcttctgtcttgtttgcttaatataccattattctcaaccacataaactcaaaatcttggaatcatctttgattttatccttcacctttacttctcatatcccaagttctgttgcttatttttttaaccttctattctgtcccttcccattgctaattttctctgttactgatctttggtattactggcagagatagcctcctgaaactcattcagatcgtataattcacttcctcaaaaacctgcagagacttaccattatttgaagaataaagttcaaactaacttgcgtagaatttatgttttccttggtctgtactgcatcttcagctgcacatacttctactgactccatccccccaaacataccacattccagccaagggtggggtggcatggttgtatgttttctacacatggatttgttcatgaggttacttcagttcatgaggccagttagcaaatctctacttaatagtgttcatttcatcctatctcatatgatagttagaagttgacatattgccttctcccacctgattgaaagttctttgaagatagaaaacatgacttaacgtttccttcagtattttgtataggacagaaacatttttcatagaattattttgactaattagataaaattttaaaactaagtttatacagtggggtctccccccaacttttcattctaaagcacacttgttattttataaaccgagttgtggcagtattccccatctaggtccataacactgtgttataggaaataaacttctatacgatgtgatcaataaaaatggaactagaatacaaactgttaaagcataatcttctcaattttttttttcagagagacacatctcaattcaaaggcagcttgctgatctagagaatttagcttttgtaactgatggaaattttgactctgccagctcattgaactcagataatcttgatgcaggtatttccatgtttgggttttttttttttcttagtttctaataatttatcatctttcaattcacaaaaataagtttggtaagagtagacttgtttattcttactgaactagaacagtggtaaaatacagttttttattcaggaaattggcaaccgcttatgtgcaaagttgctatggaaataagttattttacaactcctcaagaaaattataatttcacggatgtctaggggctgtctattcggcaagttaggaatggcatttggctacaagtaacagaggtcccaaaaaacagtgtcttaagaggttaatattctgtcaggtaaatgaagtcccaagataggcaatttagggctggtatgagagttccacgttatcagtgccccacactgctctctttctgctctactctccttagtgtttggtttgtatcctcaagatcgctgactgcgtggtttttttgaagtagacagtgtaaaaataaaaattgtacctatactctattgtactgtatgtgaaagatatttgttgggttaaaaattattaatatgagctgacaggtatgtaggtataagagaaaaaagaaaaaaattactaaatgagttattaatgattcttgctgtatattttattgctttaaacctgaatttgaaatttaattctttcatctatactatcaaagtttttatttgagatacattatatttctaattaaataagacatttttatgatacataatctttttgagaatatgttaataaagaaggcagaacttgtaaattcagtaatggatacggtggctgtaactatgcgccccgtctcagaacagcggttatatcaaatcccatctattccttccacttccttcttccatttttctaactccacatgttaactgtttttgttgttgccagtttagtagaggaataccacagcacatacttttgctctttgtccaatccctgtccttttgggagtgtaactgctgtcctttcagctgtccaaaatacagagtgatgctctcagtggcagaaaatttggccggaaggatgtcatacagtttatcacttcttcaacctttgttcccagtaacgacaaatgcatccactagctacagagagggaaattttagggtgaaaaaacaatcactgatcatgtgctgcaacaattactgttaactgtctcctgggtcaagaataatgacttctccctaaagttaagaaagactttaagaagtaggagggggagcccccattaacctctttgtagttgaatccaggcattaataactagaatattctgttgtttattgattcttttttctttttaaggcaacagacaggcttgtccattgtgccctaaggaaaaattcagagcttgtaatagccataagcttcgtcgtcacctccagaatttacactggaaagtctcagttgaatttgaaggttagtatttttgtgcttgcaaagaagtaatatatatgaaattcaacatttattaccagttttggcatttttatcatgagtataatcaaatattttcagtttaaaatgtgaggggtttaatgccctcatttctaatgtatttaataaaacaccatatagctttataggcagtagagatctatatgacacagtttagttgagcaaacatttattatgcatctgttgtatactgagtactctgaccctgggagtccattttgcttcttgaacaatgttttaataagttttccttttattttacacatattttggaaggtatagtacatgtagtaaaataagaaaataaaataatttgtatgaatattggaaaatacaagataatatctctttctgctgatggcttaaaaaaactactggagttaagagaattcagaatggtgggatacaagataattcagaaatcatagccattttctacttcagataaatggaaacaaacaaatatttcaattataatcatgataaaaatgacacaatttgagggaataagttcaacaagaggactcatcatgaaaagaataaaatcgaaggacagaaaacaagaacttttcaagttaaagggcttcctaagtgaattatatgaattattatagcatttttgggaaaatgctataattttcccaacatctgacaacatcttttaaaattaaaaatacgcatatccatccaccatgcagttcctctcctaggagtgccttagaagtaaaagaattgaggttggacacagtggctcatacctgtaatctcagcactttgggaagctgaggcaggaagatcacttgaggccatgagttcaagaccagcctgagcaacatagtaagaccctgtctctataaaaaagtgaaaaaattagccaggcgaggtggcctgtgcctgtagttgcaactgctagagaggctcaggtggtaggactgcttgagtccagaagcttgaggctgcagtgccataattgtgccactgtattccagcctgggcaacagagtgagactctgtttcttaaaaaaaaaaaaaaaagaggaagtaaaagaatcaacaggcacggataaatgtacaaggatattcattgcaatatttacttagtaacaaaaacttggaattaaaagagatgattgaataaattatggtatatacataccatgaaatattattatgtagccattgaaatgagtatattagatatataccagctaacttagaagtatttccatggtcaactactaatgaaaacagcaatttatagggaagattttataatattccatttggataaaacaaaaagtcccaccctcaaaagaaacctaagtatcaatcttaaacatatatacatttatatttgtatatgattatgtgagcacagaaattgtaaaatatggttggagtgtcaaccagccttgataaagcagctagtaagagacatccagaaaagaagtcggaactatgctggaactattttcttagtagtactactaaaaagattatcattagttatttagggaaaggggaattagatgctaatttaaggaccatcttgtcttttaagtttagttctatataagaatgtatgataaaccatactgacttcttaggaaaataaaggtctcatttcaattaaaaggatctctcatattctttacttaggtcattgtttagcctttaggtttggtctccctccaagttattctcttttcttaaatattttcttgtgatatttctttacttactcatggatgtggttctctcatgtacattaggctattgggttctttcacatggtattgctctggtagatggtgaagatatgatagtttttgtctcagtgagcaggtttcaaagtagttgacgtaaaattgaaggtagaagcaaccaaatctgccgaaggaatggatgtgaggtgtgagagaaagagccaagaatgcttgggtttgggacttgagcaagtagagaaatggagttggcctttactgagctggagaacagtgcattaggaccaagtgtgggaaagaaggccggaaccagaaatttgggcatttaaagggtgagatgcatctaagtggagatgtcaagtagcccataggttatatgaatctggagttcaggaagaatgtggggctaaagatatgcatttgggagttgtcagaagacacatggtatttaaagccataagatcagataagtaactaaaagaatacatattgatggaaaaaagaagtcatccaggactaaatcttggagcacttcagcatatacaagtaagaaatgatcgaatctaaggtataagaaaaatgcattagagatgacttaacaggctttgagttaagagcaactgtaaggcattatcattcaaaaaaagtaaagagacctaatgtaagataaattaccagtttagtcttgacaagtaggttttgagatgctgactagataatcagttacatatccttaataggcaattagaaataggaatctggctcttaggaatgaattagtacctagagctttaatttgggattcctttaattggaattgtgaaaggagctaagttgccaaggaaatgagaaaaaaaatcacttagccacccaagcctatggaatttctacattttagggcatgagagaaggaagaggatctgtaaagaagatgaagaaaggtgggaagaaaaccaagatagtaccatgtcatagatgaagaagggtctgtataatggcaaatatatcaatagcatgaggtaaaggtgaagcctaagaaaaagtcaaggtggcagagaataggataaagctgaatcccaaagatgctaaatgactaatccaagataaaacagatagtcatggcggaactagaattcaaacctggatccctctgtatttgtgtatatagataacatatacatatgtatatatgcatacacatatatctcatgtataataattgtataaactaaagcaatctcatttgagtaattatgacattacaaatgtaagggtaataccaattcttataaaataaaacttgcttataatttttgataactgaatatttaatgaacaatgtatgataaccagccattctttattttaggttacaggatgtgcatctgtcacttaccttgtcgaccagtgaaaccaaacattattggagaacaggtgatcagatattagatttttttatttttaaatttagtcctttttaaagaaagcataatttttacttactgtgaaactaaaatgtgtatgttcagcagtgtggtttactttaaaattctctgagtcctttcagattatcataatgggaaaactatgaaatgtatgaaaaaaaataattgttatattgaagttctcattttacagtttttagtttaagtcagataaattgctcctttgtgttcaaaatgaaaattaactcatttactaattttgaaatggaaaatttagagagtagttttttctcttaaaatttcggtcatggaataggagcttcaatttctgtgatttagtaaatatcttagtatgttttgatttaattcatcttccccatgtccttccttttgagttcaatcttagagaatcaagaaactttcagaaatcttagtaactttttaaaaaatacatgtgttttatttttagggtagatttgacctaaggggaatacaaactataaaattttttagtgacactatcctgaatgcatattggcgtaatgagttcccattattacattttcttttgagccactaaaagcagtatagtgttgacaaaaaagaaaatattctgtaagtagtagtcaaaacagtacctggtccatcagcctagtctaagatattttgaatatgataatcacagtaccacaaggaaccttgggtaatgtgcttcactattttctatttgctgtaagggtccaagtaaaaaggaggtagcagcactaagagtaaaaggcatcaaaactaggaaagagccattggagcagtcttttgttctcagctaaatgagaaattatgaagtgaaaatttttttactcggataagtacgcttctaattatgtctctaacattcagtggggtactggagctggctcaaatttccagaaatctttcaagctggttgtttagtatggcctccattaaaaattaagttatataaacctaaaaatgaatgagttatattaaaaaacaaaggtaatgaatgttcacttcatatcattgttctcctgtattttaatattatctgtgcacttacagttatttacatctgttatgtctgctgggtggcagtgctctgtaatggtgtaataatgcacatcttttcctaaattcacattcagtgatgttacattgatagcttaaaatctatgacagttgtagcttgaaattggctatagcagagtatttatgccacagaaatctgcaaatactacaaatcagggctttattttcctggagagccagttaataagcatttaccagcacaccactcctaacattacaccatttttaaatgcaacctatagaaaatacaattattttctgattggaatgaatgagaaaagctaggaaattaaccttctggcctattgtaaagtaagttttaaaagtatatgtaaatgcaggtaaggaagttaagatacttcaaagtcacatggcaaaattaaaattatcttctataccattaaatccaagacactaatgtacttaaatttgcaaacatatacttctgtttcattgtcttagcaacttatttaaattaaatactctgtttgatagataaccagtaaaatgggagcccattatcattgtatcatttgttcagcaacaatcaccagaagaactgatatgctaggacatgttaggcgccacatgaataaaggagagactaaatctagttatattgcaggtaagttgagcaatctcattaacatattaatatgtaaatccttaaataatggtccagttattattttcagacatcaggaatataaaataatgctgatttaaccaaatgatttagttcactagtccattacttcagcttttggtttctttctgtaaggtctccaaaaacattttaacattctcaatgtatatatttaataaatggtgtagaaaaaagtaagtgacactcaagtgactacaggtattttaatgaaagattatagaattgttttcccagtgacagcttttacacccttaactgtcatgtatgtattgttggaaaacactagaaaaaaagatacagtgaaataaagacttattattcatagtgatatgaaattattaatagcttgttactacttagagatcccttctcaagaattaaatcaagcactaatggcctaaagcatgtattatatgtaatgaataacttctctcctctgtgtccagaatggcactacgtaccattcctttaagaattgaaaaaaaaaacagtcactgaactatttttctatgaagcataattttctcacagagcctaagttgagaaagtctgaccttgtgagatatgcaacatgcctcctcacgggtagaaaagggtatgtaacacagtgctagggaaagttactattattttgcattttagaaagaaagatacagttgccatttagttaacattccgactgtaatgttatcaagaaatccaaacataaaggatctcatttcttaaatatttaaaacatatgcacatatatacacatcaatattttattagtttatagctaaatgattctaacatactaaatgtaaaatcattttttcattactttgtagccatttcaatgtaatttgtgacttgaaatcattatgagaaaatattctgaagtctcccatgttcaggaaatagagtgattcttagtaagccatgctagctaatggaatgcagccatatggagttactcattttctaacaattataccatagtgaaatatatttagcaaacaatgtagtgtttgatgaaccacaaaggtattttaggattttgtgctttcctagggtgattgttcttaggtatcataatacagatgtattgatgtgctggacagtcaagatagtaaattaactttcattaatcagatgtttaactgagtgttactcttttgtagagagtgctgaataaatcagttctttggttttggtttgtttacatctgccaaaccgtttgcattaacacaaaataatataaagttatttttcaaaatgtatatttattgttttagatgtttacaattattttgtgttttcttggaaatcttttgtttagaattattttgtgtttccctggaaatcttttcttttttccatcttagcttccactgctaaaccacctaaggaaattttgaaagaggcagacacggatgtacaagtttgtcccaactattctatacctcagaaaacagattcctattttaaccccaaaatgaaactaaatcggtaagataaattgaaaatagggttatgggatgtttcaaattattataagtgtaccttctcttaacctttatgttctaatatattaaaatttagaactaggtgcagaataaaaatcatctgttttaacatttttctcagaagaattgtttctttttttctaacaagccgatgtctttatcagagaataagataggcgtaactttatataattactgaacaagctggtacttctgtgagcaagttttctttataaataaataaatacttgttaatagaacccaactggattcatagtttaatttcacatatttttagttcttatagtattaaattcagaatatgttttcaggtctccttttgaaatagtttgtacagtaactaggaacttcagttcactattcttaaatgaaataaaatctatgatggtgaagccatggtaaagttatttcagattatgatttccttctaggcagctaatattctgtacattggctgctttggctgaggaacgaaaacctttggaatgtctagatgcttttggagccactggtaagtgaggacacttttttggaaccccattttatttattcaattttacagtattttttcttagaaaatatatatgggcagtgatgtaaaaaaattaaagatccaaggcaaaatttttaattttttattgtgaaaaattttaaatgtatattagagtataataagtgagtctctgtgtatccatcgcttacttcaaaaatgagtggttcatgctcagtcgttttctcattgtcctcatacctcatatcctaatcttttgatatccattaatttgaaacaaataacagatacatcatttcatctgtaagtatttcagttggatctctaaaaggtaaagatttttaaaaaataaaaccactatactgtcatcatactttaaaaataaagaataattctttaatatcaattgtttgcccaattatctcataatatgttttaaaaatcaaatcagaatgcagacaaaaactgtatttcaggtgtctggtatgtctaagtctcttttaaatctatgggtccttctatcattttctgtgtgtgtgataattatttgttgacttaacatgtcttttgacccatagagtttcccgcagtctagatttttgctgattgtattgttatggctcataaaacatgttcttctatctcctgtatttttgtaaattggtcatttaattagattcagatacaatttttttttttttttttgcaataatacttgtttgctgcaatcaggcagcacctgatgtctggttgtgtctctttttttgtgttgtgatgatcattgcctagcctttagacagtggaataaagtgaaattttaaacattgagaatattcttctcaaaagacttaatagtagagaaaagataatagaaacagtagaaaatttctaaaaagcctccgtacccaatccaggtccttctttataaagattataagagtacacttttggggagtttgtgccaaaggagtgaaagcatgagttagctctccttcctaaactcctctcctcagggaaaagtagtggttaaaagcatggactgtggaaccagactgcctgagttcaaatcccagctttatcgctttgatagttgtatgaccacaggaaattgtgcctcaatttgctcatctattaaaagaggagactactgctactaccatgatgatcagcattagtaccatctcagtataaatatggtaaaagtgatgaggtgatgcttctgattatttcccaagtcgcttggatttgaaatttgaatcatgttattactccttcttttcctgttactcttcccatatctactcagccaccaggtctgttctaatttttcttttctaatataactcacattttccattccatatccaccaatttaatgatttcatagcaagcctattgcagtagcttctaaatagtacccttgcttccagtcatttctctcctccagtttgtcttgcctgttactgctaaacagctattcctctgaagcaccacattaatgttatttatcaatcaaaaaagtcattcatctttattgccgggagtccagacttctcagactacatttaatatcttccatatctgatcctaacctgcttgtccaaatttatttctcagtattcttcaccatacaccgtttttctttactcttttgagacagagtttcgctctgtcacccaggctggagtacagtggtaccatctcagcttgctgcaacctccgcctcctgggttcaagcaattctcttgcctcaacttcccaagtagctgggatgacaggcgcctaccaccacgcctggctgatttttgtatttttagtagagacagggcttcgccatgttggccaagctggtctcgaactcctgacctcaggtgatccacccgccccagcctcccaaagtgctgggattacatgtgtgagccaccgcgcccagcctcttaactcttttttaaatctgaagtcattaaagctaatatctaaggaatatatttccagcctcttcttttaatgtgcctttgtaaacttagatcaggtctggagcagtcattttgcacattttgccattcctaaaatgaggatgtcagaacttacctcacaagcttgtgaaaatatgaaaaatgcgtatatgtgaagtccataacacatggtatttttccattcatgagacacgtgtatggagaagatggtcagtatttccagtacataaggggtttactaatctatgttggctgggcttgtgttgccatctcccattttgtaatgaatgtcccttatgactttaagctagtagatatggaaaaactgtgaaaaggggcccttttggtctgaattcttcctctaatcattcgcttttttgtttttgtttttgttgttttttttttttttttgagatagggtctcggctttgagatggggtcttggcaccatctcgactcacttcagtctggacctctaggaggtgatcctcccacctcagcctcccaaaagtagctgggaccacaagcatgcgccaccatgcccagctaatttttgtatttttctgtagagatagggatttgctatgttgcccaagctggtctcaaactcctgggctcaagtgatccacctgcctcagcctcccaaagtgcagagattacaggtgtgagccatctcacctggccacaatttttttttttttaattcacaacaatgctattgtgcagtgtttgaaaagtgttggtccagaaaagtttttcatattttggtccatgatggtaaacttcagcaggaggtattccaacttcccatcctcccttcaagcagagtaatcccatttgtataaagtattccatggtcagaaaaaaagcaaaaaagaaaacattttccactattcaacaaaataaaaagcatacatagagattttatttgaacaaggatcataaaataggtttagaagaagtattagttaaaatctgttagacagatttttagttataacctttcttgagaagctttgtagtaagaaggaataagattcatgaaaacattaaattttgaaataatttgttatttataaaactgaatgttgttataccatttttattctttaaaattattacaattataaaactcattttcttcccatttttcctaagggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatgtaagtagaaaagacttgccgtgtcactttctaaacttatctgaaattttggggacgaggagtagttaaaaattaagacagttttttgttgtttatttatttaaattaatgccattttttgacattggcctaaggtatgcagtatgaaaattttctagtatttgaaataaaatgcctgggcatgtgacttttcctctaacccgaatttatttttacatgtctgatacatcatactatcattttattacttaatttcaaaacagaattatgtacttaaaatatatttgcaatgtatttttaaatccatggaattttataattagaaataattacagtggtataatttttgttactaatatgactttaaaatgtctatattctttctgattttagacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaaggtaccaaattgccaacagtgtacttagtgtgtttcagtgtttgataaaaagagataatattacaagaagtacttaccttattcaaaatatgcacaaaatataaattctgtattccttatctgtaatactggtttttaatcttacgtggtatctgttgtaattttatttaaaagtttatacctgaaatattcagtttactctccaattaaaatgttactgaaataaagtataagaaagaaaaggtaaaagtgaaagttaatttccagtttatttcaacaatgtaggataaaggatagctatatgaaaggaaaagcaaaaactgttttgttttgttttttcaccatgttgcccaggatgaaacaagactcctggccaacatggtgaaaccccgtctctactaaaaatacaaaaattagctgggcatgttggtacacacctgtaatcacagctacgattataggttgaggcactagaatcacttgaacccaggagccacatgctgcagtgagccaaggttgctccactgcactccagcctgggcaacatagtgagactctgcctcagaaagaaacagtcatttcttttatatccattctgttttatcttctttatttatatagtttgaataaaatgatggcttacaaacttgattctgcaaaatggtcttacaaaatgggaagttctctccatttctcaccaggatttccaaacagaatttgaaaacagttattttttaaaaggatgactttttttgagcacttactatatgcagattatgctagaataatataatataaacggatattgtgaatatagataatggataatcagccagctcacttgccagccccaatactagtttcagagcatttaagtagaaatttctacctcaggataaatacagattattagacttcatagaccttcagggttgtttctaattacctgaaaactgatgtttactgtatgcatgctaaggacttaactgcacatacttaaaaatgtctataatgtaatatcagcaaattcagagtaatatatataaattaaatgtagtatatgactgcagagtacataaatggtatatagtagagcttaatccaaaaagtctgtgaaattaatggtggaaaggactttgactgttcttttttcactcaattttcagtagctagcatactatcctgcatatagtcattactcaataaatagatactgtttgaaagaagcttttataggaaataaaatagataaaaaggaagcaatgtggtggtgatgataagaaacaaagtgaaaatgactgaaaaccagaaaatattgccctattgagaggatatcgcaagggaaaatgtctagaaactgaagaccctcccaagcatcttttatttcctgtgtttcaatttctgtaaaagttacagtaatgatcttttaaaagcactgctactgagaattgaatttttcttgatgtcccataacttatccatagtatactgtccaggttaatattgtcagtataatgccaaacaagggaaaatgataagcccacaaaataacttgaaaaaatttattgtagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaaggtaaattcaagttatatattatgtttatctataatcctccactgaataagcctttatcacatacctaattatacatattgttgtcctttgattttaaagattacagtgctaactttgttatttcctatactggatttcctttcgtcaacagacaagacattcgtgtgagtttattaaagttatttactcatgctgtacaatatatgctttctagctctgccttctatcgaaacatctagaaataacttagtttccactctcaactaattttaggaacataagtcagattacgttttttccaggctgttacaaatcattaattttataaaaataattttcatgtttctggctgtgtataaaagccatcagttataaaatgcattcaataaacatttattgagcctctactatatgccaggcctggggatgggaaacaaggaaaaagctgtagtttatgccttcataaagctctttctgtttgtttcagttctgggacatggaaacagttgcttattgttttctgttaggttcttggtattttatgaatttttgagtttagcacttactatgttaagttgcagatttttttctcattttgtcactttttttttaatctgtgttgcagaagttttttgttgctaattgaatgtttatgtagtctggattttgcctgtagttagaaagagctttcctattcctggattattcaaagtagattaggttgtattgaatagtacacctttcctccactgatttgagaataccttctttatcttatactaaatttccacatgtatttgagtttgcttctagattttctgttctgttccagtggttggatatttcttcatacacgtctatcatactgttttgactatagaggcttttcagtgtcatttaatatctgtgatggcaatccctactcaaagctctttgttttcagtgttcctgtattgctcttttgttaatcccttaatataaaagtaaataataacccagttggcatattattttgatgacattaaattggggagaatagatactgtgatttttgaagcttcctacaaatatgatatgcttttcatttgtgcaagtactttagtataatgttaactggtggtggtaatggaggaaattctgtcatgttccttacttttagtttcctctagcgctttctatttttttattttttttcagatggagtcttgctctgtcttctatccaggctggagttcagtggcacaatcttggcccactcaacctctgcttcctgggctcaagcaattctcctgcctcagcctcccaagtacctgggactataggcacacaccaccatgcccggctactttttgtatttttagtagagacggggtttcaccatgtttgctggctagtctgaaactcctgacctgtagtaatctgcccgccgcatcctcccaaagtgctgggattacaggcatgagcctctgcacccagcctctagtgctttctgattcaagcataatactggcttttcatctacaatacatatcatttatcacattaaggaagaatacttcatttttattgtattttatcaagatgttgaattttgtcataatgcattttcagcatctgtggagatgattatatggtttttctctttaggcttactaatttgattaattgtaataaaagtttccaatatagaaccaaactggattttgtagaataaactattgtcaggtttttttttaatatgttgttgtattttatttgctaatttttaaaggattttcttgtttcatgagatggtatatagttttcctttgtagcataattttagttgggctttgatctatcagtttactcccttcaaaaataatttggaatggttcccttttttcaattcttaggaattgaaaaactgatttttttttaaactagttcttaagaactagtttaactagtattggaattatgtgttccttaaaggtttagtaatattcacctagcatttctgttttatttacatagggttgagctaagtgttgtctaataattccttttaatctccttggttcctatggtcatattccccttatatactttcatttatttatcctttcttccatttttcttgactagataagaggctgctttaaatattttattgtaattgtttgtttttctttctttttttttttttttgagacggagtctcattctgtcacccaggctggagtgcactggcacagtatcggctcactgcagcttccatctcccaggttcaagcaattctcctgcctcagcctcccaagtagctgtgactacaggcacacgccatcatgcccggctaactttttgtattttagtagagacggggtttcaccatgttgcccaggctggtcacgaactcctgagctcaggcaatccgcccgccttggcctcccaaagcactaggattacaagcgtgagccaccacacccggcctgtttgtttttcttaatgtctatttttagtagtaaatatgtatatacttctgtaatttggatttatcagttttaagtaatatactttggctccttgataccacaactgagataattagctccctgttttccatttttcccttcctaatttttgtttgttataccatctctatgttattagaatatgtaacacttaacattctgttttgccagattaatctctacatataataatattctgtatatgtcatcagtctttttgccataatttctctagtcatctcttacttggttaaatttaactctcagtttactcaatagagctcataagaaaaatactactttgtttccttcatgttcaaagcttttctttgcccaaagcatgtccaatagcctgtatacttaaagaggttaaagaatttgagtgccttatagaagttcttataatttttctttcttatgtatgtgacattaatcaaacattttaaagactttttgacttgataagtgataactataaagcaatgatttatttttgcattttatttggaatcatacagaacttagaataaacaagtatgtcctacaaagaagtcatctcattcagaatttttatcaatttgtaatacatagtttaaaaagtcaaatagctgggcacggtggctcacgcctgtaatcccaacagtttgggaggctgaggcggacggaccacctgaggtcaggagttcgaaactggccaacatggtgaaaccccatctctactaaaagtacaaaaattagctgggcgtgatggcgggcacctgtaatcccagctactcaggaggctgaggctgagacaggagaatcaccacttgaacccaggaggcagaggttgcagtgagctgagatcatgccactgcactccagcctcggtgacagagcaagactccctctcaaaaaaagaaagaaaaaaaagtcaaatagttccgtaagtcttattaataaaataataacctctgcctgactccctaaacagttaaaatgtcacagctgtttcttataatgcttacattcatatttctaaataacatgtttataatgcatctaacttccttccatggaaaaagagtatttggctttttaaaccaatcgagtcacatgcatgctttcccccttccacgttggactacatcaatatttagtgttagtatttttataaatagataaatattgttcgcaaattttatttgctgtctattgctgtgtaacaaattcctccaaaattattggctttaaacaacatttattatcccatagtttctatgagttgagaatctaagcatggcttagctgggtccactagctcggggtctctcacaaggccacagatcaaggtgttggtcagtggtttgtgcccttagtcccagctacttgggaggctgaggcaggaggatcacttgaacccagtagttcaaggctgcagtgagctatggttacaccactgcactccagcctgggtgacagagcaagatgccatctcttaaaaaaaaaaaaaaaaagcaagtcagaagaaccagagagtgagtgagtgccagcaagatagaagaggtcttttgtaacctaatctcaaagtaatactccattacttttgccatattttagttgttagaaatttgtctctagaaccagtgcctactcagggggagggtattacacaagggtatgaataccaagaggcagggattattgctgatcattttggaaggctgctacagtacagataaaccatatgaatccgggcatggtggctcataccagtaatcccagcactttaggagactgaggtaggattgcctgaggtcaggagttcaagaccagcctgagcaacatagcaagaccctgtctctacaaaaataaaaataaaagctgattcatatatgttataataatgtttcctttcttatgcaactcttcggtaactctggaattaatacttactgtgcttgttacctttttaaaaaaatactttttataatccatccctaaactctttgctacattttcaatgcttccttcaccatagttaagcacattaggtaatctttggctataaatttcactcccctggagacagccctcctgttgtagtttggattgtttgttttctgtatctgctgaaatctgttgtgcaagggcttctgtttaaccatcatcctggaaattttctttaactttctttttgtgataaatctcctatcgcagatcctgtgtattttcccactttccttgtttacttcttcattttgagtggacactttttcctatagattgcagagaagtattgcatggctaagtaccaaattctaggatggaaatcattttttcctcaaaatgttcaaggtattattccattgtcttctagcttccagtgagaagtctgctgcttttcttgtgtagtgttatattattttctctctgaatgctcttaaaatatctcttctaaacccagtattctaaaataattttgagataatatgtgtatgagttcatctttttaaattcagtttactggataatctctgagttctatttatttatttatttatttttatttttatttttatttattttttttttgaggtggagtatcgctatgtcacccaggctggagtgcagtggcatgatatcagctcactgcaaccttcacctgctagattcaagcagttctcgtgactcagcctcctgagtagctgtgattacaggcacatgccaccatgctcagctaacttttgtattttttagtagagacagggtctcaccatgttggccaggctggtctggaactcctgacctcaagtgatccgccctccttggcctcccaaagtgctgggattacaggcatgagccactgcgcccagcctctgagttcttttaagtcagaaacttgagctcttcagctctgataaatttggggggcaaggggactaattttttctttttctttttcttttttttaagatggagtcttgctgtgttgcccagggtggagtgcagtggtgtgatcttggctcactgcaacctctgcctcccaggttcaagcaattctcctgcctcagcttactgagtagctgggactgcaggcctgtgccaccactctcagctaatttttgtatttttagtagagacagggtttcagcacattggccaggctggtctcgatctcctgacctcaagtgatctgcctacctcgtctccccaaagtgctgggattacaggcaagagccaccacacctggcccttgggggatgttatttctttgacaagttttgcctttcaaattatatctgttgtctctttcaggaactctgtttagttatattttgggtcttctagattaatcctttaattttttaaaatatctatacggttcatctctttggcaattagttctactttatactttttccttaatttttattttccaactcttatttaaatttctgtcatattttgttcatttctaagagttatttcatattttttcactgttcctttttttttctttaggctagtcaagtgattattgttccttttttaatagtgtcatattgtttcagggatacaaaatctcttacctttctaagaattgattatacttgggtatattttatatttaggggagaataggggttttttgtttgttttgtattgttgctgttgttttgttgttcagttctcctgttttttaactttttctgttttgtaattttgttctctgtctgtcatggtagttctcaaatgttttgtggtcttcggttgtccacagtgaaaaattgttttaaagcacttggggcagagcttataaaccaacggatttggctgtaatcccagcactttgggaggctgaggcgggcagatcatgaggtcaggagatcgagaccatcctggctaacacagtgaaaccctgtctctactaaaaatacaaaaaattagccgggcgtggtggcgggcaccaatagtcccagctactcgggaggctgaggcaggagaatggcgtgaacctgggaggcggagcttgcagtgagccaagatcgcaccactgcacttgagcctaggcaacaaagcgagactgtctcaaaaaaaaaataaaaataaaaataaaccaatggattttactgtgataagaagataccagtctgctttttttagtaagacacccccaaatgtcaacaagtatacatagatcttttgtcttggattggtaaatttttccagagaggaatcaaccaatcttttagcagctctgggagagccacactggggacagagactggaaagcagatttttacttaatccctctgttttcagacatctcactctcaactgtaactaaaactgctggtttcatatcctcaatagtttagcctcaccaaagattaacttcatcttttggaatggggaggacacagacgcttgattgtattagagaagatctggagttttaattgaaccctttaaaaaattgtaaccagacctcttatttgcaatacctctctatagtcatcttcagagacaatcattgccttcaattttcaggccgtcgcagggtcccaaaacactaatgaactttctgttttgttggttgcccatctatccatttcaggcttatgctttagatttttctggtctgataatcagttctcccattgtgtatgtgactcctgcttctgaaattttattggcatctctcatcttttgttacctcctctcccattttatttattcttgtagtttaatttttgttcctgtcatttaagcgttaagagacagcagagagagagtgcatgtttaatctgttgcatttaaatagaagtctcagaatattttttaactcctcatctggtattgccttcctcgcttatgtaccagtaacacggaaatactagttttctttctactttaccgcttcattatttgctgctagtaacttgaattgatagccttggccctcagagaggaaatttgctgatgctaatttagacctgagaaatcctagcaaagaggcttgggaaaaggcacgtttgtatggtaagattattttgcacagtgcatcaagatacaaactgattaataattcatttgtgctctctgcctgtggtaagtgggtgtagctgacagaactatactataaattgccatcctgaattggatgatgactgcttataagtatttgtagtttagtgatgtaatggtttaagagaagacttcttaagtatactcatatttgaggaacatagttctcaacaaaactttacgtcagtgctaaccacaccctttcatcaaagcttagaattaaataatactgaaaagtagacctaggagcagtgaaggacacttttaagtaaatgtaaaataagatctcataactatgcattataccaataattgtattgaatagcagagtgatagtatcagctagcaagaggctatcgacctgtgttcctgccaccattctttggttctgaatgtatctgggactgattgattaggtcaggccatttcaagaaagtgaatgataacccaggaatggcctggagtggagggaattagttggagaatatctgatataaaatgactatttgggccttgaatggatttaaaagttccatagtcaaatattagcccattttgaaaactaagaatagtgctagtatctccccagtttccttgtgattatatcaggactctcattcattgctttttaaaccaaattagattcttctagcctacattttgaaggctgaatatgaatcaagcataaggaattttctttccaactgcggaagagttaacttatgagaaatatctacattttgattgggatgttggttacatgggtgtatacatttgttaaaattcatcaactttttaatataaagtatatatgttttattgcacataaattataccttaatcagttaattttgaaatatggatctcttgtaaactttataagactttctccttccttatattatttcatgtggtatagtaagtaaatatcagttacacctctaataagccatttgacatgaatttccacctctctcaagctttaatcctctgatctgtataattgagattttaacagtacctacttcagagagttgtaaggacttaaattaaaaaaatatatatatgtgtgtgtgtgcacatatatgtgtgtatacatatatacgtatacatatgcacacacacatatatacatacataaaatacttagcataatacctggcacatagtagatcctcagtatatagtagctgcacattattattaatataacaattactactatttgtattagtcatttctcctttgatttctccttttattatctttttacagaaaacccatatagacagctgccttgtaactgtcatggaagcatgcctggaaagacagcaatagaacttggacctctgtggtatgtgaccagccataagaacatattaaaatttgatgtattgattgatttattaattgctgatttttattatgtgtggtaaaagacaaatttaaattcaattgttaagtctaggcaaataattatgactcttctcctcctatgaacctgaggtgtttaatattttgagatttttctctaccattattctctctagtttgtgacagaactaagaggcaatggaggtaaaagagaagcctggatgatctggaaactagataattcatttctgaatagtaagaaagaagctttttaaaattgatcattgtagatctagcatgtgatttttaaatgatcacaataactttttatagaagagccaactcatgtaaaaggtcctagaagaattagttttaagagagaaaggcatgtgaaagtgtctgcctttgttttagataaagttatttagatgatacacaattggaaatatttaatgtgtatatgcttttgcatcattggtaacagctgattgtaccttaaagttgaattggttttttttgtttgtttgtttttttgagacagagtcccgctcttgtcacccaggctggagtgcagtggcgcaatatcggctcactgcaacctccacctcctaggttcaagcgattctcctgcctcagcctcctgagtagctgggattacaggcacccgccacaacacctggctgatttttgtactttcattagagactgggtttcaccatgtttgccaggctggtctcgaactcctgatctcaggtgatctgcctggctcagcctcccaaagtactaggattacaggtgtgagccactgcgcctggccaaattattttaatcagaatccttaccttaagtttgttactagagattcttttttttttttttttttttttttgagacagagtttcactcttgttgcccaacctggagtgcaatggcactatctcggctcaccacaacctctgcctcccaggttcaagcaattttcctacctcagcctcctgagtagccaggattacaggcatgtgccaccatgcccagctaattttgtatttttttagtagagaccgggtttctccatgttggtcaggctgatatcaaactcccgacctcaagtgatccacccgcctcggcctcccaaagtgctggggattacaggtgtgagctaccgcacccggccgagattcttacagaaattcaagattcctaagaacattgtgacaagaattgcaaatttcttctcattactttataaggtcaaggcttaagcacctactaaacctagaaattgacctacatggtaaatgtctttgtgctgatgctcatgattttatcttcatcttattaaatactcttagattaagaaagatctagccagccctaccttctagttcttctaaaactagttctcacctatagcatctgctacacattgatcctactcactgattcagaactgaggaaattaaaaatagcaggttactggatccagaaggaagatttctagcctaactgccttattttacacatgaggaaactatggcacagtgtttttaagtgcttgctaaaactgaccaaaaaaattcataccacagccaaggctagaacttaggttttctgactcccaggactgaattctttttttattttttatttttgaggcagaatcccactttgttgcccaggctgaagtgcagtggcacaatcttggcttactgcaacctccaccttttgggttcaagcgaatctcctgactcagcctcccgagtagctgggactacaggcatgtgccactgcacccagctaatttttgtatttttaatagagagggggtttcatcatgttggccaggctggtcttgaactcctgactccacccacctcggcctcccgaagtgctgggattatgaattcttaataaaaccttatgatttccacatgaaagctattgtgttcatggctttacactcatccagaataccttcccctctctaccacctccaattcaaattgtactttctttttgaagtctcttcttagtgcctcaacccaatataatctctaaattccctttagtatatcttatattgatcacatatttgataatttaaaatcatatattctttcatatatatttgctaaccctaacaatagtagctaccatacattgaggatatatagagaagttttatttttggccaggcgtggtggttcatgcctgtaatcccagcactttgggaggctgagacaggagaatgtcgtgaacccgggaggcagagcatgcagtgggctgagattgcgccagtgcactctagcctgggcgacagagcaagactccatctccaaaaagaaaaaagttttattttacatttcatgatgaggaatataagactgaaaagtagtaattactcaggattatatagctagcccagcacagttgcagacatctatagtcccacctactcaggaggctgaggcaggaggatcccttgagcccaggaattcaagttcagcctgggcagcatagtgagaccctgtctcttaataaaaagattacataactagtaagtggtggagccaggattggaatccagtttatcatactcagaatttcatattttgtccattatacctgtgattcttaaattaaatgggaagcatatcagattcaccccagactatttctgaaccataccatcaccacatataattctcatatatgtgctcccctgccctgtcctgccccaccctaccaccataaactcatcagaattaagattttctattagtgactagaatgtgcattgtgaaaacctcttcattgctttattttcctgtctagatttataggcttttataaggtcaacattgtatattatattttggtatatcctccacacaccctctgtgtaccacagtactgtataccttatgagagttcaataaattatttttttattaaggtaacatacacatataacattttccttctttaccatttttaagtatacacttcagtggtaataaatacatttatattcttttacccctcttcatcaccctctcccttctccccttcccagcctcaatagattcttgttgacttaattaagtttccttgactaatgctactagtttagagaactgatatgataaaaatgagtggcaaatagaaaataaagttttaggccagaagtgtggtgtctcacacctgtaattccagcactttgggaagccaaggtaggaggatcccttgagcccagtagtttgagatcagcctgggcaacatgatgacaccctatctctattaaaaaataataaaatactatagcctaggcaacaggacgggactctatctcaaaaaagaataataataataaagaaaataaacagttttaaattaaatcataaattctttttgaatttaagtattactctgtcatataattaattatatatcttacttatagttaaattgtgaagactttctttttaaagagaaacatttttcaaacccagttctctgtatattcttttcttttcaggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaaggtgactaactgaacgctagcttactagctttaaactgcttaccaaaaatactgtatctttttcaattgtatttgatgttataataaaaccaatataattataaatagtgtgtttttagtaaatcttctctaatgagtctgatcctctggtttttttttaattacatagttttattcaggcttgtaatcaggcctgagatgaataggtgaatgatgaatagtgttgttggttttgttgttttttttttggatactgggtctcactttttcacccaagctggaatacaagtggcacaaacatggctcactgcagtctcaacctcctagactcaggcagtcctcttgcctcagcctcaacctcctgtgtagctgggaccacaagcatgcacaccacacctggctaatattttttagagatggggtctcaccatattgtccaggcggatttcaaactcctgggctcaagcagtcctcccaccttgacctcccaaagtggctgggattacaggcatgaaccaccatgccctgataatttttttttaaagataacctccttttttgtgtgtttttaattttactagatttaaaaaaagaaaaaaaaaacactaaaggtcctttgtgatttttattaccctagatgtgctttctagaaaaagaaacttttggtaattcaaggagtgttgtggccaaaaattgtaatatctatgaagacacagaaactacatttatacttctcattcagtaaagctatgtgttttttctgtttagtacaaacagccaattttgtagttgtatctgactattgatatgagcctattgaatatcctagtgttctcataaataattagaaactgctattatagagggttaaaaatgtaatttttgcagttcagtttggccacagaatctcttgcatattcgtgaaaatagtgtggatggaatttcataaacttttatttaaactgagttgttgctttatgtcattctgtaaaatattttcttttcccatttgctttattttttagaagaaaatggtgtatttattaaaactacagatgacaccacaacagataattacattgcacaaggtatgtatgcatatatgtgtgtacatatgtacatatcaggtcaaaaaggcatatagcaaaagggtaggaagagaagagattgccatggtagcctacttaaaaatacatttcatattatatgacaacaaaactgtagtaaaacttgtttatcagcattcacacataggaaatttctgttaacatatgctttgttcacatctgtaatatatggttatccctttgaacgaactgtatgatcttgaaccatgtgaataaaataagatcaaattatatatgataaagttatatataattttatagttaagataaaattttattctaattcttttaaaaattgctcattaatatatgatttatagcaattccatttaagtaaccagaagacctcattcttcagccaaaagaatttattatatggcctttcatataatttaggatatgtgcatactttaaatctagctgtggtagacactaaattcatattaaaggatgttaagatttaaaatatcagtgccctaatgtctaaggttttgttttgctttttaaaaaactttagattctagatgtgttttttgagtacagatgaaaagaagactgtagagtgttaagtttgaaagagcagtggcctttagttatcagctgtaattttttattagttgctcagcagtttaatgttgaccttcaaagacaaggaaacttaaatttcttttaatagtatatagtttaaataactactgcatactctttgcaacagccatgttcatttggcatcttcaactaatttgataacttaaattgatacattctacctaatttctctgttggagggaagacaaagaagcattatgatacactataaagaatattagatttgctgggcatagtggctcatgcctataatcccagcattttgggaggccaagttgggtagatcacttgaggtcaggagttcaagaccagcctggccaacatggtgaaaccccgtctctacgaaaaacacaaaaattagccaggtgtgtcagtgcaagcctgtaataccagctacttgagaggctgaggtgggagaattgcctgaacccaggaggcagaggctgcagttagccaagattgcaccactgcactccagcctgggtgacagatcgagactgtctcaaaaaaaaaaaaaaaaaaaaaattagatttaagagtattatcctatgcaggcgttgttatataaactcagccaggtccctcccattcagcaaaattatcttaaatcctttttagaataaagtaaaacataaataagctttaaaaatattttcaaaagccaagagcacagtagcacacacctgtaatctcagctactcaggaggctgaagtgggaggatagtgtaaggattgtgtgagcctgggcaacacagccaaactccatctcaaaaaaaaaatttgtttttaatctgtgagcctttctcataagtaaattaaggaaattagactaatttttgtgggctcttctataacttttaaattatatggttattctaagaccattggtcaacacataaaatcttaaaatgatagtactatgcaaacccaaaggaaaataattcattctgtcaaagatacgttatatgttcattgcagtgctattcacagtagcaaagacagaatcaacctaggtgcccatcatcaatggactggataaagaaaatgaacatatgtactaaggaatactatgcagccataagaaagaacaaaatcatgctctttgcagcaacatggatggcactctaggccgttatcctaataaaactaatgcaagaacagaaaaccaaagccccatgttctaacttacaagtgggagctaaactttgggtactcacagacatcagatgggaataatagacactggggactactagatgggggagggatgggatgtggcctgggctgaagaaccacctgttgggtactatgcccactgcatgggtgctggggttgttaggaccccaaaccccagcattacacaatatacccacgtaacaaacctacacatataccctttaatcgataaagaaagttgaaattattttttaaaaaagaagaaattaccaggccaaaaaaaaaaatctatatactgctgatgatactcactattaacgtattacatcagattttttgcctcagatgctcctagaacttgtactaaatctggatatctatcctttgactaggtgcctcattagatttcatgcagtttcaaattttagatttcaaattataattctgatttgatggatggatcccaggttgtcctttttgctttatgtttttatgtaaagaggcaacagttcagcaataatttatatttattttgaatgtaatttatttttatgtatcaactttgccttttcaatacttttttttttttaagagacagggtctcactgtgttgctcaggctagactcaaactcctaggctcaagccatcctgccacctcagcctcccaagtagctgggacttgggtcccagttacacaggtgtacgctactgctcctggcagcttctgaatattttgcttaagcagatgttaattactttccctgaagagataagatttgaccataacgttcatatataaataatcaagggttgaacaccaggcaaaatctcattatagtattggatatctcagttgttttcatgttgtgatttttggaaggatacagttctagaatcttagctggcctcctttcactcaaaatgaaaaaactaagtgctgtgatgagaaataggcaatgagatcataacattgaccttatgtcagtttctgtgtccaaactctcaagactttgtgttgtttttctttgttttgtgattactaaagacccactgtgtatccaatactgatcactcagtagaaatacaggtataaaaatgaaagacattgtccttaggaacttagaatataacttggggagaaaggacttacacacattaaggaactataagaaaagaaaaaaaaatgacaacttaatcaaactctgagtagtgtagtgtagtattaacaacaatgaaatgtatgaagtgactagccccagattgacagatggcttcctacaggagacgaaatagagtgtggcttgaagttgaagaaggtagaaaggaagttctgattcagcagtttaatatgaaaattacataagtgaaggaccgtgaaaatagaataaattataagaattaagattggatagtcaggttgaaataatgtgtcaggatttatacttgagataaatatatagttataaaagtatttggcttgtaatttttaagagcatgctaactttgtatgtgtatgttgcaggaaagagaaaaagtaatgaaatgatcacaaatttaggcaagaagcaaaagactgatgtcagtactgaacatcctcccttttattacaacattcacagacacagcattaaaggaatgaatatgccaaagtaagacacccagtgaatgacaaagtatatatattttatattttaataatattgtgatttaaataaaaatacaagaacctgattattttttctttcctttcctttttgcaggttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacaatgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaacgagttaagga

SEQ ID NO: 9893 - DNA, 1555 bp, Homo sapiens
tgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattag

SEQ ID NO: 9894 - DNA, 3813 bp, Homo sapiens
gtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggcgagctactcctctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgctgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaataataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattag

SEQ ID NO: 9895 - DNA, 480 bp, Homo sapiens
agataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaa

SEQ ID NO: 9896 - DNA, 197 bp, Homo sapiens
cccacctagttccaagaacccctgccccttctttgctcactcctattcaagccacgttgttcagcttcctctgcgctcttgggccagagggctagaagctgctgttttctggaatagagcacagggcagtatgatctgtagtttctccaggccctggccggtaccctgaaaacttggggacccatcacctctgttct

SEQ ID NO: 9897 - DNA, 437 bp, Homo sapiens
tgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactt

SEQ ID NO: 9898 - DNA, 480 bp, Homo sapiens; identical to SEQ ID NO: 9895

SEQ ID NO: 9899 - DNA, 997 bp, Homo sapiens
ggctcacatctgtaatcccagcactttgggaggccaaggtgggcagattgctggccaacatggtaaaaccccatctctaaaaatataaaaattagctgggcgtggtggcgcatacctgtaatcccagctacttgggaggctaaggcacaagaatcacttaaacaggaggcaggggttgcagtgagctgagatcacaccactgcactccagcctgggtggcagagcaaaactttgtccccacccctgacaaaaaacaaacaaacaaacaaaacaaaaaaaaacctgtcaattcagatgctaggttttcatcagacgtacttaatctgtatttagatttcttaaaacttactgtggaaaatgtatttacatactcaagttgtttgaaacataactcactgttttccaataactgaagtatccacttttacatgtattaaaattaaataaaattagaaattcagttctgcagttgcactagccacattttaagtgtttaatagccacacgtggttagtggcatctatattggacagggcagatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcaaatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatcc

SEQ ID NO: 9900 - DNA, 793 bp, Homo sapiens
actccagcctgggtggcagagcaaaacttgtccccacccctgacaaaaaacaaacaaacaaacaaaacaaaaaaaaacctgtcaattcagatgctaggttttcatcagacgtacttaatctgtatttagatttcttaaaacttactgtggaaaatgtatttacatactcaagttgtttgaaacataactcactgttttccaataactgaagtatccacttttacatgtattaaaattaaataaaattagaaattcagttctgcagttgcactagccacattttaagtgtttaatagccacacgtggttagtggcatctatattggacagggcagatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcagatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatcc

SEQ ID NO: 9901 - DNA, 994 bp, Homo sapiens
ggctcacatctgtaatcccagcactttgggaggccaaggtgggcagattgctggccaacatggtaaaaccccatctctaaaaatataaaaattagctgggcgtggtggcgcatacctgtaatcccagctacttgggaggctaaggcacaagaatcacttaaacaggaggcaggggttgcagtgagctgagatcacaccactgcactccagcctgggtggcagagcaaaactttgtccccacccctgacaaaaaacaaacaaacaaacaaacaaaaaaaacctgtcaattcagatgctaggttttcatcagacgtacttaatctgtatttagatttcttaaaacttactgtggaaaatgtatttacatactcaagttgtttgaaacataactcactgttttccataactgaagtatccacttttacatgtattaaaattaaataaaattagaaattcagttctgcagttgcactagccacattttaagtgtttaatagccacacgtggttagtggcatctatattggacagggcagatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcagatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatcc

SEQ ID NO: 9902 - DNA, 227 bp, Homo sapiens
cctcaggtgagcagctttagtcaatgttgtgaattttagattttaattagacatgcaacagtttcactacctttcaggatttttgtcctgtaacagaggctcttgctttttgacagagaggtaggcaggtggagaggttatcctgctgctgcagttctcaagttgttaagtttcctctggaaggctaacccttgttgggaactaacagtttcaataccagcaagtct

SEQ ID NO: 9903 - DNA, 529 bp, Homo sapiens
agtagctgggactacaggcatgcgccaccacgcccagctaatttttgtgtttttagtagagatgggctttcaccatgctggccaggatggtctcgatctcttgacctcgtgatctgcccacctcggcctcccaaagtgctgggattacaggtgtgagccactgcgcctggcccgcatgtattacatttataattaaaaattcacaactcaatgtcaagtgtgaaccttgtgttgaccctgatttgagcaagcaataaaaagatatttttgagacatttagattatgaatttcacatttgatgatagttactattaattttgtgaggtgtgatattggcaatgtggttagatgacttcagagaaaaaggaaggtatagttaagcaagtatggcaacatctaataacttgggtctaggtgatgtgtatgggtttcattatactgtcctctttactgttgtatgtatttgaaaacattcatgacaaaaaaactttttaatcagttaaataaaccatgaagaacggttaaaga

SEQ ID NO: 9904 - DNA, 530 bp, Homo sapiens
agtagctgggactacaggcatgcgccaccacgcccagctaatttttgtgtttttagtagagatgggctttcaccatgctggccaggatggtctcgatctcttgacctcgtgatctgcccacctcggcctcccaaagtgctgggattacaggtgtgagccactgcgcctggcccgcatgtattacatttataattaaaaattcacaactcaatgtcaagtgtgaaccttgtgttgaccctgatttgagcaagcaataaaaagatatttttgagacatttagattatgaatttcacatttgatgatagttactattaattttgtgaggtgtgatattggcaatgtggttagatgacttcagagaaaaaggaaggtatagttaagcaagtatggcaacatctaataacttgggtctaggtgatgtgtatgggtttcattatactgtcctctttactgttgtatatatttgaaaacattcatgacaaaaaaactttttaatcagttaaataaaccatgaagaacggttaaagaa

SEQ ID NO: 9905 - DNA, 530 bp, Homo sapiens; identical to SEQ ID NO: 9904

SEQ ID NO: 9906 - DNA, 18038 bp, Homo sapiens; identical to SEQ ID NO: 6790

SEQ ID NO: 9907 - DNA, 13540 bp, Homo sapiens; identical to SEQ ID NO: 6791

SEQ ID NO: 9908 - DNA, 309 bp, Homo sapiens; identical to SEQ ID NO: 6792

SEQ ID NO: 9909 - DNA, 577 bp, Homo sapiens; identical to SEQ ID NO: 6793

SEQ ID NO: 9910 - DNA, 5488 bp, Homo sapiens
tttcagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatacagtaaaccacttgattcaataacactggttttagtcattgagagttgtctccaaggaaccactttaaaatccaaatcagctttcagtctaaacataacttgattagttttttttttcagagggtcagtacaggatgaattaaaaacctaaaaatatggttcataaatgtaagctagataaattttgtttacattttttcaatatcttaggttcgatatacctttggaatatttaattatattttggatataaattggacttcatttagggtgagggcaaacttaagctgagaaaatggttaagaaatctgagtttatttaatttatatgtaaccttttatagtggtgggactgtttgggtacagagatgttttatatttatttgcagggtatatccaaatattttaaaaattaattgaataaccagtacttctagatgataagtttgtcagcatgagcagaaatgagaatttcaggattacttacaattgaccacaacctggagtaggtgaatgaacatggattcagtggcactttacagatccgcttgggaggggctgctgtcatcagccttttcagtagagctgagtgcctgttgttttaatgatgatgactactgtaccctgtgtacctgttcccagagcgcctccaaaattaattactcctctgcacctttcccagtcatcttaattagcttgagggcctcattttttatgaacaagagttaagtatctgttaactttttaaagcttgatagagatataattaacacatactctggaaagttactctctttcactgtcaaaaaattgattgatcacagttttccaaaatatggttctggataagatcccttaggtttcccgaaatttcagcctggcttgttttgtaccacgcaggaggtcattttgggagtttgctctttggattgttcttggtagaagtctggaatctgaatagttcaaccacagttgcatggaacactttgagtgttcaactgcattatgtggtcttgataaatttttaaaaatcctattttgatagtttttaaaagtggaaaaccattacaagagttgagtggatagggaatgtaagaatgtagttttagaaaaattcaattatatttggttatcactggtattgtattgttattgagctaccttgttatcattttaagaaaaataagtttatatactgggaactatgttgggaaaatgttgccatagtaactttattttttataatagaattttctatttttgaccaaacataaaatatttggatatgggccaggcatgatggctcatgcctgtattcccagcactttggaaggccaaagcaggagactcggttgaggccagtagtttgagaccagcctggacaacatagtaagattcatctctacaaaaaaaaaaattagccggatgtgatggcacatgcctgtaatcccagcactttgggagtctgaggcaggaggatcccttgagtccaggagtttgaggcttccatgagctgtaatcacaccactgcaccccagcctgcgtgacagagtgaaaccctgtctctaaaaagtctgaatatgaaaattatattggcagcatactcagacataaactccaaagttgtctctacactgatttcacatctgcataattttctgcatacccagcaggtgaattttcagtttttctgggagacaattttgaagagatggtgaaatagaatgggaagttaaggaggggaggtaaaatgttttaaatgagaagaacaaaaaagctttaaaagtcaataacactttgggaagctgaggtgggcagatcacgaggtcaagagatcgagaccatcctggctaacatggtgaaaccccatctctactaaaaatacaaaaattagctgggcacggtggcttgtgcctgtagccccagctactcaggaggctgaggcaggagaatctcttgaacccgggaggtggaggttgcagtgagccgagatcgagccactgcactccagcctggtgacaaagcaagactccgtctcaaaaaaaaaaaaaaaaagtcggtaagaacggcttaaaaatggactgttttcttttcctgtgtggcattgggttgccatgtagacctgtaccccaggtgctttgggcatctgagcctatgatccatattcagcaggcagtaaagaaacggtccttgaagatgagtccttcctggtaatgcttcctgaccaccgaggcactaccagagatgttatccacaccaggtcgaatgtgtggatattagttaacatctacatggggtgagattgacttttgcaaacaaaagggaaaagatgcactagaaaaacagtacaagtaatgaccacaaaaacattgtttgactgaaatccagctagctaaaagaatcctcagctcactgaaggaagagactgaaaataggaaagaagttctggtgatttcatctgagggaaatccccaggcttaggtttgacttggttcagggttggaggtttatagcctcttgtgtgatccttgataccagcaaactggttccaaatcccaggagttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagtgtacctggctttccttttcctgggtggagacagctggggcatattcgggtggcactccctctcagtaccagaggccccactgcctgcagctggaggcatgtgaccataagctcctgcttttgctttttgggcttgcatccctcttttctgtgaactctggagaatgctggaattaaaacatttaagcattttgattaaatgagcttgagctcctctgttcttttctaggtgctcttgttctccaactctcctgcctctttctacctctgccctatacattccagctctggagacagagtctgaaactggagtctctggagggatgagaaaaccatctttaattgtaacaaatggggtgggtagacgagcttcagagtgggagcagattgcattgaggttcaactctcccacccatgcctgggagtcaagtcttggagaggagtaacactcttggtggtcagcacagctcagagtcagagacaatagccagcaggccagcaaggctggctgtgtgaggcacaggaagcagggcataggtagggagcagagctgggggttctctctctgctggaagatagcagctgccccttggcatatgggggttgcacactgcaccttgtagccagggctgctatttgctgttctgtgaaggagttggccactcattgtgacatgcaggacagtggccttctgagaacctgctgcttgcttgcatagtgcagcacaagtgaggacaggcaggggtgggagcatttatggtgatcagatgtgcctggcaagcccctgttcagacattgctcacattccaaatgttttcgtgtagaatattgcacaggtctggggacgctctacctgtgccctgtgagtgttaataatggtggagaaagagtgtagctgtgcccttgagagagaaggtgagggaaagagtgcaccagtcagctgaccgtcagctggctaggctcttcactgagtcctatgtcgcagtgcacaaatcactgcccatcaggcctcagtttcctcatctggtaaatggtgataacatcaatctgcccccccgccagggtgctgttatgagggtcaaaagtggtagtggagggtaatactgggtgagtccattgtgtgtgggaggagaaaggctttacattcacctggtacatgaaggtttttctgcttcaggcagcacagcacagccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaca

SEQ ID NO: 9911 - DNA, 23979 bp, Homo sapiens
  misc_feature (9003)..(9003): n equals a,t,g, or c
tgcctcagcctcctgagtagctgggattacaggtgtgtgccaccacgcccggctaatttttgtatttttagtagagacggggtttcgccatgttggccaggctggtcagaatttttaaatgtttattttatatataatgtccagggtatttcaagggagaagtagggaaaagtacttctacttcatctttccagaagcagaagttcattctgttttgagcagtggtcagatctcttatttgagtacaggctgtctcataatagctcataacctgaattcacaaatatcaaatccctgtaaagataagccccttcctttttgtattattatttttccatcttttagaatacaaagtatatttttacaaaggaaaataatgtcaaggatgttgtcttcattcttatactcttccgtggcagcctataaaatcttttaacccttcaggcagctgccatcctgtacattcacatacactcacaaatacacacaaacaagttagtatcacagtgtcatcttcattaaaccatcacaaatatttaaaaaagacttttaaaaaatagatgtgagtttcactagtttgcagtactagtaacttgatagaactgaaaaacaagaggggtatttatttatcttgaatactaatatttgaggaaaagcaagtttgatcaccaaaggataggatggagaagtagagaacctggaggggtcatttgggtcctttagagagtggtaaaactagttcttctgattaccatcgcttggaaatgtcacccttttcttttttattggcttaagataatacctggcataaggtagatgctccataaagacagaactacagaggatgtttggaattgacagttggagtcagtgcacactgctttcctttagaggggcatacaatttactcagctcccaaaaaagtacctttcttattttgctttggggtgtttctgtcctgtctctaactgttttggtatctcattgactgtctctttttggctcaatgtcttcatatcttggcttatggttctttttggagttattgttgagagcctaagccctggtctcaaattgatcttgtagcctttccctatgtctgtcagggctttgtgccctataactctttttaaaaaatgttttaaaattaaatatttcaaatacttacgaaagtatagaagatagaacaaaaggaatcccctgattccttttgtggtgccttgaggtctcatcattggctaggcgtctgctgtaaaacccacagtgtcttctggcagttgacctggtcctgccgttggtgctgcaaacttagtagcttttatgtgtgggtcctggggcttttcacatttttactccccaatggaaggtgtggagaaatgggtcaaatggactgtgtaggatctgttggctggtagcctaatttttctttttgcctcctttgtgtttttatatcactgcagtttctacatgtatattgtggtaataattattcattcattcatccattccagacatggtctttattcttagaacttatattttggtagtggaaatgcaaaatcagtaaaatagagaacaaagaggtaggtttcctaagaatttaaaagagggagaaagtacttctagctggacaagtctgagaaggtggatttgagacagtctttgatttgcatttggatatggagagatgaaaggagtggcattgcagacacaagtgaagaatgcatagaggtacagagatgaagagtagtgtgcatctttggggttctgagatgaagaactgagatgccaaataaggttgcatccctagagttctttggaagagaggtccactggtatcctgttatcatcctatcaagtaaagggcctgatagtagaggatcctgtcaagtagaggatttgtgaaatacgatgtgtggacacatcctattggaaagacttatctgagctgtaatagccacctcactaatccctaattgcagggctgccactcacagatgtacaggttatgccctgaacaagcaccctgcagtgttaacagatagggctaaaacacagccaggctctgctagcagaaatggtgcaggcctgtttccaccaagagaggcatcctttcctaatctgcccaaggcaccacgagggttcagatctgtttctttctgtttcttaatggtattcacatatcactgtaatatgatttgctaaatgattgcctttagccatatgtagggattcagtcatcactttgaagactgactctgtatcaaacatttgcagaaattcagaaggacatgatctagaggtttcatttttgccttctgctttccttgtcaccagcattaggttagatgctcagaatctctccaccttcttctatctccttgcaagtgaggatatggcagctaaactgcttagtgcctatctccatgggtgacctgaagttcacaggtcactgacatcaatcctcgctgcttcagtgtctggtgcttcctgtctctttagggctgtcttgctctgtgtcctgctacctgccattactactgttggtcctgagccctctggtcctgcgtccgttcttctctattcctttccccatcatcccagttggcttaattctggaaagggagagactcattagagaaaaagaaaaagagaattacaactgcagaaaaggcagggaggataatgaagggaggaaagttgggagtgatatagcagtagaggccagggaaataacaataaaagcaacatttgcaattatagtaagaatgagggtgaaaaaccctagagtgggcatttcacaggtgggggtatttctggcactgtcatttgagcctcagtaacaaggtgaccttgctttcctcaggtgtcctcatgacttctcttgtggaccatgtccgtgatcttttttgcctgcgtggtacgggtaagggatggactgcccctctcagcctctactgatttttaccacaccccaagattttttggaatggaggagacggctcaagagtttagccttgcgactggcccagtatccaggtcgaggttctgcagaaggttgtgactttagtatacagtaagtgatcatattcactttttcagaatattagcaaaatttggattacttttaactacatgtagtgataatcttatgctgatcacattgtgtattaaaagtagatctagcatcagtggtctgagatcatgtgtgtctacaacagaatcataaaagaaatgggttttcttagagcctcaggaatggctgctccaacttttttttttttttttttcttttgaggcagagttttgctctgtcacccaggctggagtgcagtggcaccatcttggctcactgcaacctccgcctcctgggttcaagcagttctcgtgcctcagcctcctgagtagctgggatcataggcacatgccacgatgcccagctaatttttatatttttagtagagatggggtttcaccatgttgcccaggctggtctcgaattccagatctcaggtgatccacctgcctcgacctgtcagagtactgggattacaagtgtgagccactgcacccagccgtggctgctccacctcttaacttctgttagtggagtgcccatgagcattgggagacctgggttcatgtctttagttttgtagttttttcttcactcagatgcaggggaagagaaaaggtaaggagggaggagatactagattataatgtggggagggaaaataatgagagttagaaagccaagaaataagaaaaaaatttcatttttactttatttatacctttgctttttaattttttcacttttttatgttttaatttttcactttttaatttttatttatttatttttttgacacagttttgcccttgtggcccaggctggagtgcagtggcaaactctctgcacactgcaacctctgcctcctgggttcaagtgattcttctgcttcagcctcctgagcagctgggattataggcacctaccaccacgcccggctaatttttgaattttttagtagagacggggtttcaccatgttggccaggctgctcttgagctcctgacctcaggtgatctgcccaccttggcctcccaaagtgctgggattacaggcgtgagccactgcgcctggtcatttttaaatttttattatgtgacaggagcaggggagtgaaaaataagtgagagtaggtctcttttctcaaggaacttaaagtctaacaaggtaacaagagaaatatataactaactataatacagtggggaaaatgttccattggaagtaggaatcaagtgattacaataatcctggttacaataactgatattattgagtgttttctatatgccaggcactattctgtgttttatgtggctaatgatgtaggtaatagtgttacacctgttttgcagaggaggaaactgaggtaaaaaaaacttaactaagtttacactgttagtaatgggtcagcccaggatttgaatgcaggcagttaggcaccaaagtctgcttcttatgggttatacaatttcctgttctaggactcagagcaagaagccagtcattctatggaggcatcaggggcaaggcagattttagaatatcaaaatgacttgttagattttacgtctattttctcgttttagacctttacttagcaagtctcttttgctctccttatatttttattttttattttattttttagagacagggtcttagctgggtgcagtggctcacgcctgtaatcccagcactttgggaggctgaggcgggaagatcgcgaagttcaagaccagcctgggcaatatgataagaccccatctctacaaaaaaattaaaaattacccaagtgtggtagggtgcacctgtaccagctacttgggaggctgaggtgggaggattgctcaagccaggaggtcgaggccacagtgagccatgttcacacctcagcctccaaagtagctggaactctgtctccagatagataggtagattggatagattgattgattgatagatagcctcccaagtagctgagtctacacaccactatacccagctaatttatttttattttttagagacaaggtcttgccatgttgcccaggctggtcttaaactcctaggctcaagtgatcctcccgccttggccttccaaagccctgggattataggtatgagccaccttgccttgcacccttttgttctccttgaatagtaaatttttttttttttttttgagacggagtctcgctctgtcgcccaggctggagtgcagtggcacgatctcggctcactgcaagctctgcctcttgggttcacaccattcttctgcctcagcctcccgagtagctgggactacaggtgcccaccaccacgcctggctaatttttttttgtatttttagtagagacggcgtttcaccgtgttagccaggatggtctcgagctcctaacctcgtgattctcctgcctcggcctcccaaagtgctgggattacaggcgtgagccaccgcacccggccttgaatagtaaatttttagttgacctgctaagctgaggtccttttaggggaattcagtctcagaattataaaaacaaaaggaaaagtccaggcctgaccccaggctaggtggtaatgtcaggctagaagggccatgtcctgaagggggtgacaaataataggcacatgcagctgtcacctggtgatgtgggctctggatgtttaggagcaaacactgagttgcacctgcccacatgtgcagcccctttctctggacatgctgaacatgctgtccttgatggtctctcctttactatgctgtgattaactgatttgtacttcaaataggaaagcttttctctgttaaaggctatttttcacagaaaaaagaagtctaagacttcagatttaaatcctggatacttcagtagtattttggaaaaaggaataaaaaatgttctactcatttgtaattttgaattaaatatttaccattattttcgcagaggaaatagactttcttttcttacaggtgagcagtaccatagcttttaatagtaaggagtgtgttagttccctaaggctgccataacaaatgaccacaaactggcttcaaacaacagaattcgttctctcacaggtatcgcagggccatgttccctctacaaactttaaggaagaatccttcctaaacctctgctactttctggcagtcattggcaatccttggttttccttggcttgtagatgcgttactgcaggctctgtctccatggttgcatggtcttcttccttctgtctctgtgtccaaatttcctttcatataaggatactgatcattagatgagggcccaccctaatccagtatgacttcattttatcttggttacatcttcaaagactctgtttctttgagttaggacatcagtaaatctttttggggggacaaactcaacccacaccaggggtcctctttcaaatagaaacacctccatcctagagtggcctagacccttctgaaggatttcttccataaggaggagagttgtccttttttttagattggaaaagtttttatatagggagttacagtttcaaaaagttggtagaacaacataacctaaaaaccgtcctgctgaaaacatccagaaatgagggtaaatatatatcgacaattactttaaatgtgtagttaatcttgaaagaaagaaatcctaagatgctagaaatgaaaggggggcagaatattaaggtagtaagtgtgtgagcggacagtgaggctcctggcattcagtcaccataaaattggagcttggtttgggcttacataggatggagtgtcagaacaagacccttgtggctgggtgcagtggttcacgcctgtaatcccagcactttgggaggttgaggcaggcagattgcttgagcccagtggttcgagaccagcctgggcaacatagagagacccccatctctacaaaaacacgaaaattagccaggtgtggtggcacacgcctgtagtcccagctactcgggaggctgaggtgggaggatggcttgagcctgggaggttgaggctgcagtgagctgagattgtgccattgcactctagcatggatgacagagtgagaccctgtgtcaaaacaaaacaaaacaaaacactcttgcataaaggaaagttcttgtcaggccacaacctaatggaatggtgataggtgagggaaataattttcccattgatacagggtaactcacctctacttggctttgtgtgggaaggaaaaataaatttcacctaagaaattgaaatgttgttcttgcgcctcgtaaaaggttgaagttggagtgtatactccccaaagtctaggaattcctaagccaaggttgaaacatcagtattggtcccagagtgatgacactgctatggtagccagccagagcaaatgcagaaccacactggaagaagtgtgccacaacttgggcttcaggggattcttacaaaaaaaagtcccatagggatgagttctcagcaaaaaggacaaaacacaagaggagacattccacagtgagtgggagtcagtagacacacagataggtgacctagaacccctgtaccctgaacttgaaatgattgcatgacagcccaaaagggagtagaaaaagaagaaaagccctgtatttattttatgagaccaaaataacctaaataccacaatcagatgaagacagtataagaaaggaaaattataggccagtcttatttgcatagaaacaaaagtcccaattaaaatgttagcaaactaaatccagcagttgtatgtttatgaatatgtaggaacttagatccaacaagggcttattttaggatgccaggatcatttaacattaggaaatctgttgatgtagattaaagaagaaaaacgttttctcaatagatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcaggtaaggttgtgtctgggtgtgggatgggaatacatggggctgtttcctggtaatacagatattgcccttttgtttcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttggtttgtaaccctctttcatatttatttttctcttccatggtgttatatgtgtagaatttacagtttaggtttggctttgaccatcaaggaaaaccactggagatgcaaaaacatgtcattgaagaacagacttgtaccatgagatttcatatcaattgaagtgtcccggaaagcgtcaaggtttaacactctggcttttcatctccacagagcctgggggcagggtggaggaagggtgaaacgtgtaggttataacccacagctctctgaagctggggtcagcaaatgatggcccataggccagccgcctgttttataaataaagcagaacgtggctatgcttattcttttacatgttgtctgtggctgcttttgccccacgacagcagagttgagttgtgacagagaccatgtagccaccaacctaaaatatttactaactggcattgtaagaaacttttgttgacccctgccccagagcattactgctcaaagggtgtttaccatcaggaggtaagcacagaaagtgagaactggtgtttagaaattcttacagtaatttgacattcctgtgattattttttantgctttttttagagcagaatatcagtctgcggtggtttggaagtaagaaaaaaacagttccttgacccagaagtttgctctggaaaaatgatacttcttttctaggctctgccagaaaggccttgttgaggcttagagactttggaacacagcataataatcagtgtgtgccctattttggtcaggtgtgggtcattttgagctcttgggagaagaggaatggagatggcagttgggggacagtctgtgctctccgtgtaaacagctgctgactctgtgatgttcttaaacaaaggtttggcagcatttgttataaatggtcagggggcagaaccagcacctggaagtgttgccacttaggctttctggctactcctgccatagccctcacattccttcatgtgttctactggctagcccatcaggaatggggctagcaccctcttttggtgtcaccctggtaggcaggctccagcctggtaaagttctgcccctgagtctccctgtgaggtcttagtcaagcttgtgctctgggccacacttctttctctgaagagggctgctagtctaaaacagaccacagctgcagcatccctgggctgtgagttgatttggagctcggtagacctgtgttcttctctccccttatctctgcatgtgccttccttctaaagccatgtgcttgatctgatgggagccccttttccagcatcatgtttgctcattgttgagtgggagtagaatgagtcaaagtacactgagagtagaattatacagattttgctttgccagtttgtatgaaacttcaagaactgttcagatgtgataatggatttatactaacataaatttaagaattaaaatgaatacttttcaaatatataatcctagtttccacaacgtattcatttgtatttttttttcaaacaagccctttttttttgagttaatcaggtcaggaataactgtctccatttttcaagcttagaaatattctgtaaattgcctagggttgtaccgtactatcagaagtggtaaggggttaagacgcatgcccctttcccccgactctctcatcactgaggttctgtgatgcattattgcctttttagtcaatcacattttaattatcctgctttgaagtgattgatcagacagtgttcatattagcaatcatttggcctttgtgtttaacttgacgcttttcagaatctggctgatttattagctcttagaaatgtgaacttcagctgggtgcaatggttcacgcctattatcccagcactctgggaggctgaggcaggagaatcccttgagctcaggagtttgagaccagcctgggcaatacagtgagaccttgtctctacagaaaaacaatttaaaaatgaaaaaaattagccaggtgtggtggcacacatctgtggtctcagctacttgggaggcttaggtgggagaatcacttgagcctgggaggtcaaggctgcagtgagttgtgatcgcaccactgcactgcactccagagtgggcgacagtgagaccctatcttcaaaaaaaagaaatgtgaacttcattttgtacgtattgtcttataatatccattctgatgaaaatgcttaacttgtgttgctctctttttgcagacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctggtaagtggcttgttgttccctgatgttgatgaagtgatattgtgtatttcacatggacgttgatttttttttcactagaaagctatttttctggggagagggagtagtataaaatatgctgagaaaaatatgggcccatcctgtttcttggtggctgttataaaaactttgactacaggccaggcgtggaggctcatgcctgtaatctcagcactttgggaggccaagtcaggcggatcacttgagtccaggagtttgaaaccagcctgggcaacatggcaaaaccccatctctatcaaaaatacaaaaaattagccagaggtggtggctcgtgcctgtagtctcagctactgcagagactgaagtaggggaatcacctgagcccgggaagtcgaggctgcagcgagccatgattgtgagccactgcactctagcctgggtgacagaatgagaccctgtctcaaaaaagaaaaaaattgactattatgacagtggattggtttgaggggaaactattgtgatgaaattcaggagccgaagagtgacttggcaggttacttttgtttttcttttccttcttcttcttctttttttttttttcaaatagagacaaggtttcaccatgttacagcccaggctggtctcgaactcctgggctcaagccatcatcctcctgcctcggcctttcagagtgctgggattacaggtgtgagctaccacgcttagctggcaggttattttcttaattagggtgaagtctacaagtttattatttttaaattttatgtttttatttatttatttatttaagtccaagttgttctgacagaactacaagtttaaatgttataaagaagattcatctctctttcttctataagttacttattgaactgtatagattggtattatatatattatatatataatatatatattatatataaaatatatataatatatataaaacaattattatttatatatatatatatatagagagagagagagagagagagagaatccttatcatcttatttactgaaatgttgtagatctgaaacccccactcttcttgttggagggaggacagtggggatgagagcgttggacagggggctggagccagggcttctaacgttctcactgtctggctgtctctgagacctgggatctccctctatccctgtggatttcagagacctcatgtgaaggaagaggtcttaatgaacgtgatcacagtgtgctgatattccatgcctttgtcattaatgttattagccactcaatgcttatcacataacaaagtatgattttttgcattcctgtttatagttacatacaattaaactaatatttaattcaattggatatttatattcgaagaattctataatggcataagagctgaatcctttgctaaaagaagtgtctacactataatagtcttaattactttgtttttaactgttttatgctaaactcatttcttgaattttaaaagtgatgtattatattcatggttttgacttaactttgtgttttagtttaatgtgtttcaaccaatacttggattggctctcattccagtcaataagtgtttctagtttatgttgagaataaacttaatttttgtaaaaggaagactgggtaattgagctccaagattttcccttaccatatatgaatgcaggcatatctttgtaatgtatgttttgttttttaaacacttagacaagaggagcaaatccagaaagtgtcaccttgcccgtctttctaggacattttactgtgatttgatttaccctattgtcctgaggctagaatctttacaggtagcatattctgttctaacagtaacttttaattgctcagtggaaactctaacacactaacaataggcataagttggattgtggcgaggtatttgtgtgtgtgtgaaatataagtgtaagaaaggagtatagcgagagaatgggagggacaccatttaattgtgtgaaccaaaatcaatttcagtggttatctttacagagaaaatgagcatttgttctaattatagttctagaaacagcttgtaacctgaataatcaatgtttccctctttccaattattttagaattttaaaaattgcatttgctgtgaattgctctagaagtgcacgtgacatcgcatattgttattgtcagagaaagaggacaagttgaatgttgaggcatataatagaaatgctttaaacatttgacaaccaattacaaataaagccttggtcctctctggtagtataagaaactgttttatttacttacttatttaatttttttttgagacaggttcttgctctgtcgcccaggctgaagtaccatggtgcaatcttggcttactgcaacctccacctccagggctcaagctatcctcccaccttagcttcctgagtagcggggactacaggcacataccaccacacctggctaatttttgtattttttttttaatagagatggggtttcaccatgttgcccaggctggtcttgaactcctgagttcaagtgatcctctcaccttagcctcccaaagtgctgggattacaggcatgagctactgtgcctgaactttttttttttttttttttgagacaaggtcgctatgttgcctaggcttgagtgcaggggcgcaatcatggctcactgcagcctcaacctcccaggctcaggtgatcctcccacctcagcctcccaggtagctgggactacaggtatgcgtcaccatgcctggataagtttttgtattttttttttttgtagagacagggtctcactatgttgcccaggctggttttgaactcctgggctgacgtgatctgctgcctgcctcagcctcccagagtgctggcattacaggtgtgtgccaaaaattgttttaggatttttcagcctgatccctattgacatttttgcatcagataattctttattttggaggctgtcctgtgcattcattgtaggatgtttagaagcattcctggcctctatccactagatgccagtagcagcctgtctctagttgtgacaaccagaaatgactccagacatggccaaatatccactggggggcagattgcccctggttgagaaccactgctttagatagaaaggaaattaagcacttgaaaaacctgtgcttgcctggaaaagagcctttttctggaagaaactttactcaaatacccacatccattctgtccatcatttcttggcttttttccctctaacttctgctgcttttacaattaatatgtttgtaattctatgtttaacatagtgaacctatcattagtgtaggtctagttaatgtcttcgtttatttttctttcatgtagaaattacttacactagacacttgttttttttccattgtgaagctcctaatttccgaatggaaccagtgacagccctgggtatcctctccctcattctcaacatcatgtgtgctgccctgaatctcattcgaggagttcaccttgcagaacattctttacaggtaaccttttttttttttttaaaacagtttaaattgaaggacatatgatagaagaaagtgatagggatacattttatctataaaactgaggttttataatttttcaaaactaatatgaattttattataaattttattctttgtagtaagtgaatgaatatgaaggttgctcttttatgtctattgtcctaagaagcaggaggggcctgccaagatattggtaagaaatggagaatttgctacaaggacattagaccaccctgtggctcttgggaccccaggagtcactccagggactggattatttacccaggacaaaaggttcattctctgattttaaggttcaggttctttttctcctgagaaaaggattgttcccataatctgatttgtataatgcagatgccaccttccttgtgtctttgtcgaagaattatatgtcactaggaagttccttcactggtctgctcatttcaaaggaacttactatttcagtgctttttaaaaacagttttaaaattttgaagtattttgagaagtatttcaagaaggtatcggccgggtgtggtgactcactcctgtaattccagcacttctgggaggttgaggtgggtggatcacatgaggtcaggagtttgagaccagcctgatcaacatggtgaaaacccatctctactaaaaatacaaaattagctgggcgtggtggcgcatgcctgtaatcccagctactcaggaggctgaggtgggagagtcgcttgaaactgggaggcaggggttgcagtgagccaaaattgcgccactgcactctagcctgggcgacaaaagcaaaactccgtctcaaaaaaagaaaacaaaaacaaaaaagaggaggtataaaaccattattagcatcaacaaatagatattacttttaaagatagtgccaccatactcacacccatgcatatagtgggtaaagtctgaagcatgactgttgttgaacctcaggagactgatgtagactgacctgtttggagaatggcagcaggcctgtgttatgagtggtaactgcctgttaccacatcctgtctttgatcaatgtgtgttgtggtttctactcttattgtttatgattgctcttagccagatacttaccaactgtctgtttgtttgtatacattagaattagtacctggccagcaagatggttaagacatagtccctgccttgggggctctcatggcccaaaacagtgtatggtggcaatcctaaagaggcggcagtgcctggagatgggaggaattagagaaagctaggtcttaacagatgcttaggtttctgagaggtggagggattggcggcccattccaggttgcagacttagcacagtcacatggggacaggaggcacatgctgtgaccaagctgttgaaaacgattgtatgctaaccctgatctggtgcataaacaggaacttgtgtctcacccagccagggattttgtactgtcaaccataccagacagaaggcagagtaaagtgctttatgtcacagtgtttcctttcatctaaatatccctttccttgtgttccttgtatttgttttaggttgcccatgaggaaattggaaacattctggcttttcttgttcctttcgtagcctgcattttccaggtgggtgaaacgatattttggtcagtggattaaatccatgaccttactttgttcttctgttcatctatcagcaagtttctagatgtgatttttgttccaccaaggtcatggttcacatcatggacaataccaagcccttagtggaggaccttaggcccatcctggccagtcctctcattttacagaggaagaactttgtgctcataaagggaaagccccttgttcaaggccaaggggctattgacagcagcagaacagaaaccagcagtttggatttgacttcccagaagggagggatgagattacatagggattggattaggcctgactagtgagtggcaagatattgccttgtgcttattattaggacagtccaagcacagaaatgtccttctataaaagtagcatctgtgtacatgtagtttttaaaatataggtctaggcaggcattgtggctcacacctgtaatcccagtacttttcaaggccaaggtgggaggatcactttaggcctggagtttgagaccaaccagggcaacatagcaagaccccatctctgaactttttttttcttttttttttttgagacggagtcttgcactgttgcccaggctggagtgcagtggcacaatcttggctcactgcaagctctgcctcccgggttcacgccattctcctgcctcagcctcctaagtagctgggactgtaggtgcccaccaccacacctggctaattttttttgtacttttagtagagacggggtttcaccatgttagccaggatggtctcgatctcctgaccttgtgatccacccgcctcggccgcccaaagtgctgggattacaggcatgagccaccacgcccgacctctgcaaaaaattttttaaaaaatatatacatatataagactaggtcaaagaactgctgatttttttgttgttgttgttgttgttgttttaaatagtaataccttctgactcagacctgttctttaggaactgaagcaaacattagaacattaactagagggttttgattagttattttcatataagctgtgtactaaggggtggcataaagaggcgattttgagtccctcataggcagagttaattctagtgaaagcgtggctctaattctccttccttgtcctccgtatggactaggattttagcactgtctctgaatacatattttttctccctttttttaaaattaaaatttctgttcttaggacgctttccttctcttccacatacatcctagaatggtttattcttaagaattacccaggccaggtgtggtgactcatgcctgtaatcctagcactttgggaggccaagatgtgtggatcacttgaggccaggagttcaagaccagcctagggaaccccatctctattataataaaaatacaaaaatcagctgattatggtggtgcatacctgtagtcccagctacttgggaggcttaggcatgagaattgcttgaaccctggaggtggaggttgcggtgagctgagatcacgccactgtgttccagcctgggcaacagagaaagacattgcctaaaaaaaatgaaaaagcattacctgattatgcaaaaagaaattttcaacccatgaaaatgcattcattttttagaaaacaagtctccaagaccttggacatagccagtggcagtttcctagagctatgttttaggactgcagggattgtacagttccacctcattccttcaactgtgttcctggttggatagctcactccctccctctgtagattgaacctttgtcagattgatccatgttcagtgatgtcctttttttaaaaaaaaaaaacaaagcattgaaccaaaatgccgtttccaccttttgcagaacaagaatggccccttttatgtgtgatagtcatacacaaaataccagtcactctccctgctgtgagacctttccctgactcagagatgctttggaagacatgataaggagggtgcccaagggaagagtggtgctcaatgtagtcgtggctcaggagaaaccaaaatagtaaaagcatggctttctctcaccagcttgcttgcctgtcctggctccctgaagaaaaacttcactggggggccagtcagtcacgttagggtcccctgtctgcagcctggctgtctgcagcttatgtgcagctcttctttctctactgccaacagcctggtcatttctgtctatttctttaacttctttcagatgtgccatgcactgattcttcctgtgacatctatttcactttcctttaatcttccaaatcctcactttcgtccaataattagcagcctaaccagtgggtccacgctttactgtaatgaattcagtttaatcagctaatgtgagagaaatgacactcttcatggaagctgtgggaggtgaattttgcatatgatctagtggccattttatctctgattggaattcctcttctggtctcatttcagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatacagtaaaccacttgattcaataacactggttttagtcattgagagttgtctccaaggaaccactttaaaatccaaatcagctttcagtctaaacataacttgattagttttttttttcagagggtcagtacaggatgaattaaaaacctaaaaatatggttcataaatgtaagctagataaattttgtttacattttttcaatatcttaggttcgatatacctttggaatatttaattatattttggatataaattggacttcatttagggtgagggcaaacttaagctgagaaaatggttaagaaatctgagtttatttaatttatatgtaaccttttatagtggtgggactgtttgggtacagagatgttttatatttatttgcagggtatatccgaatattttaaaaattaattgaataaccagtacttctagatgataagtttgtcagcatgagcagaaatgagaatttcaggattacttacaattgaccacaacctggagtaggtgaatgaacatggattcagtggcactttacagatccgcttgggaggggctgctgtcatcagccttttcagtagagctgagtgcctgttgttttaatgatgatgactactgtaccctgtgtacctgttcccagagcgcctccaaaattaattactcctctgcacctttcccagtcatcttaattagcttgagggcctcattttttatgaacaagagttaagtatctgttaactttttaaagcttgatagagatataattaacacatactctggaaagttactctctttcactgtcaaaaaattgattgatcacagttttccaaaatatggttctggataagatcccttaggtttcccgaaatttcagcctggcttgttttgtaccacgcaggaggtcattttgggagtttgctctttggattgttcttggtagaagtctggaatctgaatagttcaaccacagttgcatggaacactttgagtgttcaactgcattatgtggtcttgataaatttttaaaaatcctattttgatagtttttaaaagtggaaaaccattacaagagttgagtggatagggaatgtaagaatgtagttttagaaaaattcaattatatttggttatcactggtattgtattgttattgagctaccttgttatcattttaagaaaaataagtttatatactgggaactatgttgggaaaatgttgccatagtaactttattttttataatagaattttctatttttgaccaaacataaaatatttggatatgggccaggcatgatggctcatgcctgtattcccagcactttggaaggccaaagcaggagactcggttgaggccagtagtttgagaccagcctggacaacatagtaagattcatctctacaaaaaaaaaaattagccggatgtgatggcacatgcctgtaatcccagcactttgggagtctgaggcaggaggatcccttgagtccaggagtttgaggcttccatgagctataatcacaccactgcaccccagcctgcatgacagagtgaaaccctgtctctaaaaagtctgaatatgaaaattatattggcagcatactcagacataaactccaaagttgtctctacactgatttcacatctgcataattttctgcatacccagcaggtgaattttcagtttttctgggagacaattttgaagagatggtgaaatagaatgggaagttaaggaggggaggtaaaatgttttaaatgagaagaacaaaaaagctttaaaagtcaataacactttgggaagctgaggtgggcagatcacgaggtcaagagatcgagaccatcctggctaacatggtgaaaccccatctctactaaaaatacaaaaattagctgggcacggtggcttgtgcctgtagccccagctactcaggaggctgaggcaggagaatctcttgaacccgggaggtggaggttgcagtgagccgagatcgagccactgcactccagcctggtgacaaagcaagactccgtctcaaaaaaaaaaaaaaaaaaagtcggtaagaacggcttaaaaatggactgttttcttttcctatgtggcattgggttgccatgtagacctgtaccccaggtgctttgggcatctgagcctatgatccatattcagcaggcagtaaagaaacggtccttgaagatgagtccttcctggtaatgcttcctgaccaccgaggcactaccagagatgttatccacaccaggtcgaatgtgtggatatcagttaacatctacatggggtgagattgacttttgcaaacaaaagggaaaagatgcactagaaaaacagtacaagtaatgaccacaaaaacattgtttgactgaaatccagctagctaaaagaatcctcagctcactgaaggaagagactgaaaataggaaagaagttctggtgatttcatccgagggaaatccccaggcttaggtttgacttggttcagggttggaggtttatagcctcttgtgtgatccttgataccagcaaactggttccaaatcccaggagttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagtgtacctggctttccttttcctgggtggagacagctggggcatattcgggtggcattccctctcagtaccagaggccccactgcctgcagctggaggcatgtgaccataagctcctgcttttgctttttgggcttgcatccctcttttctgtgaactctggagaatgctggaattaaaacatttaagcattttgattaaatgagcttgagctcctctgttcttttctaggtgctcttgttctccaactctcctgcctctttctacctctgccctatacattccagctctggagacagagtctgaaactggagtctctggagggatgagaaaaccatctttaattgtaacaaatggggtgggtagacgagcttcagagtgggagcagattgcattgaggttcaactctcccacccatgcctgggagtcaagtcttggagaggagtaacacttggtggtcagcacagctcagagtcagagacaatagccagcaggccagcaaggctggctgtgtgaggcacaggaagcagggcataggtagggagcagagctgggggttctctctctgctggaagatagcagctgccccttggcatatgggggttgcacactgcaccttgtagccagggctgctatttgctgttctgtgaaggagttggccactcattgtgacatgcaggacagtggccttctgagaacctgctgcttgcttgcatagtgcagcacaagtgaggacaggcaggggtgggagcatttatggtgatcagatgtgcctggcaagcccctgttcagacattgctcacattccaaatgttttcgtgtagaatattgcacaggtctggggacgctctacctgtgccctgtgagtgttaataatggtggagaaagagtgtagctgtgcccttgagagagaaggtgagggaaagagtgcaccagtcagctgaccgtcagctggctaggctcttcactgagtcctatgtcgcagtgcacaaatcactgcccatcaggcctcagtttcctcatctggtaaatggtgataacatcaatctgcccccccgccagggtgctgttatgagggtcaaaagtggtagtggagggtaatactgggtgagtccattgtgtgtgggaggagaaaggcttttacattcacctggtacatgaaggtttttctgcttcaggcagcacagcacagccatttcttctggcctttacaaaaaggcatttttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaca

SEQ ID NO: 9912 - DNA, 23885 bp, Homo sapiens
gcccacctgccgtttgctgtcattggcagcacagaagaactgaagataggcaacaagatgatgagggcgcggcagtatccttggggcactgtgcagggtgagtgagtctccgggaagggctacacacaggaagccccttttgtctgtctctttgtttgtccccagccactatatgacaagtttctaaattgtcccaagtctctgctcattcggcatgggtcccaaatagccataggggtcactagcaagctaactctggctccatactgggatgctctgatgggagcaagctccctctaatttctaatgggaaaggtattcctaaaacacaaggacttgcaaggtaggaaggagtgtgcgaaaaagcatgtgttcttgcccaagtgcacctgaagaatgttcacagtagtgttgtttgtaatgacaaataattacaaacaattcagatattctttaaaatagactggataggccgggcacagtggctcacgcctgtaatcccagcactttgggaggccgaggcgggcggatcacgaggtcaggagattgagaccatcctggccaacatggtgaaaccccatctctactaaaaatacaaaaaaaaaaaaaaaaaaaaaaaagactggatagtgggagggtgggagggggataagggatttaaaaaaactacgtgttggggctgggcgcggtggctcactcctgtaattctagcactctgggaggccgaagaaggcggatcacctgaggtcaggagctcgagaccagcctggccaacatggtgaaaccccgtttctactaaaaatacaaaaaaaaaaaaattagtcaggtatggtggcatgtgcctgtagtcccagctactcaggaggctgaggcaggagaatcgcttgaacccgggaggtagagattgcagtgagctgagattttgccactgcattccagcctgggcgacagagtgagattcaaaaaaaaagaaagaaagaaacataccattggattccctttgtatgaattccaaaaggaggcaaaactaaacaagatatatattcttaggaatgcatacataagaggtaaaactataaagaaaaacaaaggaatgataatccccaaagtcaggagaaggattaagtctctgccaggggagttgagggatagagggggatgagattgggaaagggcactcaggggcttccaaggtactggtaatgtttaacctgagttgtggagacattggtgttaatttttcaaaaattctttaaattgtacatacacatttcatgctctttgtatgtatgattatttcacaattgaaaagcaattagacatattgtattacactcaggaaagttccttctgtgatctgcctgacatatgttaacttaccctcagggctagtcagttcagtgcacaagacaaggccaaggatggcgctgtgggtagaagaggtctctggtcctcagagtctacagctagaaactgggccgtggctgataggggcatcgtgtgaaagagtggctggttctctgtaaactcatccctaccactggggaaacacctgaaagtggatggcgagttgtccacatcacatacgaaggctggcatgttttaggacaccccacacacccactggcaatagctggattttccataggtaggacaagactggttatcagagctgtgctaagttctggtcttctctgctgttcggagctggggatgctccactaggaacgtttgcaaatggtttctggacccacagtgtcccaccctgggaatggacttgtggtctgagaaacaggaacctgaagtgagacgaggagaagccagtagacatggttccaatgacttatttcatctgatgtggactactctgaacctaaacagaaaagggggttttgaaagtttttcttgtaagtctaagttgactgttccgcttgaatgaggaagaagttgtatattgctcaggcagcctgcagggccctcggaggcactccttctgactcaccattagagatcactgtccagagatggaggaggagatggcatatagcatagtcctgagaagttgtcttactgatgtcatctttaatattagcctgtgttctatgacagcagggggctttattcctaattcagtgggtcttaagcagagggattatgtgagctgattcgggctttggaaagattaatgaccacaaggtagtctgcttcaactatggctgacccacttatcccagacccttctctgccctcactaccctcttccagaccctgcaagacagaatctggggtgattgcctgttcacttcagacaccatttttcctacttgttcagggcaaataccaccatccgacacagtgaagccatacctgtagccaccttgacaaagtgctcctcgtgacctggtccagccagaaatcgattttgctatgacttggtccacatctgtcattcttgaccactgccccaaattgcagacctttgcttgcactcttttgaggaggggacttgttcacacaggccagaaagtggggtccccttgctcctagtcaccactgctactgtcaggccattatctaccttctaaagaaaccacctccttggaagcttctaccatccaggtgggccatgcctgcggtccacacccctccttgtcactgtcatctatcaatatcctagttctttccccttattctttggagactttgtcacctcccctacattgcctgggtttgaaccctaattctgcaacttactagctacataaccttgcctagcctcattgacactttgcaaacaccattcccttctctggctgataaattgctattcttccttccagagtcatcttagagattttctcttcggtgaagtcttcactttcccaggagttcttaggttcccctcttctgagctttattgcaacttggctatccctctatttttgtagttgtgcactgaattgtatttgtctatttgtatctattcttcctctaaactataagctcctgagagcaagattccatcacttcgtttctgaattcccagtgcctcacacaatactgggaacagagattccacaaatattgattggatggatggatggatggatggatggatggatggatggatggatagatagatggatggatgagtggatggatggatggatagatggatggatggatggatggatgagtggatggatggatggatggatggatggatggatagatggatggatggatgagtggatggatggatggatggatggacagatgcatatatgctgttgtcctacaagtggtgcagaccaaacattcttttgagggttctgactgctgaatttagattgtggtgctactgactgtcttaataagtatttttatgatatcacagtttttcattactggcatttttgtaacctttcatttacattttcagtagaaaagagaggaggtaaatttgcaggatctaaatacacagattgcaaggcaacgtcactgttagacattttgcctctcgtttcatccatttctgcttctgctggccttcctttcaacatactttcaataccccaaatcctgctatgcagttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcaggtaccgctcctgccagcccagcccagcccagcccagctcagctcagcccactcaggtggtgtggaagccttcccctggagaattcacaggggaggcgagacacgggtgctaagacctcaaggagcaggggcgactcacttgccagttctgcttgcctgttcaccctttgcctctgcacacctgccaggagagctgtggggagcaggcttgggaagtaccgccgccttgcttttaagggcaagggaagggaggatgcccagaggaccagcaaggctgatcaccacacacacatgcacgcatccatgacagctccaagcagctgcgctggggggaatccccaagctggggccctgttccacgaggtggcagttggtaactgtcctctgcccctctttcttcatcaggctcctggcgctcagacaggtttctagtctgttctttacccatttccccattctcaaacccagataggaccaggtagcatgcccttgccatgcatcgatgaactgcaggctctccaattgctgtccttagtgtctgcattcaagtgcaagttctgttttgaccgcaggatgttgatcatcactgccatatttcttaaatcagaatgcttttagagaaggggaatgtttttgaaagcaggttattatgcagagaggagtaatgcgccaagtagaagtgtctgatctatatgcgtgatgtgtgaaataagccccacagttgaaattaccacgtggtgccctttatggtggtcaggcattaataagcaagtgagggagatgtctaccagttaaaaaggctttcaaagagcctctgagatcttactctacctgtgcacagcctaaagctggcctggagtcagagcctaaccagtcccttggggatatttgcttcaggagggacaggctcatgccctatatactgacaggtggggctgggggaagccatgcttgtctttttctggtgggagctccctggctgtcttccccacctgcagctttcatctgcatttgtagaggagtaggtgtgcctccacctggtcattttgtctccttccctcctccttcactccatcctgaatacctctgtttcctgtgtcttcgccttcttcactccttctctgccagctccttcccatgctgcatgtaagcattcttgtgctgaagaaactctcccttaaccctgctctttcttaccagcctctgtcctgtcaagaagtccttgacaggatgaggagaaagagttgttctatgtttactggttcctcttccccatctctcattcattcctcaatccactgcagtctggcttctgtccccagcataaccactcaaatgcctctctccaaggccaggaatcgcagacttgtggccaagttcaatgtggcctttggtttccatcttatttgatatcaacgcagcactttatgccattccccactgcctccttgaaatgctctctgcctttggcttttctagcactggcctggctgattctattcctatctctcctactatttcttctcagcctcctttgcaggctcgttttcttcaccttactcctttaaatgttgatataccccccgggattctttcctagagcctctgctcctttcactttctgttctctttgcagctggttctttctactctcacagccctaattaccacctagaagtagatggttcccaagctagtcttacttctgaggtctaaacccattaatccaactgcatcctggatgtccactcagacatcccatagaggacctccccgaaaatcaagctctgtacaaattcatcttctgccctcttaagcatgtgtctccaacattccctgttgccattcatgataccaccatccacctggttgcccaaggataatcagaattacctttggctcctcccaagtcctgggagttctgcttcccttactgctccctccattccctcccagcccttaacattaagatcctatcacttcttcttttcttttctttctttttttttttttttttttgagacagagtcttgctctatcgcccaggctggagtacaatggcacaatctcggctcactgcaatcttggcttcccgggttcaagcgattctcctgcctcagcctccccagtagctgggattacaggcgcccaccacctcacccagctaatttttgtatttttattagagatggggtttcaccatattggccaggctggtcttgaactcctgacctcaagtgatctacccaccttggcctcccaaagtgctgagattacaggcatgagccaccacacctggccaagatcctgtcacttcttacttggattgatggacagtctatccttcccacagcacagccggaatggtccttctcattttcaaattggatctagtactacttcctgctttaaaaccatgcagtgtgtacatatccaatttttaaatatggcattcaaagcctgttctcttcctccaggctcaggaactttgtctgcctctactccaccactgccatggtgctctctggccatgttgaaccatacctggctccccaagaatgtcattctctcttcacacctgctttcttacatgctgccctctttggatcacagttccacctcttcttcaccaggctattgcttttttttttttttttttgagatggagtctcactctgtcacacaggctggagtgcagtggcgcaatctcggctcacttcaaccttcgcctagcaggttcaagtgattctcctgcctcagcctcccgagtagctgggattactggcgcccactacgacgcctggctaattttttgtattttttagtagagatggggtttcaccatgttggccaggctggtctcgaactcctgacctcaggtgatccacccgtcttggcctcccagagtgctggaattacaggcgtgagccactgcacccagcctatctcctatttctttaaaaataagcttaggccaggggcatctcccactagaccatgagttccttgatggcaggtatgatggctgttggctctagaggctgagtgactagcatcatgtcaattagtactgagtctagcacatatggagtctcctcaagcatttgttgaaatagttcattaatgtggtcagtttcagagccagggcctggcagcattgtgcagtgggaaaacccagatgaagagacaggagactcagcttctggtcaaagttctccctctaactagccgtggggccttgagtaagacacctcacctctctgggcctcagttttctcatccgtagaacaagagtatagaaccagatattctaagtctctccagttcactagggttgccccatccccctccagaatccctgtgggcatgctgtcatgggccaagccaggtgcccacagctttgtggttctatttttgtacctggctcacaactggggaagggaggacagaggaacccagtgaggatctttggggccagttttatcaaataggaatcattccaaaggaagaagaattaacctgaccatgttcgcagtttacaggagacatatgaggccaaaaggaacgagttcctaggggaactccagaaaaaagaagaggagatgagacagatgttcgtccagcgagtcaaagagaaagaagcggagctcaaagaggcagagaaagaggtaaatgtgagcctggtgattattaaaatgtcaagaaacaacagctgctggtgagactgtggaaaaataggaacgcttttacactgttggtgtgaatgtaaattacttcaaccactgtggaagacagtgtggtgattcctcaaagacctagaatcagaaatgccattcgacccagcaatcctatagatcactttattataaagatacacacacacatatgttcactgcaacactattcacaataggaaagacatagaatcaactcaaatgcccatcaatgatagattggataaagaaaatgtggtacatatacaccatggaatactatgcagccataaaaaggaatcagaggatgttctttagaaggacatgagtggagctgggagccattatcttcagcaaactaacacaggaacagaaatccaaacattgggccggacactgtggctcacgcctgtaatcccaacactttgggaggccgaggtagttggatcacctgaagtcaggagttcgagaccagcctggccaacatggtgaaaccctgtctctactaaaaatacaacaattagtggagtgtggtggcacatgcctatagtcccagctacttgggaggctgaggcaggagaatcgcttgaatctgggaagtggaggttacagtgagctgagatcatgccactgcactccagccttggtgacagagcaagactccatctcaaaaacaaaaaaaaagaaaggaaacacttaattacttcacgattctcttccacatttaacctgtcacactctcaagggttctcaccaaagcccatgacaagggtattgattttttttttcagtttcacttaaaaaaaaaaaatgtctgttggctgggcgcggtggctcacgcctgtaatcccagcactttgagaggccaaggcgggcggatcacaaggtcaagagttcgagaccatcctgcctaacacggtgaaaccccgtctctactaaaaatacaaaaaaattagccgggcgtggtggcgggcgcctgtagtcccagctactcgggaggctgaggcaggagaatggcgtgaacccggaaggcggagcttgcagtgagccgagatcgcgccactgtactccagcctgggcgacagagcgagactctgcctcaaaaaaaaaaaatgtcagacaggtgccttggctcaggtctgtaatcccagcactttgggaggcttaaagcgaggggattgcttgagcccaggagtttaagaccagcctgggcaacatactgagaccctgtttctattaaaaatagaaaaaattggctgggcgcagttgctcacacctgtaatcccagcactttgggaggtcgaggtgggtggatcacgagttcaggagtttgaggccagcctggctaatatggtgaaaccctgtctctgctaaaaatacaaaaattagccaggtgtggtggtacgcacctgtagtcccagctacttgggagactgaggcagaagaattgcttgaacccaggaggcggaggttgcagtgagccgagattgtcccactggactccagcctgggcaacagagcgagactccatctcaaaaaaaaaaaataattacaaatacaaaaaattagccaggcatggttgcacgtgcctgtagtcccagctacccaggaggctgaggtaggaggaatgcttcagccgagagatcgaggccactgcattccagcctgcgtgacagagtgagactctgtctcaataaaaaaaacaaaaatgtcacccagcacttttaggaggagaagtgaggggatctcaaagacaaatgaataaaagtgcaacaaacaaaaaccaggttaaggcaattgataggcagccctagtgactagtaagagctgctttaggccaggcgtggtggctcatgcctgtaatcccaacactttgggaggccaaggtgggcggatgacaaggtcaggagatcgagaccatcctggctaactcagtgaaaccccgtctctactaaaaatacaaaaaattagccaggagtggtagcacgtgcctgtagtcccagctacttgggaggccgaggcaggagaatcacttgaacctgggaggcggaggttgcagtgagccgagattgtgccactgcactccagcttgggcgacagagcgagactctgtctcaaaaaaaaaaaaaaaagaaaagaaaaaagaaaagatctggtttatacagcaagtctgtcactcacccacctaagtgacagtgccaaatacccccaggacccggagaactaaccttcttcatcgtatgctgcaagtgctacagaatcctaaactctctcctgaatccatgaaagaaagtgaaattcggcttgctctgctcttactattcagggtagtttattgcattctagtttgtgactgtctgtgcctcttgttctctgatccacttaccacaatggcatgccagaatattctttttttttttttccgagacagagtctcactcttgcccaggctggagtgcagtggtgcgatctcggctcactgaaagctccgcctcccgggttcaagtgattctcctgtctcagcctcccaagtagctgggattataggcaagcgtcaccacgcccagctcatttttgtatttttagtagagacgaggtttcaccatgttggccatgctggtctagaactcctgaccttatgccacccaccttggcctcccaaagtgctgggattgagccgactactgggattacagcactcccaaagtgctggtattacaggcgtgagccactgtgcctggcccagaatattcttcttgttcttctttgggtttctggttctattcaggactaattaagcctccctttagttaaggctgaggtgtctgtactcattccatgtcataaagtcctttttatttccttccatgtccaaagccaagtatttccttgactggctttcccatactgaagttttctctgagatccatggtgatccttcctgattgcaggggttaagaaaagacaggggttccttacacataagaggtcccattatataatgttctaaatactgggttgaccatagtcaaattccttacttctcagaccttctgtttcctcataaaatggagataataacggaacctacctcataggaatgtggtaacaattaaataaattaatatacataaaggacttataaaagtcagtgcttagcctgtaattactcggtaatttctttttttattttttgagacggagtcttcctctgttgcccaggctggagtccagtggcacaatcttggctcactgcaacctccgcctcctgggttcaggtgattcttctgcctcagcctgctgagtagctgggactacaggcacatgccacaatgcctggctaatttttgtatttttagtagagacggggtttcaccatgttggccaggctggtgtcgaacacctgacctcaagtaatctgcccaccttggcctcccagagtgctaggattacaggcctgagcccggccagcactcagtaaatgttatattattataattgatgttattattgaccatgtgtggtaactatggggactctttttaacaaaatgtctgactaaacacaatgcagtattcctttaccatattcaggagcagagacttggagataaaatggcaggaagagagaacgatccagagcatggtgcctttggtgccatcatagcaatccctgacagaaatgccccctgaggttccagggtcctgcagggtcacagccctactggtccccacccacctgggcttggccaggctggggactgctcacaggggattctctccaatctccctgtgcttccctgccagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaaaagcaaaggagagtgagagagcagaagggaagaaaaaaattagaggtgcagcaatataagagaggaacaaggccgggcacggtggctcacacctataatcccagcactttgggaagccaaggcaggaggaacacttgaggtcaggagtccaagaccagcctggcctatatggcgaaaccccgtctctgcttaaaaaaaaaagaaaaaaaaaataggctgggcacggtggctcacacctgtaatcccagcactttgggaggccgaggcaggcagatcacaaggtcaggagatcgagaccatcctggttaacacagtgaaaccccatctctactaaaaatacaaaaaaattagctgggtgtggtggtgggtgcctgtagtcccagctactcgggaggctgaggcaggagaatggggtgaacctgggaggcggagcttgcagtgagcagagatcgtgccactgcactccagcctgggcgacagagcgagactccgtctcaaaaaaaaaaaaaaaaaaagagttcaagaccagcctgaacaacatggtgaaaccctgtctctactaaaaatacaaaaattagccaggcgcggtggcgcgcgcttataatcccagctactcaggaggctgaggcaggagaattgcttgaacccaggaggcagaggttgcagtgagttgagatcgcaccactgccctccagcttgggcgacagagcgagactccatctaaaaaaaaaaaaaaaatacagaaattagctgcctgtagtcccaactactcaggaggctgaggcaggagaatcacttgaacccgggaggtgtaggttacagtaagctgagatcacaccactgcactccagcctgggcaacggagtgagactccatctgaaaaaaaaaaaaatagaaaagaaagagaggaacaaaaagaactgcagctacgggccgggcgtggtgtaatcccagcactttgggaggccaaggcgggtggatcacttgagttcaggagttcgagaccagcctggcctacatgatgaaaccttgtctccactaacaatacaaaaaattagccaggcgtggtggcgtgcgcctgtaatcccagctacttgggaggctgagcaggagaattgcctgaactgaggaggcagaggttgcagtgagctaagatagcaccattgcactccagcctgggcgacagattgagactctgtctcaaaaaaaaaaaaaaaaaaaaaaaaaagaagtgcagatacaggatagtggaagaaagagagagcctttagcagaaactcggtgcaccctctccccacccttgccctatatctgaggttgctcacctctccatggccgtagtcccaccctcaccctgcctcagttattactctctgcagccaacagaatttaactgctgccagtgaaggctgcagctcagccctgatttcccacccctttgtgatccctccctgctggcttagttctgcctagcctggggtgctgagaacttatgggggagccctcagatgccagtgtatgctgcatgtgccccatcctcaatctgtggaatgactgtaagaccttctgatctcccctggtattagaacagtggctcctggataccatgtgggtcaataatcctcacccaaccccagtctctgcttgctgaagttacccattcctcatcccagaactggagaaaaatatttcaacgggatctagaaaaactcctgtggtgcccttgtgccctgcagttgtttgtgcagtgtggcttgaggagttcccaggtggactgtttagctgtgtctttactgaagggtactgaggatccaaaaggtgtccatggtcattgccttctgttttcagccatttgttcctggacttaactatgggatatttttgccagaaggaagaaacaccttcctttcctctggcttatcacttaggaataacatggtaacttttgcataacagtaaaatatgttatatttgaaggcattcagctttgcaatccaattactctttatgcaaatgtgtaatttaaacatcttggccgggtacggtggctcacgcctgtaatcccagcactttgggaaactgacgcaggcagatcacctgaggtcaggagtttgagaccagcctgggcaacatggcgaaaccccgtctctactaaaaatacaaaaattagctgggcatggtggcccacacctgtagtcccagctactcaggaggctaaggcaggagaatcacttgagcctgggaggtggaggttgcagaaccaagatcatgccactgcacttcagcctgggtgacagagtgagactttgtctaaaaaaaaaaaaagaacatcttcaccaattagtccagaaatttttcttactgaatcttaatactatatgtcaaattcactgatgaatgaaattttttggtattacctgatggataaagttcaactagccagaaaaaagtctctttggacacaccctgtactgtattaacttatctgtcatggtgtattagttgcaccagcaggaatgaattcctatttttaagatcagaaaaatctaaatttgtcatccagctgtaacctgctgccttcatagtcctgtggtatttgttaactcagtacctggggcagtttcatagcctgcttgtgggagttaggaattggtttgttcaggctacaatgaaactataaatattccctattcagatgttcagtaaaagttcttcttacatcaagctttccccttgttgcctcatactgactgacttctcccaccccaggcaggagaccccaacagggagatacccctctctactcttcaggaatatttggggttggtgacagtgcccctttccaattctgaaatgggtgaaaaccctgctggcatgtggcaccttatattagcaataagggcctaacagaatgacctgtcttcttctgtacttccagatgcagaagtggccctgaatcttggcttcttatgtaatttcatgagcaatttgttaacttctggaagagccaccgttagacctgtgctaccctcctcccatagtcacggtagtgagttttgagggcagaaatggtggtagtagtatttcttcttgagagatggtggttggatctaagagtcacatattcagaatttcctttagctgcccctaaagagattaagaaagtactggccagccgtggtggctcatgcttgtaatcccaatactttgggaggccaaggcgaaggattgcttgagtccaggagtttgagatcagcctgggcaacatagtgagacctttgtctctacaaaaaaaataaataaataaacattagctgggcctggtggcacttgcctataatcccagctactcaggagactgaggtgggagaactgcttgaacccgggaggttgaggctgcagtgagccatgattgcgccactgcactccagtctgggcaacagagagagaccctgactcaaaaaaaaaaaaaaaagagtatcagtgtttcaggggttcctaccagtccacccttcccacttccccttcctgctactcctaatcacctttgacctctaacccttcattgtttgtgtcaagtcataatatttgatttcccctcatgctcactccatcttcatcagctcttactgttttacagttaactctgctgtttgctgcatgctgcatgagacccagggtcctggtaagcttgattaactctaaatagaactggcagtggcttctagaacatatctcccccaatcccgcacccccaacacaagcatctaatcgtagaagaagctgcttcattggtctagctggttttctctcgtgacttataatatgcagaaatagtctggtgtggtttcaggtgtacatgtggaatgcctgcctgcctgcctgattaaagtgaggggtcgttttcagacttttgctgctagaacagctgggtaacacaggtggatcctgtgatcagtatttgaggtttcagtgtgggaagtttttttcttaaagagccataatcgggccggacgcagtggctcacagacctgtaatcccagcactttggtaggccgaggagggcagatcacctgaggtcagaagattgagaccatcctggctaacacggtgaagctccatctctactaaaaatacaaaaaattagccggacatggtggcacaggcctgtaatcccagctactctggaggctgacacaggagaatcgcttgaacctgggaggcggaggttgcagtgagccgagattgcaccattgtactctagcctgggcaacaagagcgaaactccatctcaaaaacaaaaggagctataaccattattttcaaaattaatgaaaccgtggtgatgagagaaactgggtttcacaagctccgtcctgcaatgtcacagtcagcatcaaccctctcccatccccctgcatcaggtttgagaatgtccagagtcaatggaaactcacttctctgtttcccgctggtggcagtttcatatctgaggggttcaagtcctcaaatttcctttgactgtacccctcaaaaccataataaggctgagagcagtggctcacgcctgtaatcttagcactttgggaggccgaggcgggcggatcacctgaggtcgggagttcgagaccagcctgaccaacatggagaaatcctgtctctactaaaaatacaaaattagccgggcgtggtggtgcatgcctgtaatcccagctactcgggaggctgaggcaggagaattgcttgaacctgggaggcggaggttgcagtgagccgagatcgcacctttgcactccagcctgggcaataagagcgaaactccgtctcaaaaaaacaaacaaacaaacaaacaaaaaaaaaaacaaaaaaaaaaaacccataataaaagcggaggaaaatgaagagatcttagaaattatagagaattccttacatttaatcctacaagtactggcttcatgaaaacctcttataaggagatcagcaggtaaggattcctgagtgctagatgttgtgttaatagaagtttataaagtttcacatagtttatagggagactgaaagcagggattaaggaccttctatctcctctactagactcaggtagtggatggaaaggaaatacaaacatttttaatttaacataattagggttttttttgtttgtttgtttctttttttgagacggagtctcactctgtcaccgaggctggagtgcagtggcacaacctcagctccctgcaacctccgcctcctgggttcaagcaattctcatgcctcagcctcccaagtagctgggattataggcatgtgccaccattcctggctaatttttgtatttttagcagagaccgggtttcaccacgttggcccaggctggtctcaaactcctgacctcaggtgatctgcctaccttggcctcccaaagtgctgagattacaggcgtgagccaccgcgcccgatgaagggttattattattttttttaaactttaccgtggaaactttcaaacatgagcaaaataagaggataatacagttcagcccccaggcaaccataaacatatgcctaatcttgtttcatcaattactacagacctgctgaattattataaagcaaaactatatcattttatctgtaaatactttagtatatatttccaagagataatgattctttaaaaaaacataaccacaaccccaccattatcacacctacaaaatgaacaataattcattaacatgaaatgtctagtcagtgtttgaaacatcccggttgtctcataaatgcccttttacatttggtttgtttggatcagggaatataaaatatagagaagacttttccccactcacccatgtagtttatgatttaaatggagagcctgctgttagtcaccaaactgattgccgcagctattgcactggggactcggggcagctggcaaaacatcctgcttggaagcaaatcctgaagaggaagtccatagaggtttctgcaacataaggcccatgaaaccgggccaaaggaaacaatcttaaaagaacagtgacttgatttactgtctggcttaacagcaagtcttggagcccctgctagttgactggaattaaacagcagatttccatttaggaagacagtcagttcctagaatgcctgtccattctttgcactgtatgtagttccagtgcgtagtgaagtgtctgacatgtaataggaactcagttcatgtgttatgttctttgttctcccatttttaatgaggtgagcaggaaatatgtattctagttaatgagatttcagttaattcaggtttcactgcacgtggcttgacacagttgcttacaggtttccccaagtaaatcattgttagtggccattcctaaaatgaattctggcaaaactataattaaagctacactttacaagtgagaggcaattggtaaacagctggaacagccaaccccaaccccaagtaggttggctcttcctggcaggattctccctggcagaccacgaaagcaatttcagaccaacgagtcaggggaggctttggctccccaggatctgaaagcagcaaaggcaacccgccccctcctcaaagccctcattcaaggggtggatcacgaaggccacctagaatgcaggcagagtgaggcttactgtgcctccacattttgaaattgcttgaggcactacttatagctctctgcatttgtaaaagcgattcctttgtgaccccctacatcgttgcagatactctacctcaatcattattggtccttaggagtgcacagtatatggatagtatacacacatcaaaatacgtcagccttcccatgaaacctagaacataggccattgcagtgttttttagattactcttcccctaggaagtagacaaagaataaaaataagatatgagcatttgtatagcttttattactttccaaagtgtttttttttgttgttgttgttttgtttttgtttttgtcttttgtatagtatctcattttatacttacaacaggtctgtgaggtagagaaggaataatccccagtttgcaagatgagtaaatggaagctgggcgaggtggctcacttatgtaatcctagcactttgggaggctgaggtgggaggatcacttgagcccaggagttggagaccagcctgggcagcatggtgaaaccctatctctctattttttttttttttttttaagagagttggctgggcatgatggctcacgcctgtaatcccagcactttggaaggccgaggcaggaggatcacccgaggtcaggagttcaataccagcctggccaacatggtgaaaccctgtctctactaaaaatacaaaaattagctgggcatggtggcgggtgcctataatcccagctacttgggaggctgaggcaggagaattgcttgaaccccagaggcggcggttgcagtgagccaagatcgcaccattgcactccagcctgggtgacagagcaagactccatctcaaaagaaataaaaatacacacacacacacacacacacacacacacacacacacacacacacaccagctctgggcccagctgtgactctttgcagccacaggcaagtctgttgacttctctgtgtttcttggtctactcatatgaaatggggatcagttctacttgctgtatttatgtcacaggaatgaaatttacatggaagagaggtcaaagtattatttaagcacaaaccaatgatgggtttccatagttcacattttcaggtaactgtggtctggaccctagaacagagttctgcaatcatccccatatgctctgcaaacaggtcttgccccagagtaccagttagctgactaggacagctctaaggatctcctggggtgaaacctcagcctcctctactttcccaatgggacaggaaatgcagtggctagagcctggggctctatccagtggcctgaggccacttagagatttgtggaaggtattcctgtacaaggtattgggtggtggtgctgggggtgggtggtggtgctgggggtgggtggtgggggacactagtcaggacctagtcattaagaagagataggccgggctcagtgcctcacgccagtaatcccagcactttgggaggctgaggcgggtggatcacttgaggtcaggagttcgagaccagcctggccaacatgatgaaacccccgtcgctactaaaaatacaaaaattagccgagcgtggtggcaggcgcctgtaatcccagatactcaggaggctgaggcaggagaatcgcttgaaattggaagatggaggttgcagtgagccaagatcacggccactgcactccagcctgggcaaaagaccaaaactccatctcaacaacaacaacaaaaaagagccgggtgcagtggctcacgcctgtaatcccagcactttgggaggccaaggcgggcagatcatgaggtcaggagatcgagaccatcctggctaacacggtgaaaccccgtctctactaaaaatacaaaaaaattagccgggtgtggcggcgggctcctgtagtcccagctgctggggaggctgaggcaggagaatggcgtgaacccgggaggcagagcttgcagcgagccgagatcgcaccactgcactccagcctgggtgacagagcaagactctgtctcaaaaaaaaaaaaaaaaagaaagaaagataaaatgtatttttgtggttgttgatcattattttgctggctaatgccactgctgccatcatgtgggagtgtgtgtggagtgtatgagagagaaagcatgttccccggagccaatgcaataagaccttaagaccatctaacatagctatattctaatttagccattagtcctcattacttaattttcttctgacttttttttttttttggtacattaatctatccattcattaactcagcttctcttttcattttcagtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaactggtgtgtggtgttcttaaaaccttctcagcagatttccc

SEQ ID NO: 9913 - DNA, 16555 bp, Homo sapiens
cagtttacaggagacatatgaggccaaaaggaacgagttcctaggggaactccagaaaaaagaagaggagatgagacagatgttcgtccagcgagtcaaagagaaagaagcggagctcaaagaggcagagaaagaggtaaatgtgagcctggtgattattaaaatgtcaagaaacaacagctgctggtgagactgtggaaaaataggaacgcttttacactgttggtgtgaatgtaaattacttcaaccactgtggaagacagtgtggtgattcctcaaagacctagaatcagaaatgccattcgacccagcaatcctatagatcactttattataaagatacacacacacatatgttcactgcaacactattcacaataggaaagacatagaatcaactcaaatgcccatcaatgatagattggataaagaaaatgtggtacatatacaccatggaatactatgcagccataaaaaggaatcagaggatgttctttagaaggacatgagtggagctgggagccattatcttcagcaaactaacacaggaacagaaatccaaacattgggccggacactgtggctcacgcctgtaatcccaacactttgggaggccgaggtagttggatcacctgaagtcaggagttcgagaccagcctggccaacatggtgaaaccctgtctctactaaaaatacaacaattagtggagtgtggtggcacatgcctatagtcccagctacttgggaggctgaggcaggagaatcgcttgaatctgggaagtggaggttacagtgagctgagatcatgccactgcactccagccttggtgacagagcaagactccatctcaaaaacaaaaaaaaagaaaggaaacacttaattacttcacgattctcttccacatttaacctgtcacactctcaagggttctcaccaaagcccatgacaagggtattgattttttttttcagtttcacttaaaaaaaaaaaatgtctgttggctgggcgcggtggctcacgcctgtaatcccagcactttgagaggccaaggcgggcggatcacaaggtcaagagttcgagaccatcctgcctaacacggtgaaaccccgtctctactaaaaatacaaaaaaattagccgggcgtggtggcgggcgcctgtagtcccagctactcgggaggctgaggcaggagaatggcgtgaacccggaaggcggagcttgcagtgagccgagatcgcgccactgtactccagcctgggcgacagagcgagactctgcctcaaaaaaaaaaaatgtcagacaggtgccttggctcaggtctgtaatcccagcactttgggaggcttaaagcgaggggattgcttgagcccaggagtttaagaccagcctgggcaacatactgagaccctgtttctattaaaaatagaaaaaattggctgggcgcagttgctcacacctgtaatcccagcactttgggaggtcgaggtgggtggatcacgagttcaggagtttgaggccagcctggctaatatggtgaaaccctgtctctgctaaaaatacaaaaattagccaggtgtggtggtacgcacctgtagtcccagctacttgggagactgaggcagaagaattgcttgaacccaggaggcggaggttgcagtgagccgagattgtcccactggactccagcctgggcaacagagcgagactccatctcaaaaaaaaaaaataattacaaatacaaaaaattagccaggcatggttgcacgtgcctgtagtcccagctacccaggaggctgaggtaggaggaatgcttcagccgagagatcgaggccactgcattccagcctgcgtgacagagtgagactctgtctcaataaaaaaaacaaaaatgtcacccagcacttttaggaggagaagtgaggggatctcaaagacaaatgaataaaagtgcaacaaacaaaaaccaggttaaggcaattgataggcagccctagtgactagtaagagctgctttaggccaggcgtggtggctcatgcctgtaatcccaacactttgggaggccaaggtgggcggatgacaaggtcaggagatcgagaccatcctggctaactcagtgaaaccccgtctctactaaaaatacaaaaaattagccaggagtggtagcacgtgcctgtagtcccagctacttgggaggccgaggcaggagaatcacttgaacctgggaggcggaggttgcagtgagccgagattgtgccactgcactccagcttgggcgacagagcgagactctgtctcaaaaaaaaaaaaaaaagaaaagaaaaaagaaaagatctggtttatacagcaagtctgtcactcacccacctaagtgacagtgccaaatacccccaggacccggagaactaaccttcttcatcgtatgctgcaagtgctacagaatcctaaactctctcctgaatccatgaaagaaagtgaaattcggcttgctctgctcttactattcagggtagtttattgcattctagtttgtgactgtctgtgcctcttgttctctgatccacttaccacaatggcatgccagaatattctttttttttttttccgagacagagtctcactcttgcccaggctggagtgcagtggtgcgatctcggctcactgaaagctccgcctcccgggttcaagtgattctcctgtctcagcctcccaagtagctgggattataggcaagcgtcaccacgcccagctcatttttgtatttttagtagagacgaggtttcaccatgttggccatgctggtctagaactcctgaccttatgccacccaccttggcctcccaaagtgctgggattgagccgactactgggattacagcactcccaaagtgctggtattacaggcgtgagccactgtgcctggcccagaatattcttcttgttcttctttgggtttctggttctattcaggactaattaagcctccctttagttaaggctgaggtgtctgtactcattccatgtcataaagtcctttttatttccttccatgtccaaagccaagtatttccttgactggctttcccatactgaagttttctctgagatccatggtgatccttcctgattgcaggggttaagaaaagacaggggttccttacacataagaggtcccattatataatgttctaaatactgggttgaccatagtcaaattccttacttctcagaccttctgtttcctcataaaatggagataataacggaacctacctcataggaatgtggtaacaattaaataaattaatatacataaaggacttataaaagtcagtgcttagcctgtaattactcggtaatttctttttttattttttgagacggagtcttcctctgttgcccaggctggagtccagtggcacaatcttggctcactgcaacctccgcctcctgggttcaggtgattcttctgcctcagcctgctgagtagctgggactacaggcacatgccacaatgcctggctaatttttgtatttttagtagagacggggtttcaccatgttggccaggctggtgtcgaacacctgacctcaagtaatctgcccaccttggcctcccagagtgctaggattacaggcctgagcccggccagcactcagtaaatgttatattattataattgatgttattattgaccatgtgtggtaactatggggactctttttaacaaaatgtctgactaaacacaatgcagtattcctttaccatattcaggagcagagacttggagataaaatggcaggaagagagaacgatccagagcatggtgcctttggtgccatcatagcaatccctgacagaaatgccccctgaggttccagggtcctgcagggtcacagccctactggtccccacccacctgggcttggccaggctggggactgctcacaggggattctctccaatctccctgtgcttccctgccagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaaaagcaaaggagagtgagagagcagaagggaagaaaaaaattagaggtgcagcaatataagagaggaacaaggccgggcacggtggctcacacctataatcccagcactttgggaagccaaggcaggaggaacacttgaggtcaggagtccaagaccagcctggcctatatggcgaaaccccgtctctgcttaaaaaaaaaagaaaaaaaaaataggctgggcacggtggctcacacctgtaatcccagcactttgggaggccgaggcaggcagatcacaaggtcaggagatcgagaccatcctggttaacacagtgaaaccccatctctactaaaaatacaaaaaaattagctgggtgtggtggtgggtgcctgtagtcccagctactcgggaggctgaggcaggagaatggggtgaacctgggaggcggagcttgcagtgagcagagatcgtgccactgcactccagcctgggcgacagagcgagactccgtctcaaaaaaaaaaaaaaaaaaagagttcaagaccagcctgaacaacatggtgaaaccctgtctctactaaaaatacaaaaattagccaggcgcggtggcgcgcgcttataatcccagctactcaggaggctgaggcaggagaattgcttgaacccaggaggcagaggttgcagtgagttgagatcgcaccactgccctccagcttgggcgacagagcgagactccatctaaaaaaaaaaaaaaaatacagaaattagctgcctgtagtcccaactactcaggaggctgaggcaggagaatcacttgaacccgggaggtgtaggttacagtaagctgagatcacaccactgcactccagcctgggcaacggagtgagactccatctgaaaaaaaaaaaaatagaaaagaaagagaggaacaaaaagaactgcagctacgggccgggcgtggtgtaatcccagcactttgggaggccaaggcgggtggatcacttgagttcaggagttcgagaccagcctggcctacatgatgaaaccttgtctccactaacaatacaaaaaattagccaggcgtggtggcgtgcgcctgtaatcccagctacttgggaggctgagcaggagaattgcctgaactgaggaggcagaggttgcagtgagctaagatagcaccattgcactccagcctgggcgacagattgagactctgtctcaaaaaaaaaaaaaaaaaaaaaaaaaagaagtgcagatacaggatagtggaagaaagagagagcctttagcagaaactcggtgcaccctctccccacccttgccctatatctgaggttgctcacctctccatggccgtagtcccaccctcaccctgcctcagttattactctctgcagccaacagaatttaactgctgccagtgaaggctgcagctcagccctgatttcccacccctttgtgatccctccctgctggcttagttctgcctagcctggggtgctgagaacttatgggggagccctcagatgccagtgtatgctgcatgtgccccatcctcaatctgtggaatgactgtaagaccttctgatctcccctggtattagaacagtggctcctggataccatgtgggtcaataatcctcacccaaccccagtctctgcttgctgaagttacccattcctcatcccagaactggagaaaaatatttcaacgggatctagaaaaactcctgtggtgcccttgtgccctgcagttgtttgtgcagtgtggcttgaggagttcccaggtggactgtttagctgtgtctttactgaagggtactgaggatccaaaaggtgtccatggtcattgccttctgttttcagccatttgttcctggacttaactatgggatatttttgccagaaggaagaaacaccttcctttcctctggcttatcacttaggaataacatggtaacttttgcataacagtaaaatatgttatatttgaaggcattcagctttgcaatccaattactctttatgcaaatgtgtaatttaaacatcttggccgggtacggtggctcacgcctgtaatcccagcactttgggaaactgacgcaggcagatcacctgaggtcaggagtttgagaccagcctgggcaacatggcgaaaccccgtctctactaaaaatacaaaaattagctgggcatggtggcccacacctgtagtcccagctactcaggaggctaaggcaggagaatcacttgagcctgggaggtggaggttgcagaaccaagatcatgccactgcacttcagcctgggtgacagagtgagactttgtctaaaaaaaaaaaaagaacatcttcaccaattagtccagaaatttttcttactgaatcttaatactatatgtcaaattcactgatgaatgaaattttttggtattacctgatggataaagttcaactagccagaaaaaagtctctttggacacaccctgtactgtattaacttatctgtcatggtgtattagttgcaccagcaggaatgaattcctatttttaagatcagaaaaatctaaatttgtcatccagctgtaacctgctgccttcatagtcctgtggtatttgttaactcagtacctggggcagtttcatagcctgcttgtgggagttaggaattggtttgttcaggctacaatgaaactataaatattccctattcagatgttcagtaaaagttcttcttacatcaagctttccccttgttgcctcatactgactgacttctcccaccccaggcaggagaccccaacagggagatacccctctctactcttcaggaatatttggggttggtgacagtgcccctttccaattctgaaatgggtgaaaaccctgctggcatgtggcaccttatattagcaataagggcctaacagaatgacctgtcttcttctgtacttccagatgcagaagtggccctgaatcttggcttcttatgtaatttcatgagcaatttgttaacttctggaagagccaccgttagacctgtgctaccctcctcccatagtcacggtagtgagttttgagggcagaaatggtggtagtagtatttcttcttgagagatggtggttggatctaagagtcacatattcagaatttcctttagctgcccctaaagagattaagaaagtactggccagccgtggtggctcatgcttgtaatcccaatactttgggaggccaaggcgaaggattgcttgagtccaggagtttgagatcagcctgggcaacatagtgagacctttgtctctacaaaaaaaataaataaataaacattagctgggcctggtggcacttgcctataatcccagctactcaggagactgaggtgggagaactgcttgaacccgggaggttgaggctgcagtgagccatgattgcgccactgcactccagtctgggcaacagagagagaccctgactcaaaaaaaaaaaaaaaagagtatcagtgtttcaggggttcctaccagtccacccttcccacttccccttcctgctactcctaatcacctttgacctctaacccttcattgtttgtgtcaagtcataatatttgatttcccctcatgctcactccatcttcatcagctcttactgttttacagttaactctgctgtttgctgcatgctgcatgagacccagggtcctggtaagcttgattaactctaaatagaactggcagtggcttctagaacatatctcccccaatcccgcacccccaacacaagcatctaatcgtagaagaagctgcttcattggtctagctggttttctctcgtgacttataatatgcagaaatagtctggtgtggtttcaggtgtacatgtggaatgcctgcctgcctgcctgattaaagtgaggggtcgttttcagacttttgctgctagaacagctgggtaacacaggtggatcctgtgatcagtatttgaggtttcagtgtgggaagtttttttcttaaagagccataatcgggccggacgcagtggctcacagacctgtaatcccagcactttggtaggccgaggagggcagatcacctgaggtcagaagattgagaccatcctggctaacacggtgaagctccatctctactaaaaatacaaaaaattagccggacatggtggcacaggcctgtaatcccagctactctggaggctgacacaggagaatcgcttgaacctgggaggcggaggttgcagtgagccgagattgcaccattgtactctagcctgggcaacaagagcgaaactccatctcaaaaacaaaaggagctataaccattattttcaaaattaatgaaaccgtggtgatgagagaaactgggtttcacaagctccgtcctgcaatgtcacagtcagcatcaaccctctcccatccccctgcatcaggtttgagaatgtccagagtcaatggaaactcacttctctgtttcccgctggtggcagtttcatatctgaggggttcaagtcctcaaatttcctttgactgtacccctcaaaaccataataaggctgagagcagtggctcacgcctgtaatcttagcactttgggaggccgaggcgggcggatcacctgaggtcgggagttcgagaccagcctgaccaacatggagaaatcctgtctctactaaaaatacaaaattagccgggcgtggtggtgcatgcctgtaatcccagctactcgggaggctgaggcaggagaattgcttgaacctgggaggcggaggttgcagtgagccgagatcgcacctttgcactccagcctgggcaataagagcgaaactccgtctcaaaaaaacaaacaaacaaacaaacaaaaaaacaaaaaaaaaaacccataataaaagcggaggaaaatgaagagatcttagaaattatagagaattccttacatttaatcctacaagtactggcttcatgaaaacctcttataaggagatcagcaggtaaggattcctgagtgctagatgttgtgttaatagaagtttataaagtttcacatagtttatagggagactgaaagcagggattaaggaccttctatctcctctactagactcaggtagtggatggaaaggaaatacaaacatttttaatttaacataattagggttttttttgtttgtttgtttctttttttgagacggagtctcactctgtcaccgaggctggagtgcagtggcacaacctcagctccctgcaacctccgcctcctgggttcaagcaattctcatgcctcagcctcccaagtagctgggattataggcatgtgccaccattcctggctaatttttgtatttttagcagagaccgggtttcaccacgttggcccaggctggtctcaaactcctgacctcaggtgatctgcctaccttggcctcccaaagtgctgagattacaggcgtgagccaccgcgcccgatgaagggttattattattttttttaaactttaccgtggaaactttcaaacatgagcaaaataagaggataatacagttcagcccccaggcaaccataaacatatgcctaatcttgtttcatcaattactacagacctgctgaattattataaagcaaaactatatcattttatctgtaaatactttagtatatatttccaagagataatgattctttaaaaaaacataaccacaaccccaccattatcacacctacaaaatgaacaataattcattaacatgaaatgtctagtcagtgtttgaaacatcccggttgtctcataaatgcccttttacatttggtttgtttggatcagggaatataaaatatagagaagacttttccccactcacccatgtagtttatgatttaaatggagagcctgctgttagtcaccaaactgattgccgcagctattgcactggggactcggggcagctggcaaaacatcctgcttggaagcaaatcctgaagaggaagtccatagaggtttctgcaacataaggcccatgaaaccgggccaaaggaaacaatcttaaaagaacagtgacttgatttactgtctggcttaacagcaagtcttggagcccctgctagttgactggaattaaacagcagatttccatttaggaagacagtcagttcctagaatgcctgtccattctttgcactgtatgtagttccagtgcgtagtgaagtgtctgacatgtaataggaactcagttcatgtgttatgttctttgttctcccatttttaatgaggtgagcaggaaatatgtattctagttaatgagatttcagttaattcaggtttcactgcacgtggcttgacacagttgcttacaggtttccccaagtaaatcattgttagtggccattcctaaaatgaattctggcaaaactataattaaagctacactttacaagtgagaggcaattggtaaacagctggaacagccaaccccaaccccaagtaggttggctcttcctggcaggcttctccctggcagaccacgaaagcaatttcagaccaacgagtcaggggaggctttggctccccaggatctgaaagcagcaaaggcaacccgccccctcctcaaagccctcattcaaggggtggatcacgaaggccacctagaatgcaggcagagtgaggcttactgtgcctccacattttgaaattgcttgaggcactacttatagctctctgcatttgtaaaagcgattcctttgtgaccccctacatcgttgcagatactctacctcaatcattattggtccttaggagtgcacagtatatggatagtatacacacatcaaaatacgtcagccttcccatgaaacctagaacataggccattgcagtgttttttagattactcttcccctaggaagtagacaaagaataaaaataagatatgagcatttgtatagcttttattactttccaaagtgttttttttttgttgttgttgttttgtttttgtttttgtcttttgtatagtatctcattttatacttacaacaggtctgtgaggtagagaaggaataatccccagtttgcaagatgagtaaatggaagctgggcgaggtggctcacttatgtaatcctagcactttgggaggctgaggtgggaggatcacttgagcccaggagttggagaccagcctgggcagcatggtgaaaccctatctctctattttttttttttttttttaagagagttggctgggcatgatggctcacgcctgtaatcccagcactttggaaggccgaggcaggaggatcacccgaggtcaggagttcaataccagcctggccaacatggtgaaaccctgtctctactaaaaatacaaaaattagctgggcatggtggcgggtgcctataatcccagctacttgggaggctgaggcaggagaattgcttgaaccccagaggcggcggttgcagtgagccaagatcgcaccattgcactccagcctgggtgacagagcaagactccatctcaaaagaaataaaaatacacacacacacacacacacacacacacacacacacacacacacacacacacacacacacaccagctctgggcccagctgtgactctttgcagccacaggcaagtctgttgacttctctgtgtttcttggtctactcatatgaaatggggatcagttctacttgctgtatttatgtcacaggaatgaaatttacatggaagagaggtcaaagtattatttaagcacaaaccaatgatgggtttccatagttcacattttcaggtaactgtggtctggaccctagaacagagttctgcaatcatccccatatgctctgcaaacaggtcttgccccagagtaccagttagctgactaggacagctctaaggatctcctggggtgaaacctcagcctcctctactttcccaatgggacaggaaatgcagtggctagagcctggggctctatccagtggcctgaggccacttagagatttgtggaaggtattcctgtacaaggtattgggtggtggtgctgggggtgggtggtggtgctgggagtgggtggtgggggacacctagtcaggacctagtcattaagaagagataggccgggctcagtgcctcacgccagtaatcccagcactttgggaggctgaggcgggtggatcacttgaggtcaggagttcgagaccagcctggccaacatgatgaaacccccgtcgctactaaaaatacaaaaattagccgagcgtggtggcaggcgcctgtaatcccagatactcaggaggctgaggcaggagaatcgcttgaaattggaaggtggaggttgcagtgagccaagatcacggccactgcactccagcctgggcaaaagaccaaaactccatctcaacaacaacaacaaaaaagagccgggtgcagtggctcacgcctgtaatcccagcactttgggaggccaaggcgggcagatcatgaggtcaggagatcgagaccatcctggctaacacggtgaaaccccgtctctactaaaaatacaaaaaaattagccgggtgtggcggcgggctcctgtagtcccagctgctggggaggctgaggcaggagaatggcgtgaacccgggaggcagagcttgcagcgagccgagatcgcaccactgcactccagcctgggtgacagagcaagactctgtctcaaaaaaaaaaaaaaaaagaaagaaagataaaatgtatttttgtggttgttgatcattattttgctggctaatgccactgctgccatcatgtgggagtgtgtgtggagtgtatgagagagaaagcatgttccccggagccaatgcaataagaccttaagaccatctaacatagctatattctaatttagccattagtcctcattacttaattttcttctgactttttttttttttggtacattaatctatccattcattaactcagcttctcttttcattttcagtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaa

SEQ ID NO: 9914 - DNA, 887 bp, Homo sapiens
cacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaa

SEQ ID NO: 9915 - DNA, 511 bp, Homo sapiens
ggcaaatgggtcagaatatctgagatcatggcctgtttctgcaggcaggctaagaaactttccccataggctctttacctgttggtgtaaagcccttttgggcaaagccccacctgggctcacctggtcagtaaacattgattccgtggttccatctggctgtggtgacttagcacttacaagctggctagctccttgtggattacggctctgtgagtgtttcctaggccccatactgccaagtcggggcagctctctcttctctcatccataaagccaggccaagctcctcattttccctgtgagcaccaagctcataaacctatttgtcctttgcctttctttcctctttccctagccctaccactgccattcaggaagtatttattaagcacctactatgtacagggtaccagaccatatacttgagcccttgatcacatactatcttatatgacttgagttatgtaatttgggcttcctcaacaagactgtaagctcctagagggcg

SEQ ID NO: 9916 - DNA, 887 bp, Homo sapiens; identical to SEQ ID NO: 9914

SEQ ID NO: 9917 - DNA, 3693 bp, Homo sapiens
cggtccagtaggatggataatgttcttatttcacagatgaggaaactgagaacaggaaggtgagttacagaactctggctactgttctgctcatctcccagccccgtgaattttcatctctctcttcccccagtttatttatggagattcttagttcctgttcagattgtgatgagatccaattcatggtagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacactagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggt

SEQ ID NO: 9918 - DNA, 2155 bp, Homo sapiens
ccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaataactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacagag

SEQ ID NO: 9919 - DNA, 18053 bp, Homo sapiens
aggaacgaagatgccgaggagcctgcctacggagacacggccagtaacggagatccccagatccacgtgggactcctgtgagtacagaccctaccctgtttcccctggggctgggctggagactgggcccaacccgtggctcccacctgcacacacagggctggagggacccttgttacccgaggtctgaggtgaggggacagaggtggcaggaaggagtgacagggaaaagtggctccactgttgtcttccaacatggagattcacagctgagagccgccacttcctggagctgggggctccggcaggcaaagtgtggctctcggggacagttgcgcccgtgtctgccaggagttggttctgctcactgcagcacaggtagcggactccctccctcaccgtcaaggaagtaatccgctggttggcaggacaacaatttttggtttctaattacagtgtcaataagggcagtgactgtgaggtgcccctgaggaaaacagggtgtttgggtcccagccatttcctttgctcactctcgtcacttcagtccagggctcctccacctggcatggttggcatttggtcattctttgttacggggactgtgctgtacctgggctttacccactaggtgcagatgtctcctgcagatagggtggggcagaatcccaggcagtggatggccactgctgcagttgagtcagaaggatggttttacttggggggcacctgccgtccatgactcgtgtctggtttcctaggcgcgacagtggcagcgagtgtctcctcgtgcacgtgctgcagctgaagaacccggcggggctggcggtgaaggaagactgcaaagtgtaagccaggccccagggcagtggccagccagccacatggctgaggagggaaaagacagtttgggagcctgaatttccaggaaagcaccagggagtgtgtgtctgaagtgtaaagtcttcaaaagagtctagtgaatgatttgaggccggtgaaggtgccggtgctggtggcaagctagtgtgtgccgtgttggcgtggaggaagcacttgcctgtgccgtacaggactgcatcctcctggcccggggatggggttgctgatgtcgtcgtgctctgctctgtgatcttgagagacctctggctgggaccagggcatccttgactgagcggggaggaggaaataggcattgggagcagctggtgactttggcctcgatcgtgggagcgctgcctctctgagctccgtggccccagatgggggcctgatggagggtcccacttacccaagcaggtgaccatgcctgtaatggtctgttcaagtcgcagggtggggcccctttggtgagtcttctaaaggcctcaggatccctgagtgtgagcagctgggggctcggctggggttcggccaccccaatgacctctgcagtgctcacagatggctcagcccctcccatgtgccagacttggggcagggagggtgggaaatacgggctaccccatgggtgatgggcagagaaagcagtgggggagccatgcagaaaaaccagaggggcgattcccaaaaaggtggggagcagcagggcctggaagcatccgctgcttcagtcctggcttggaagtcatcctccttgtgagtgacttcccccatccctggggtacatcgttctatgcttagttgagaaaggaactttttgcaaaggactctgagactgtagccacagctgcccaaagggggctgcacgtggggggtctgtgcgcattgtgtaggtcgcgcctgccctgggactgcgccatctgtgagcgccgcctgcacgcgctcttccctcccccgttctgtttgcagccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctggtatggcgccaggctccgcccgccccgtcctccttccttccttcgtgtttcagtcagccggtcttttttttgtgtgtatctttctttcccttctttctcttgtactcttttgtgatgctttcttaggtttcgtatgtctttgccttttggcctccctctctctcttctgcctccatctctagttccctccctcctttcccctctgccatcctccctttctcccgtggtgggttgcttggaagttgtgatcttcttcagtgtttctgtggctggaaatacaaacagggatgatccaaccagtgatgttgtcaagcaccttgtcctctaaatgtgtcctctcaactagtactcacgaccctgtgggatgcctttgcgtcagccccatcttcagtccagggaacaaagtagggttgacagatttagcaaatagaaatacaagacagtcagctaaattcgaatttcaaataaattatggatgctctttaaagtgtaagtatttcccatgcggtgtttaagactcacagggaaaccctgtgttgtttatttgaagtgcagattcacctgggcgccctgcacgttacctggcaaccccggggcgaggcctcaggagaatccgcagtttgtcctcagtatcccagccatccaaggcccatgccagggttggaagccagggtggattccttccatggccagagtgttctgtcttggttctgtcccctcagcggcacaattagggcatgtagagttcagcagtcgtttcttatttcagaaattcctgagcgaatctgcctcatcactgcagtagagctgtgagcctggcccagcactccaggttgcccattcttttgccctttctgatcccttcccagcactttctgattgggcggaacaggcgaccagggagccacccattagactcctctgcagttgctttcattgtgctgcagtcctttaagtaggaatgaaatcttttatgtcttgtttggttaagattgaagggtagcctgggcacagtggctcatgcctgtaatcccagcactttgggaggccaaggcgggtggatcacctgagctcaggagtttgagaccagcctggccaacatagcgaaaccccatctctactaaaaatacaaaaattagccgggtgtggtggcgcacacttgtaatcccagctactcgggaggctgaggcgagggaatctctcgaactagggagggaggtggaggttgcagtgagctgagatcgcaccactgcactccagcctgggcaacggagcaacactccatcacacacacacgcacacacgcacacacacacgcacacacacaaagattgaagggtgaactggatttttttgagacagggtctcactctgttgcccaggctggaatgcagtggtatgattttggctcaccacagccttctgagtagctgggaccacagttgtacatcatcatgcccggctgatttttaacttttttgtagaggcagagtcttgctctgttgcccaggctggtctcgaactcctgggctcaagcaatcctcccacctcggcctcccaaaatcctgggattacaggcatgagccacctgccctgcctgaactggatattttaaaggactctagtcatcacggcgaaatcattcagtgcctgttctggcatttctttaatacccctgcagggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggtacttggccctgctctaaggagctgatcactgctgccttcgtgaccctgagactggctttgtcttggggaagtcatttcttagaagtgtctttgtagacgtaagtcagtatagtggggtaaaggagtagagtttccatatggccattgcatgcgaatgtttttttaatgcaaatgtgttcatggtcatgggtggtacactggctagttttaaatatgagccctcagagctgcaggagaaggccacatgaatgcctccaccacagacctaggtagggtgagtttcttctcacggaagggcagcagagtggcctcctacctgtgccatgtggacacctgccgtgtgcgcagggtctgctggcctgagctgtcctcacgcaccccctcttcctgcaggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggtaagggctagctcagcgggcaggctccggctcatgccctccctggaaaggagcatgggtgccctgtggtcagaaggctcgtgaaaactgtcaggggggagcacattttctctggggagacagccagtgtgccaggcagcatggctgtctctgaggtgcacttgctttcctcagccatgcctccatagaaggtgctgggcaatccttaggcaccactgcccagaagtcgattctggtggaaattgagtgctggtgtggacgagggcagctccccgaagtctctctcctgactctcacgtgtgcttttcaccttttccttctgtctgtcctggagtttcttgtcgagagtgggactgttgaagcactgccctctcccaggattggatacagtaaggtcccttgaagttgttggatttttttcttttttaacacctgtattgagatataatgtacctcccatgcagttcacccgtttaaagtgcacagttaggtggtttttaggactgaatgggcacagtcaattttacagcattttattttcatcacacactctctgcctgtccctagccaaatgcgctcccaggttctcctctgattccctgcaactacaaatctgccctctgtgtctatggacttgccggtctggacacttcctacaaatggggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggtttggggctgagtggtgcagttttctgggatcttcagtggctgccattggtgacagagaaagcccctcttaagtacagtccttcaagagccatcttccctggaaaacagaagcgcccttttactttatgagagatgcaacagtcttcaatcattggaaagaaataggttgtattgcattacctctactactgtgctctaagagtagcatgaaatacatcccgtttggtgaccatttgggcttctgcaatgtccgccttcaggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggtaagtagaaaacataggagattgtccggagcccctcaccccaaatattttgccatacgtaccaggtatactgccctggaaggagaggctgtgtgcccccaaattcttcgtgagaagtgtgaggggatgggggaagatgcaccaaaggcaagcagagccgaggctcccggggaggagagccacgtggctgacctgcacacacacacgcagtggcccgggtgttgtggtgtaaaatgggcactgctgttggatttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccggcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaaaaaaaaaaaaagaacacaaactcccaccctcgagagggaggcgccaaaggagacattgctatcatacgttcatgtcacagagagcaaggcggcttctggagaatgcaatggcagggaagcggacaaacacttgtagagaggtttgcagttttagaaagggttcacatttagaaatgtaaatttatatttacattttacaaacatcaggatgataaaagggtgcaactgctatggaaaacattatggtggttcttcaaagcattaaaaatagaaccaccacaggatcccgcagtcccgcttctgggtatatctgggtgtatatccagaagggttgaaaggatcttgaagaaatatgtgcacacccatgttcatagcagcagcattattcacagtagccaaaaggtggaagcaactaaagtgtccatcatggatgagtggataaagaaaacgtggcctatccatgcaatagaatattattcaaccttaaaatggaaggaaattctgtcacgctgcaacatggatgagctttgaggactcatgctgagtgaataagccagtgtgaatatttatttggtcttcaactctttgagttgcatgttacctggcatgcaactcctaaaatccttagaatctgaaaatctgtcgcccaggctggagtgcagtggcgcgatctcggctcactgcaagctccgcctcccgggttcatgccattctcctgcctcagcctgaaaaaaaatctttttatatgctaatgagttactggtggctggctaagagaatagaaaagcacaaaaagacaaataccgtcgtgaggttcctggagtagtcgaattcacaggggcagaaaatagaatggtggctgccaggagcttggatggggtgcggggatgtgttacagaacggaactggggtccattcgcccggtgcagtaaaaccaggtgtctgcacgaaggtgttttgcactggtggaaagagggcatttatttgcaggtgccaagcaaggagatttgggcagctcacatttaagactcagcctccccatgccttgcagggaagggtttttaaaggcagaggtaaatttcaggaaagcggaagtcacaggcaaaatcctaaaccaatccatggaggttacacgttgcttttggcctagaaggataggatatcttaatgtgggggcttacaggacgtagatggattcaaagattttctgattgcaattggttcaggaggcaaagctttgtctaaaaatttggggtcagcagaaaagatagttagctctgacttgtaggtgtgactccctccagacccctcaggaagagattcagaataaagagcaagggtcagagtgcagtcctcagctcccccttatctgagatctgtgccagcgggtccctttggtgggggtctgggtttctgaaagacagtcggggacatatgttaagatgtctttggtttctttttttcttttctttttttttttgagatggagtctcgctctgtcacccaggccgcagtgcagtggcgtgatctcagctcactgcaacctctgcctcttgggttcaagcaattctcatggctcagcctcccaagtagctgggattacaggcgcccaccaccatgcccagatgaatttttttttttttttaagtagagacggggtttcatcacgttggccaggctggtctccaactcctggcctcaaatgatccacctgccttggcctcccaaagtgctgggattacgggcgtgagccaccgcacctgaccaagatgtctttagtttctctaggcaaccaaacatctccagactctaacttccttggctattgttttaggctactattaccttcttgcttatcaggttacttacttacatctcagggatagcgaggtacctggaatttcccttgaaagaaattgattttcctttatttccatgctcgggaggtctgcaggcccctaaaatggggtctctgctctatctcaggagtgggaatggggagttgtttagtggagaggacagagtctcagatttacaaggtaaagaagttctggagatctgttgcccatcagtgtgaatggacgccactgaactgtgcctgtacaaatggttaatatggtaacttttgttgcgtgtttttttcccacaatattttaaaaaacagggccctgaagggcctcactgagaaggcagtgtttgagtagagatcgtcaaggaagggagctcagagctttgtgcagaagcatgggcaggtgtgggagcagccagtgtgtgttgtggggcggtgctgaggacgaagggagtgtgttgtggggcccactcaggacccttccttttctctgagggcatgagaagctggtgggttttgagcccagtggcaacatgatctgactgtagcttttttgttagtgctttctaaaatttattgagttgaagttcacataaagggaagcattttaaagtgtatgcatcagtggcatttggtccacagtgttgctcacccgccacctctatctagtttcatgacgtttcaatcaccccagagtaaaacccgtccccattgagcagtcactcccattcccctccccctagccacctgcagccaccaaaatctttctagctgtgtggatttacctcttccggatgtttccagaagtggaatcatatactatgtggcctttgccgcatggcttctttcactcagcacgatattttcaaggtttatttacattttagcgtgtataaacactccattggtttttatggctgaatgctattcccttgtgtggataagaccacatcttgttgatccattgatctgtcaatggacatttggggtgtttccacatttggccagttttcctgggatgtccctggttgctgtgttgagaatagatcgaagggcagagaggtgtggaattgggaagactggtgaggcacctactgcactcatccaggcatgagataatggcgactcaggtgaaaggttgctgacaagtgctcaaaacccccttgatcttgaacacagagccagcagggatcgctcttggaccagatatggggtgtgcaaaagagatcggaagtccgggatggccctaacgttctttgcatgaacaaatggaaagttgagatccctgtgagaggaggggccagggtggggttggggagatatcagcctttccattgtggacgtgccacatgtgaaacgccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagagtaagttggaatccctttgtcacctgtctggaatgttttgtcttccatcccctttgtgattttttttttctgctgttcatactgaaaggcatatgtatttgcaccaataataccaatccatgaactatgaactttataggtatgcggtgatgacattggtgttgtgatctccccgcatgtcctaccatgcttatctgattctggatttgttcaggattcaaattcatcccttcccccagttttcagtgttgtgtatgtattgacctgtggggcaggaagcagggcgaatcatttctacctcagcctaaggaacaagtggaagcaggggccctcttgaatgggttgagctggaggagccgggaacctgagtggcttggagccctgtggggcagccaggtttctgggccagagggtggatggtcctggcaaaggggcagtgggttctcactcacccacatgtaacttcccaacctgtggatgagtgggaggcgctcagcggttctcagccatggctgtgccttgcagtcaaatcatgtcgggggattcaacagatcctggtacccacatagcaccccagagatttgccattggtcacaggtaaggcctgggcgtcagaacttccggaagcacccagatggttctagcatgtcacacaaggctgagaaccccaaggtgggtagagggaagatgcgagccagtgtggtcaatgaaggtaggacagagtgatagtgccagcatggacttgtacagaaagggcttttaaggatgatggctcatgacacagtgacctggaggggccatttggttgagaaccatgacccttcctgcacctctgaattggggctgttgaagaaggcatctgccctggaggtgctcgctccatgagggcagagccaaggcagatcttcggagagggaagggcctcagaccctcaaaggagatgtggcaaacactgtgggagggggcctaggtggccaaaacagcctctcagccatgttggtgagacccgctgctgttgtcccattggtctgaagtgtccctgctggcagctgccccaggtggcgccgcgtccggtccaggccctcccacctgtcacacttcagccccgtggaggctgatgctcaagcgcttggctggacgctctagatggaaggccacgttcaccgccctccttgttccaggctcctgccgagccaccaacgtgtcggctggcggggctgcttattgaggcggggagggtgcaagcaggtagtgttttgcttactcagaggaaatgctctgtgtgcctgcgtaacagctgcacttactggcgatgcttctggatgcttcgctgttctgtatgtttgtatgaacgccgtgcaggtatgctgccaggccgctgcacttcctgaataggtttactggcgtggaaaataaggccacgaaggcagggatgttggatttcacacagattgacactgatcctgaggtgagaccctgccaccaaaatgaaggctgtaatgacttggctcccataaagatgacattctttacttcctgtttaaaagcacgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgctttgtttttgttttgttttgttttgtttttttcattttagcagaaactcttctttaaattgaaacccaaagacctgctacaagcaccaataatcataagtgcactcgagggcctgtgaagaggatgaaaataatccattctgagactctgattacacacacacaatgaactgtgcattgctgagaaattgtttctgaacatcattcttttttgtgcagctttatcgtagtgacagcgacagttcaacgctgccccggaagtccccctttgtccgaaatactttggaaagacgaacccttcgctataagcaggtatgtgccctgtaaacaaatatggaatctgtgcttgccctgcgagtgattttacaagccttaaaaaggtaacatttaaggtcatgtaaatgaaaaggtagtatttctatttcttgtttacttaacagatgtaatgtcgtaatgttgctaatatttcttaagatagtatcatgatttcagataatctgtgatctttacattcttcagtataataaataaccatttttatataataggctgttttctctttttttgacaggagagtatatatagtttagaaaagttgagtttttcaacatgttgcttttctgggcagggatcgtttgaataatatatatatatatatatatatatatatatatatatatatatatatatatatatatatagtgtgtgtgtgtgtgtgtgtgtgtgtagagaggaagagagacagacacacaaaaaacccccaatttccacgtggcagttgtgctccaccacatacaagagtggctgctgactgggaagaataagaaagtttataatttgggccgggtgcagtggctcacgcctataatcccaacactttgggaggctgaggcgggcggatcacctgaggtcaggagttcgagaccagcctgtccaaaatggtgaaaccccgtctctactaaaattatgaaaattagccagacatggcagcacgtgcctgtaatctcagctactcagaaggctgaggcaggagaattgcatgaacccgggaggcagaggttgcagtgagcttacgtcatgccactgcactccagcctgggagacagagcaagactccatctcaaaaaaaaaaaaaaagtgcataatttggcttcagaagtgtctctcagcagcaccactgctggcatttcagacaggctcattctttgctgtgggggttgccccgtgcactttaggatgttgagcagtgtccctgggctccacccaccagatgccagtaacaccccatcacatacacagcagttgtgacactcaaaatgtccacagacattgccagctgtcctcccgggggccagattctcctggttgagaaccatgaagctctgctgagaattcagcagtgcttttaaagaatttatatttgttaagttacaacccatatttgcatttaaattctgtgtatgtgcaaaatagcgttgtgtgtgtaaaaagcataccgtgactcaggccactgacccatggtgattggcgaatggatttgtggttttgctgcggtgactgctgtcttagggttctgtttcccattggatgggaagtactgctctcagttccgcagacaagagtcttttccctgtcagggctttcctgagcctaggtatgtttgcttacttgaggcttatatggggagggaagctttggacagcttgcatgtgtgtgtctgcgtgtttgcgtgggagtgtgtatactattttttaaacaacaagcactcgtggtttataacgtactttctttccccttgtacagtggatcattaggatttttccatgtccatatatttttttcaacttgttacaatggctacattttatactggccttgtaatttatttaacgtttcctgctgttatagacttacttttttttttctgtcataaaccttaattggaccacttttgcatgtcagcagttatgcctttcagatgcaagtttgctgtagacatatatatattctcaaatggcccttcagaaagattgttccatttttgatcctgccagccccatataagagcatctgttgctgcacatttctgccaatacataggtcatcattaaagaaaaacaatttgctgttactaaccttgatactgaactagagatttacattcctcttgcccacatctgtgttttttaaccttgggcgtgcttagagaaatacgtgtgcctgacctgtctcctattaattgtggaagaaccttctagaaggcctgagtgagggctcacagctggcgtctcttgcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcaggtgggggtcccctgtggccagctcccgcctgcacctcactgctccctgctccaggctctgaagggagcctcccagacacggaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactgcagccaccccctggcctctgtctcctgggaggaattccttggggggagtgtgggtgaggtgggccttactccctcctgtcaccactcactgactgtggttggttcttctgggctccagggttggcagtgaacttactcattcttccttaaaaaaaaaaaaaaaaaaaaaaaaaaatcaataaaatcgtcttgttggtccaacgttgctgttccagacaagacagaccaaacttgactaccgtcatgagcaggcggctgagaagatgctgaagaaggcctccaaggagatctaccagctgcgtgggcagagccacaaagagcccatccaagtgcagacctttaggtatggcggaggcgtggcaaggccggcccctcggccctgcttcctccttactgtcgtgcctttggcatggtaaaaaagtacagtgagtctgtttttgtttttcttctgagacagagtctcactctgtcacccaggctggagtgcagtggtgcgatcttgtctcactgcaccctctgccccctgggctcaagcaagtctcatgcctcaacctcccgagtagctgggattacagatgcgcactactatacccggctaatttttaaatgttagtagactgggttttgccatgttgcccaggctgatctcaaactcctgacctcaaatgatccacctgcctcagcctcccaaagtgctgagattacaggcgtgagcccctgcgtctggccgtgtgagtctgtaaaacccatgggaagttgagaacaaaacaggaatccactgcagccagtagtgtattttcatgtttttatcctgatctttttttcctacagttttttttcatgccacttctaatcataatgcgggttcagtttggcatttagcattttttaaattaaaatattccatattgctatataatgtgctatcttgtttgactgtaatgtctcatctaatagtttactcaaccactatattttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagctgcccaaagttctgggattacaggcatgagtcgctgcacccgaccacctttgctttttcagttaacttttgattaaggcaaaatgtatctgcaggaaagctgcgtatcatacacacatggtccagtgaattgttacaaactcgtcctaagaatcggtcattatcagtgcccccagatcccacactagagtaaccaccaccttgaattctaatagtatagattggttttgtctgtttttgtttttgctgaggggatttttacagatgcatcagtattcttttgtgtctgtaaaaaaaattaagttgaaattcacataacataaaatgacccattttaaagtgaacagttcagcctttggcgcattcacaatgttgcacaaccacccctctgtctagttccagaacatttttaccaccccaaaagtaaaccctatacccattaagcagtcactccccgttctccctcccctagctctgtctctagggatgtgcctttctgcctgtttcataggaatgggatcatatcttacgtggacttttgcatctggcttctttcctgcagctgagggttttcgaggttcatccatgttgtagcctatgtgccagtgtgtccttccttgttaagggcgaataaaatgtgtcttttagccctaatttttgtgtacatttaatattcacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgc

SEQ ID NO: 9920 - DNA, 19861 bp, Homo sapiens
cccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgcccccgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgctcccgagccccccgcccgttcgcgggctctgtctgtggggggcgaggccggaagggggacccaggggcgcggattcggccgggcgggggctcaaaaacggggcggggggccgtggcgacgcgggcgcgggtccccctcccccggcctgcccgctcagtgtctctctcttgctctcgctctcgctctccccctctttctctctttctctctttttccgcgaggcctacacgacgccaggggtttgggtgcgtgttggggagggggagggggagcccatggggctccggagactgcgacaaaaagagggtttcggggacaggaaaccgggtggcgggtagagggagggggacccgcctccgtggggtgtgagatttgttgggagagggaaagaggggaagaaaggggcgaggagaggagggggtgacgctggggggcgccgtggtggcggagggggcctcgccaaagggaggctttggcggggagaagtggccgaggagagtgggggggctggtgacatcagcccctcggaaaggatcggagcggtaaaggtggtgcagtgggggggagggggcgcaagggagtcgtggcgccggagtcgggaggggggcggcgaggggaggagggagggcggttgccgctgggcgcgacttggtgcgtttcgggcaggaccgactgactgtgtgtgcgcggagcagacgtgtcccgggccaggccgggccgtggaaggaggagaaggagagtcaaataaaataagaccaccccccaacaccaaaaaatggatagagttagtacgagaagtgcccagtgaagccaaatgacacgtcattttacagtgtgacctttttttccccttccagacttgcaggctttttcaaaagcagagcggagaattaattgtagcagctgccccccccacccaccacgagcagcgcccccccaacactattttaataaaccattaaaaaaaacacattttcctgctggctggccacattgagagtgctttgtgaaaagaaaaaacaaagacattcacaaatcagataaaactggagaatgacatttgtctgtaaatggcttcttggtctggaaatggcgtggtttctttttttttttttttttttttttgtcctcctcaaggtgggaggggggattgagagtgctctaaggagacttttcctccaggtgggaagagataaaaagacattaattagttgtttatcaagtgacatttagttgtttggttttgggttttctttttttgattgcgatttttcctctgattaaaaaaataataataaaataaaaaaaggttaactataaggagatggcctttcctccttttttttcttaaggtgctgttttgggggaaaaaaatgtaatgaaatgaccaaaagaattacacagcattaattaaaaatggaagttttccacttccttgataatttggctatctgaataaatttgtgaatttgctaggttaagacctagttcgtggtcacatttcaacaaaacagcttgagtataaagaaaataataaaaggctgttcttatttattttcctttggtggcttttggtttgctctttttgcataggtcatgactttgttctcctgggtccagatttataaaagcagaaaattactaattaagtcaaaataagtgtctttggtgtttatgcatttgcaatttcagtaattaaatggtacatgtgttgctgtcttgtctaaaacttttaaaggcagaattatgctgttgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagcttaagccagtgacacaatattttgcatttttaaatggtgattctcaccaaataatgcctccccacaaaagaggaaacctaataatgccccaaatcctctttttactccatcttaatgacataaaaattaagtgaattagagaactacaatgatcttaaaataatttttcagccacatttcataaatgtggaaactgaggcacggatctgtttttgcctatgaaagataggtcctgtaactgttacacagtttaacacttctgaaattagaatattagagatcctgctaaatattacgtattgtttccttggcctctcttaatagtgccatttatatttttaatttaccagagttaggctcattaagatagtgtttgctttgaaatcaatgtttctgtggaaactaattttaacttttacagatattgattacgggcttgtgaaaaggcaagtaaaggaggaatgctgtgctatctgggcattaaaacaaaacaatacaattaaaagttaaaaagaaagaaaaaggtaataacagatttgtgtggaaggagggcaaaaaaacttcacacgtggattatctgttggagaatgtgcattgcaaaaaagatgcaaaatagcaatcctccctctagcttgatggaaatgtgttttttccatgaaacatatatgtatttttacaaatgaaagatgatttaaaatggaggcatgtgtttctactctttgagttgggaagggcttggaatctttcaaattcagtacttcccagggatagttttccttttgattaaagttttgttcttatgttactttttactgttgtttttgcagtttacctaatgctaatagggtctcaggaactgtatttgatgttaaagtgtggtttttccagaagatgacagataattgatggtctccccttttcctcagcaacatagttgtacccagagggaatttatctttagaaagatatagtttgtgaggaaagaggaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaacaatcaaaagaaaaattaaaaccagcaaaccttaaattcttgtttgttatttggatggtgaaatactgcaggtagacactgaattggacattgatttccttttctctgcgtcgaaatgtcaaggaaagttgcaagtctgtgattttgtgtttggttttttgcatgttgcttctatggaaaaacaaaacaacaacagcagacctccctgcccaaagtgttaaaatgcctccttcataacctgagacttactttcattttctaggtgctggagaatctggtaaaagcaccattgtgaagcagatgaggatcctgcatgttaatgggtttaatggagagtaagtgtcaaatctgtgcaggggggcaccaagtaagaggaacagactttatactaacctttaggaagtataggtgggctttgggggctgggcagccagttttcacttaatttttcctgatttacatattagaaaatcctgggaagggctctttagggtccctcaccccccacccccttggatctttggtgcaacaaatactactgatgaaagcaccagtgtttgtgacaaacatctccctatcccaagaaaatcgtgcctggttgcaggggacgcttgacagcacttggccccgtgacagcccctctccgggccaggtccctgccacagtcttcggacatcactgcagtgtcttcaacgtggctttggccgccccctcgtccggcccacgctgatcactgcaaattcaccccaccccacctcacgcagatttcaatgtaatgaaccaacacaggatgttttaaactattagggaaacattgtttccataatattctcaccagaaacagatgtggaagtggcagcccgtgtttacagtttctcattttttttgtccccctttaaattaccattatgggtaaatcattgtttccctttaaaacaaaaaacaaatcagtacccctgcctacagaaaagaagagggaacatttatttaaaggatggaaagactgggagttaggcactcccagcctcactgaggggcatttttgcctttgagaagtcctcccaggtatcctggtatagcacaatgtggcaatccgtagtgggaatgaagattaaacaggagagactttgtattagacctgtgagacgagttaggaagccctgcctggcatggggaatgcaaacagggaacattcaataaatcggggaacttgcttttctccccaagaccccagatggggcctacccatcgttctcgtgtaacaaaacgtgtaaaaaaaaaaaaagaaaaagaaaaaacaaaacaaaaaaactaagttgaccagtctgttttcactggtatgagagcattaaccgcactagatttcaagcacctgaaggcactagtttgtaattactagctggttggcacagtcctgttccctttcttaaacttggattcgattgaaaatttaaccttgagttgcttcagcttccatttcaaaaggggagttggagtcaaggtggtagcgtttaattataccaaccaccccccaaaaaaacaaacaaaacaaacaaaaaaacctttactagtcactaagcatccaggaaacaaaggtgaactttttcacctttcagagcaaggcaggcagctccttatagagaattctagaatttgttagatcaaataattgtttagagaaggatgacatcacccatacgaatagtcctgttagttgaggatgctttttctactttaaccctgaattcagaaggattggttgggatgcacagggggcttcttcactcatctgattatgactctcaatgggttatcaacatgcacatacgtgctattgagtaagtcagcatcacttgtcaccaaccaattccgaaattaattcttgacacacccctcgataaagccctgccagcggagactgccatcctgacaataaataaataaccctgagacagacttccaaccatgaatctgtcatttgaagaaaaatcttgcataaattttccccctgcaacttgcaggagtacttacttattcatgagagtagttaagcaaaaataatttgaccatgtatcctctagataaatattttgatgaaaactggacatggctagcatttttcaaagatgcagcagccactgtttaccttagcttgagtcggatggaagctaagtcacctttgaaataaattactgacagcttcattacagattgccctaaaatttaaaaatttttatagaaaggattctcctccctaagcgagccagcctgtaacaccaggcaagggttttaaaccagaacttctcttttctgttttctttttggaaagaggaagcaacattcccagtttgccttctttgcagacaagggcacagatacgttaaatttagcctgtgagagggtttacaggggtattcctcatgggagcctagataccttatttttatctcatccaactgcctccttttttctttttcctcactgcggtattgcaacaaaagctatttccttcttaactaggaattccctatgagacagtgacatctgtccctaaagggtggtctgggtggtacagggttcttcctccctgatcttgcgttttgttagggctcggctgagctattaaatttgccttaactctctgcgggctgccatgctgattacatttttaagagtaagataatactgatttgaccttcagaaatacagaggttggatgcggattttctaactcaaaactaactctgtttcttacatttagtgccaggaacaaaacaaaaacaaaacataaacaccattaacattggttgaactaagctaatcaattaccaaactgtagaatgctgcccttcggccttcaaggaggaattcctactgtttatgaagatcgggtttgggtttttggttttttttttctttttcttttttccgtggtggtggtgggtgggcttttgttctttttgttttttctgtggtggtggtgggtgggcttttgttctttgaaattttttttgctacatcacagtccagacatagtttaatgacaatttatggggaacaattatttataaataaaaccattttataggtagtttccttccactgcaagaagtgaggtcattagttttgcaggaaatcctgggcagaaatctcccccgtttatgcctttatgccttaagttacaaccttgggaagattctgacctgggagaattaggagccttatgcgctgccatattctccaaagaattgtgagataaatcactgctttagctccctaatgcgtgtacgtttagtgaaagcacaagaaaacaattatccatccctcctgtctccgaccagagtctccagagagctctgttaatactgcagcaaaggtgtgggattcttcccccatggcctgcagtctcagtggatgttccaatttagccagaaaggcgacctaagaattgccgggaggatggatggctggcgcgcgaattgttgcttttgctcttggctgatggttgaggaatgtagagagactgtgtggggtttgtgtgacactgcggtgccttgcagattaggtgagctttcaatctctctttaaaaggggcggcgaagaggacccgcaggctgcaaggagcaacagcgatgggtaggcacattcaaaaccagaaaaaattgttaacaaaccaaacaaacatgaagatcatactgggaaactgaggccagagacccgggaagaaaataaaaatcatttaaaggaccatcagccatattggcatacatttgtgaataacacacaatttcctgacattttggagcaagtaaagtgcgtaacataaatttttttggccatgcttaaagtagaatgagatccagctgggggaaagttatagatttcagccttggatgatcagtttaggattttgagaattgatgtttttccatatggtttctgttttcccccagctctccatttgaaccagctgcttgttttaaaactatctactaaattccatctacccactggttggtctgattttaaaatttcagacctctttgaaacaaaatttgtttcctttattaaaatatgcaatgctgcaccgtctttaattttgaaaaacgccttggtaccttgcagcaggtcgttaagaatcatctcgaaaagcctctggccttttaaaaatgatcaaatttatttgaatcaaaggcactttacgttagcttggtggataaggaaattcatgatggcatcttttatttttccattcattatcaaattattttttctttgcttcctgcatccccacacccatcacacacacacacacgcacacacatgcacatgcatacacagacacgcacacacatcacacgcacacacagccacacgcgccgcgcacacacacacgcatgccaggtaaccactctagctctgctgtgtatttagcatgcagtggtggagtggctatttctcatgagaccatccagaaccattgacttagtttagggcatctcaaagaaacagcttctgtggccggggaggggaggggcaaagatattggggtctggggacaaagtaactgacacatgtttgttcatctgtttcttttagaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaatccctgtatctcgcgtctgtcttctgtcttccttcctttgtctgtcttttcccaccaaagcacaaggattaaggtggagacctgaatagcttcccccaccacttagttagctgaagcggggggaggggaggagctcttaaaaactgaacgcatcccatctgctgtatacatagaagggggaggaggaggaaccaagaccctaaaagtacttccagccttagtcccaattttgtagcgaatcagaattctagctaatggcatatgttttgcctttgttgagtagtttaaagacatctaaggaattttctctgaatttcacaatcaacgttaaattcattaagcaatagtaaaagtgatgataaacccgccaacccccagtataatatctccatctacatagtaattgcttcaatggaagaattttatgttttagtattacacacccgaattagattttagatttctattttagctgttttatacttgatatactcccacacctattcacatacgtagatgaatactgaacacgttctcaaaatatccgtattttaagacgggaagttttccaattatcatactactgcttagaccaaaatatcaaactgaatgaaagaaacttgtttctggaaatactttctcttgctgtatgcagatttggatatttagtacccgaatgtatttaattttactattgtggaacctcaaaaccaaaggttaatagctttcattacctgtgaagtggagcctgcttttaatgaatgggaatagatttgccctagggggttttgggtaaattctgaattcaaaagtgaacattggggaccatcaaacacatgtccttttaatttataacatctaaataatcgatgttagactgtaataccaaggccggggattcttaatttcagaaatgagctttgattctgcacatacaaagcagacagtcgcacagagcggtcaggactcactccctttcactctaaggtggttgctttaagagtctgggggccagaatcagatttcagatttgtacacaaggcctgaagctcgctcacctccctgtcatctgtgtttctgagattctccggacctgcagcacttttacttaaatggccctgaggggattcctggcaacatctgtcccccctccccaccccagacaccccccaccactaatgagcgtggcccctctgaacttccccagctcttcacccaatgtagaagagcagtggtgcagtgacctgtgaaaggggcttcacgtaggaagggggcgagatgggatccttcagcaggtgaaggcccagaagtacacagacatttattcagaaagaataaatttgtaagtataattctttgagaaaggaaagaccaaatgatttgtggaaggcctgtcgacaggcccgcacttgaccccaccgtccgtccccgccccccacccctgctgctccactgactgccctgccctgctcgtctgctcgtctgctcttgctaattaacctcccttcgcctttcctctgccttaactgtcgtgttctagtctggagagattatatgttttaatttctactccagtctatgaattggtgaatcagccaagtgaatgcttcaaaaactgggactctcaaaagattaaaaaatatatatatacaaaccgtgaaaaagataaactctgtcccctccatctcccattggtttctgcctcggtgactccccccctcttggcctcagtttccctgtcagagaggcaggaccgtagcaccttttttccgcatgacaacgccctcacctcccagggcctaacaggtacagcaggtgtgctgtgtgtgctggttccatttttgggctatagacctgatgagatacatactccacacaagaggccttttcttgccctctaaaaacataaactcgagaaccttccctggctgtgcttctaatgaaggctagtttctgaaaaacatacagcatttggatcagtgtaatgtggtacaaaaattaacattctgttatggtccccagaagccaaagggtgtgtcctttacctgtgggaccagtgaccctgaatatagatcattccataaagaccacgcaggccatcccatgtggctgagttaaactcaaggaaaagctacaaaaccttcaacctctacttaccagagggatctgacctcccctcccccttagattataaggccttctagggggtggaatcttatttgattcctattgcacatggaccaacatgcactaacatcatgaactagaagtttcattgctgctagctgcaggtgcctggagcatcgcacatacgacttttttttttttttttttttttttttttgacagagtctcactctcgccctggctggagtgcagtggtgccatctcagcttactgcaacctccgcctcccgggttcaagcaattctcctgcctcagcctccctagtagctgggattacaggtgcatgccaccatgcccagctagtttttttgtgtgtttttagtagagacggggtttcaccatgttggccagactggtctccaactcctgacctcaggcagtctgcccgcctcagcctcccaaagtgctgggattacaggtgtgagccaccgcacccgggctcctgtaatgaactattataaacaccaccacctgtgctcactggttctctcagtatgctagcaactgagttaattccaagtcaaaccatgggactgttttgttccaccccaacctcatagtgacctatcactccagcctcacccctacccagatgttgataggaccaggagaagcctttaggaagtgttagtatgtagtgtgggggcttcaaacccatgaaagattaaatgagctgcatgcaacttctggtacagtcatgattgctaaggcaatttgctaatctgccccgattgggcgtgtcctcagggcacatttgggaggttataatttgcaactatgtttattcagctacctccaatctttgcacagatccgaacccacaactccctgaagaacagaatactatgctttttagtcgggatgtctttatgaaagcagtactcctaactgacatggtgcaatatgattttcttttcttttcaatcccactgcagtgagaaggcaaccaaagtgcaggacatcaaaaacaacctgaaagaggcgattgaagtacgtgctggctccttgtgctgtctgtcttgtagcgccctcccagccagtgctgttccctgaccgctttgctaaatcattttcagaccattgtggccgccatgagcaacctggtgccccccgtggagctggccaaccccgagaaccagttcagagtggactacatcctgagtgtgatgaacgtgcctgactttgacttccctcccgtaagctacaccccgacttgtgtggccttagccccgcccacctgagcacagtgtccatataggaacatgagtgacagccctgcacatgggcaggagcatccaaaccacacttcaggcaaaactacatttcagtgatgtccatccttaggaaaaagttaatttcatgtgtaaccttaatttaataataataatcattagggctttgttcaagatggatgagcaaaattctgtcaccccttctacatcttagctcacctgtcctcacaaataaacatcactcttgaatactacaatctcactttattagattgtaaatttttatgaggaaaaaggtcctgagctatggcaggcttaattattccctcattcacatcttaggacaaaactgtatgttaaatatggcacacaaatactaattgtccatttactccactggaagtgccctaaggtaccttgggatgcctcagtgaagtgccaaatggaagacattctcattttaaacaggtgacctttttattaagagttttctaaagtccttggggcaaatgaaatcttttctcattattaaaaaaaatgaaatatatctaaatcataactcaaaaatcataaaatagaacatatggaaaagactttcctctggatgcacgacactgttggctccctaaagaactacttttagggaacaaaaaactgttcaagcccaagcatataagtttaggccccttcgtggggagaatggcttataagcggggaacgggaaacgagatggaaagatgtatgcgtttgtaagacccacagggaagagacttgtctacagctaaaacaatgagttattgttgccttttgtcaggctttcgtgggaatttgtgtttgtatattttagatggacttggctgcaaacttaaattggagaaatttagtggtatatagttagtatggatagctaaactttttaaatagcattattttgaaaaaaaagcaataaacacaatatgtataatataacccactgactttcttgaaatatgattctatatttaataggaaaaggaaacagcagcctattaaaaatgtatcagaacaataactttttattagtcctactaacatctgaacttttatgttcctacctacaagtcccccatcatcattttttttggtaagattcacattttcccaggaggaaaatttagtcccagcacatcttacaaatgaagtttcttattttcacaacattgaaccatttattggcatattctaacacatttagtgtatattcttcctaaacaattctgtgaagaaactaaattactcagtagcttaccccattccccctacacacgagaaaagaaactacccaaaaccagtaattcacaataagacccagcagctaattgcgtgaacttttgaatatgtttaacgtgttgaattaaagttctttgtgagcattaattcattaattgggctcaaaattcaaaatcacaccaagtgtcggtcacatagggaactctggtctcagggtttgaatgacagtgttgttgattagttcaagctcttgcctttctctaaactttcttgtgttcactttcaggaattctatgagcatgccaaggctctgtgggaggatgaaggagtgcgtgcctgctacgaacgctccaacgagtaccagctgattgactgtgcccagtagtaagtaaccgccacccaacccatcagcacataaaacagacaaaaacaagaaaacatgaaaacctgtgatcctgctttgaaagttacttgttgatgattcctttcttagaagccaaccagttaccccactggcagaaagttctaatctgattcaattgtttatttataaagtccttaattgcattttttttcttttagtgcagcgacattattttacataaacatttaaagcctgttagagcaaaatgatgatgagtttcatagtattcctaattagtaggaagtaattaattgaattgaccctaagcatttagggaaatagggctgtgctcacattttgaataatgtaaaaatactatattttattgctgtaattttaaaacataacaaagaggaatggtgaagacatagctacgcctcctctctccttggtagttgttgattgatctatttctgctctcaggtaagcgactctagtagctgcctagtgttactagatcctagtgactctaggtagagtttgtttttgtgttgtcttgacttttgaactctatttcatatccttatttattccttctcaccgggtcttgattcaaggatggtaagtggtcaatggattttaaatcctaaactgtacacctaagcagtacaataccgtggtggggttattttcaaataaaacaaattactacctgcgaggaggacaggttaaggcctgcagtagcaatgggaaaagcatctttctccaaagtcactcataaaggtgggctcacctggttggtgtgttggcaaatgaagaagggggaacttaaaacacagactttattgcacaactctacctgatgcccaggctgcttcccttgctgcctaacacctgacttaccattgcctcagggatcgccctctgtccctgtcacccaccatggtctctcccagaggacatcgtacccgatagctagaaagttgcctttgaaatagtttatggcttccctcatcttgcacatgatatagcaagcatgtggtggtcagggttatttaaaaaatatgtaaacattattattatttttttgaaacggagtctcactctgtcacccaggctggagtgcagtggtgcgaccttggctcactgcaacctctgcctcctgggttcaagtgattctcctgcctcagcctcccgagtagctgggactacaggtgcctgccgccacaaccagctaatttttgtatttttagtagagatggggtttcaccatattggccaggctggtctcgaactcctgaccttgtgatccacctgcctcggcctcccaaagtgctgggattacaggcatgagccaccgtgcccagccaaaaatgtaaagatatcttctgtttgttgatgctgcagaaatgcacaaagcagtctcagttaatgatattctgaagtaggagtgtcctgtgacttggggcaggggagtctagtagaggtttgatgttttagccatccttattacaagtagctgaaactcggaactgattttgctataggaagtattagctaatcagaaccaaggtgccaggctgactcaccaagggctaagattgctttacttagtagcctcaagcccaaggaactgattgtgaaaaccacctgaataaacaggagggaggaagaggtaatactgttcatctataaatcatataagcctctgttagggtctgcgcaatctatcaaccccagccctgccttcccataggaaattcctttattttcaattgccacatacatagatattccacggtttaatatacaagcaaatgtgtatattttttcaaggaacagaaaaaaacagtccatcttggctggtccctatggcccccagcccccactccttcttcaacaaagtccctgattttctcaaaagttcgaaccaaaagctggaagcgctaattatagtaacgcaaaacaaatggaaatcctggaattgtttgcattttgtattttggatccaagtcagaagttaagtacaggtacaagattaagagagtttaaccaccccagttttgaatgctgggggggcagggagacccagtttcgttaattaacagtagcttagccagattgttgaattttgtcgggtttcgttttctctctcaaatcatttagaagtttttggggtttttttaagcaacacttaattactcctgaaactttgtctgaaaacgcaccatttgtatagatcatgaaaagttttaaggaaactcagagaaaaagagaacaacgcagcttaaaacttttaaaatgtcctccctcacccgtggctcaaacagccctgcatctgccgtggccggcacgtttctggttgaactgcctttatgttaaagttcagatactggtagtgtgcccatttcttaagctgtctatttttatttgttgagctggggtttggctggctccactccagatgtctctctcacaagatttggtgctgatgatctatttatagaactgtggttctgttgccatggtaacatgctggaggccagggcggctggggagctatttctggactggtgctgtaatgtaagattgattgggcaagttagtatatcctctaagccagactaactctgaactagtaaaaaggaagaggggaacagaaaacttaggcagtttctttaaataaacttttctctctttatgattttcttttctcgttagcccgctttaaaacaattccaatctctacatgcccctccctccaaaaaataactggttttaacattaattttccatattaattaccccaatctttcaaaagtaaattttcctgtgtgtctagtcaagcaacacaaacaagatgctttttttaatgaaaagcgtaatatctggagtgttctatttcatggaccaaacagaacggaagagaactttgtgtttgtttcctgttcaggatggctagggcgagaagggcccctttgtgccaacctcttttgttctctttaatcaatgagattcttaaaaagtaaaaaggaagggatacagattctcagtaactaaaacaatctcgtgtgcccttgaggggaaagtccttgatgtttttaagaatgtcactttattgttttttaactgaatgatatagaggtatacaattttcaaactgtttgccattttaatcaagcaatttgaaaattaaaatgtttttgtcaggcattaccaaatggcacagaatgtgataggccagcctggttttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgcgtcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcaggctgactatgtgccgagcgatcaggtgtgcaaaacccctccccaccagaggactctgagccctctttccaaactactccagacctttgctttagattggcaattattactgtttcggttggctttggtgagatccattgacctcaattttgtttcaggacctgcttcgctgccgtgtcctgacttctggaatctttgagaccaagttccaggtggacaaagtcaacttccagtaagccaactgttacctttttatataacagagatcatggtttcttgacattcaccccagtccctctggaataaccagctgtcctcctccccaccagcatgtttgacgtgggtggccagcgcgatgaacgccgcaagtggatccagtgcttcaacggtaggatgctgtgggcttggctgttcgtaaagaacgctttgcttctgtgttgttagggatcagggtcgctgctcacgctcttggctttgctctctttggttaagatgtgactgccatcatcttcgtggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgcaagcattccagacccctggccgaaagcgcgcttctcccaagcattcacacggcctcccttcttgtagatggctgcgcaccatctctgtgatcctgttcctcaacaagcaagatctgctcgctgagaaagtccttgctgggaaatcgaagattgaggactactttccagaatttgctcgctacactactcctgaggatggtgtgtatggcttccactcttgctggctgttcattgcggtggttctttttcaaacggtcaggctgaaaacccccatccccctcccaccaccaaaccataaaggatctataagagaagcaagaaaaacgcactcccactaattctcatatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctctttttgcttttgttttcatatgacatcagaggctggctgacagccgtccctggtaggtgtccccatcagggatagggtggttcctggcgagggtgtcactgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaatgatg

SEQ ID NO: 9921 - DNA, 926 bp, Homo sapiens
ttgcatgtactcaatacatttactccaagattcttctgacaagggacacttttagccaattccccaatagctctcatcattataggattaaaaaactaggcctcctgtgaatttaaaaatagattaaaatactccctggtactcagatgtgttcccactagctaattccagcattggtcaacatggatcttgtttgaagctaacccagtttaaatattccttttgcaaaacagatttttagagctatgccttgctaaagattcttccaaatagtaatctctcctggcacaggagctaaccactgcccaggtctctaggctcatctcctgctgtacactccacattcactcttccttccattagcactacttgcagttccccaaacatggcatgcctctatttttgcctgcatacttcctgtgaatgctatttctttatctagaagattctctccccacccccacctgccttatctggcatcttcagtgattcctgtgtctctttgagatccaatttaattgatagttcctttaggaatcattcctatacttcccaaactaagataaatgccccttcttatgcccatatccatctgggattttgccttccttcatactttatatccaatacaccaaaatctcttgttggctctaccttcaaaatagatccagaatctgatgacttatcatcttctcaactgctaccaccctggtccataccaccatctctagcctacatttctgtgatagcctcctagttgatttattcttacctacttcaacctagcctccacaatctattctctacatgatagccaggatgcccttttaaaatctaagtcaaagtccttcctctactcagaaccacttgagttcccttgtttcactcatagtgaaagtcaacagccttacaatgtcctgcacacc

SEQ ID NO: 9922 - DNA, 1163 bp, Homo sapiens
agctatttctgagccacatttaaaaggcatggttctataagctatgggcttttcttttttttttctttttttcttacctccttttgcagttttcccagatctgcaccttctgaagagcaaatgcaccttcctgggtttgtccaaatgcagatcatttatgctctcttatcacacacccacagaatgccgctctcataccgcaaaagcactggcttgccacattgtcatgtagtctcccagagacctgtctatttctagttgtgttttgtgaggcaggcaggagagtctcctgtgattacttcctctgatccttaaataaatctttctggttgtttttttctggggcgcttttctccgattctcagagggagcacagaccccaagaaaggataagaacttctggtctctcccagcttgtgctcctcagagctcatggtttccttgctaccaacaccaaggaaatatcaaaaggatatttaaagaatcataggtgcaaactgattagaagtttggcaaaaagagaggtacctgaagggccaaaaatctgccactttgaaaaccaacacacagggcacttggataggtttctctctgttgccagagtgccaaagaagatttttcagctaaaagaatagccgggctctgatcaagaggacagaataataaaaagggtttgattagaggcaggatataggaagaaaacccagtgtgggtgggtatctagtaaatgaaaggccaggaaggcgatggggcctgacttttccatctcagctgagcctagggcaaggaagagacttagggacttctttttttttttttgagacagagtctcgcactgtcgtacggactggagtgcaatggcacaatctcggctcactgcaacctccgcctcccaggttcaagcgattctccttgcctcagcctcccaagtagctgggattacaggctcccaccaccacgccctgctaattttttttgtctttttagtagagatggggttttactatgctggccaggttggtctcaaactcctgacctcgtgatccgcccacctcagcctcccaaagtgctgggattacaggcatgagccactgcgcccggccttagggacttctaataaaagacttagggacttctaataaaaattgaaagaaaaaaaaaaa

SEQ ID NO: 9923 - DNA, 534 bp, Homo sapiens
tgaaaggatcacttgagcccaggagctggaggctgcagtgagctatgatcgcagcactgcactctagcctgggtgaccgaacaagacctcgtctctttaaaaaaaaaaaaagaattctgggattacaacaggagcccaaggctagaataatgtatcaaaggaaacaggagatctccccgaatctggagaccttcaaaagagagcacttatttacttaggatgagtgaagtggaggcatttaacaactaaggagtctattgtgcaaaaaaccttttccttatctgagcacaaaacaacactgtgggctttagtgaatgtggatcattaggacaccttgcactccccagagtgggtctccccctgcatacactgacatagccccagccaaaacaagcagccttttcactcagcagtggtctgagaactacaccgttaatttcatgtaagcttctgcaaccatcagtacccacagctgagctgctgaccaggaaaacagtggctccttcatcacacagatgcagacactcagtgaat

SEQ ID NO: 9924 - DNA, 307 bp, Homo sapiens
gccgggcgcagtggctcacgcctgtaatcccagcactttgggaggccgaggcgggcagatcacgaggtcaggagatcgagaccatcctggctaacacggtgaaaccccgtctctactaaataatacaaaaaattagccgggcatggtggcaggcacctgtagtcccagctactcaggaggctgaggcaggagaatggcatgaacctgggaggcggagtttgcagtgagccgagatcgcaccactgcactccagcctgggggacagagcgagactccgtctcggaaaaaaaaaaaaaagaaagaaaga

SEQ ID NO: 9925 - DNA, 1558 bp, Homo sapiens
gtagaattattgtataaattatagaaacatatatatagttaaattcaagtctgaatctgacctttatgactataaattgatacgctcaaaatttcaaaattatacttctttgacccacacaatggtagtagcttatgggagagtgtttatgttgtatttaagcttgcttttcaatttttaccaaattaagggaagcaaaaatattaatttataactctaaattattaattctgagtgataaaaaagattgttttgaaatccacaaaatttaatttgttcaacattatggccgctttaaaacatacagtagagttgaagttattttacagtaaacagttatatacccatcaccttgattttactactaacattttaccatacttgttggttaatacctatccttcattaatctttccaaccacccatcaatgcatcttatatctgatgcattttaacataagttaacaatattgaatagccaaaatgccaaatttaaaatatttagaaaaacataggtctattttaaataccctgcaataatggccaaaagtcacatgaattctgtacaagttctagccacatacatatgtatccagaaaacaaaagcaaatcctacatattttatatttcagtcgaatgtatcagccagggtctgatcagaaaaacagaaactactgtgagtggttccaaaagaccaaaatattaccgtaagatttttattgattattttatcttggctgactgtagagtctctcatttttctgttcatttttattaatagaactgaaatattagggggctctaatatttgaaaggaaaataattagagtgctgagttctctgtctttttggccttgaatcctttcctatctccttcctgctttactctgtagagcagcgaaactgatccctgtaggctgtctcactgacacttaagtcaataagaagtctaaaaataatttgatatattgaattaatgcagtcaaagactatatttccaatttaattttgcagactcataagcaatttatcaatcctgctgatacggtttggatctgtgtccccaccaaatctcactttgaaatatattccccaatgttggaagtgggtactggtgggagataattggatcatggggacagatttctcatgaatggtttagtaccatccccttggtgctatttttgcaaaagtgagtgacttatgagatctagtcatttaaaaaagtgtagtacttccctccctctcctctctctctctctctctctctttctcgctcctgttcttgccatgtgacatgcctgctccctctttgtcttccaccatgattggaaacttcctgaagtctccccagaagcagatgttgctatacttcctgtagggcttgcagatccaagagtcacttactcctctttttcttatggattacctcatctccagtatttctttatagcagagcaagaacagcctaatacacctgccaaaccagaataaactgtgcttgtccaataactcctgtatcccgtagcttgaaataaatcaccaaaaaaatctaaaa

SEQ ID NO: 9926 - DNA, 1558 bp, Homo sapiens
gtagaattattatataaattatagaaacatatatatagttaaattcaagtctgaatctgacctttatgactataaattgatacgctcaaaatttcaaaattatacttctttgacccacacaatggtagtagcttatgggagagtgtttatgttgtatttaagcttgcttttcaatttttaccaaattaagggaagcaaaaatattaatttataactctaaattattaattctgagtgataaaaaagattgttttgaaatccacaaaatttaatttgttcaacattatggccgctttaaaacatacagtagagttgaagttattttacagtaaacagttatatacccatcaccttgattttactactaacattttaccatacttgttggttaatacctatccttcattaatctttccaaccacccatcaatgcatcttatatctgatgcattttaacataagttaacaatattgaatagccaaaatgccaaatttaaaatatttagaaaaacataggtctattttaaataccctgcaataatggccaaaagtcacatgaattctgtacaagttctagccacatacatatgtatccagaaaacaaaagcaaatcctacatattttatatttcagtcgaatgtatcagccagggtctgatcagaaaaacagaaactactctgagtggttccaaaagaccaaaatattaccgtaagatttttattgattattttatcttggctgactgtagagtctctcatttttctgttcatttttattaatagaactgaaatattagggggctctaatatttgaaaggaaaataattagagtgctgagttctctgtctttttggccttgaatcctttcctatctccttcctgctttactctgtagagcagcgaaactgatccctgtaggctgtctcactgacacttaagtcaataagaagtctaaaaataatttgatatattgaattaatgcagtcaaagactatatttccaatttaattttgcagactcataagcaatttatcaatcctgctgatacggtttggatctgtgtccccaccaaatctcactttgaaatatattccccaatgttggaagtgggtactggtgggagataattggatcatggggacagatttctcatgaatggtttagtaccatccccttggtgctatttttgcaaaagtgagtgacttatgagatctagtcatttaaaaaagtgtagtacttccctccctctcctctctctctctctctctctctttctcgctcctgttcttgctatgtgacatgcctgctccctctttgtcttccaccatgattggaaacttcctgaagtctccccagaagcagatgttgctatacttcctgtagggcttgcagatccaagagtcacttactcctctttttcttatggattacctcatctccagtatttctttatagcagagcaagaacagcctaatacacctgccaaaccagaataaactgtgcttgtccaataactcctgtatcccgtagcttgaaataaatcaccaaaaaaatctaaaa

SEQ ID NO: 9927 - DNA, 101 bp, Homo sapiens
aaaattagctgggcatggtggcgggcgcctgtaatcccagctactcaggaggctgaggcaggagaattgcttgaatccgggaggcggaggttgcagtgagc

SEQ ID NO: 9928 - DNA, 295 bp, Homo sapiens
attattttattctttattatacttcaagttctagggtacatgtgcacaacgtgcaggtttgttacatatgtatacatgtgccatgttggtttgctgcacccgttaactcatcatttacattaggtatatctcctaatgctatccctcccccctccccccaccctacgacaggccccggtgtgtgatgttccccttcttgtgtccaagtgttctcattgttcaattcccacctgtgagtgagaacatgcggtgtttggctttttgtccttgcgatagtttgctgagaatgatggtt

SEQ ID NO: 9929 - DNA, 101 bp, Homo sapiens; identical to SEQ ID NO: 9927

SEQ ID NO: 9930 - DNA, 17861 bp, Homo sapiens
aatgtgtttaagattgaggacaaaattggagaaggtaatctggggatatgcttttactatttttacgaggtcttttttccattctattttccttttttagtcttggttttcattactatttcttattgaaaaatataccactttttagactattaagaccatagttttattactaattatggtaacagcttttctttttcaaccttaaagaaagaataaataataaatatttactgtaaaatgaagtcctgttttaatgtattatgccattgaaacagtttttacaatctatcttagaattgtttcattaacatttttaaaaaccagatattgaaaaatttaataaattgttttacaggcactttcagctctgtttatttggccacagcacagttacaagtaggacctgaagagaaaattgctctaaaacacttgattccaacaagtcatcctataagaattgcagctgaacttcagtgcctaacagtggctgggtaggcaatttaaacatattttaattgaacttgtatataatttataagattttaaagtagatatttagcagggatgaggggattatatgtgaattaaatacatttttcagtcaagtgtttgcaatttgctagcactttccttctaaccttgcaatagttagttaaatttatagtaattcttttagattggatttcccttgaggctcgacctgatttcctgtcttttatcactgctttttgtaaccttcctgccaaatcataaaccttggctttcatggtttacattattttgtaaatgtagggaactcacatttcacatttccccagctattgacgacctcatctaatattttatttagaataacagaatcatctggtatggtttctctctgctaggtcatttctgtcaacatatggacatgatttagaatcttaccctcctaaactgccctccttcttccacctgctccatcatttctttgttcccccttacagccagacttctcaaaaattatctgcatacattgttttcattccacacctctctttcactaaatacctattgcggctgttcttctctatgctaaactggaaactatagagtcaatcattactctaggcatcatttaacacaattgacgtgaacccttgtcttgacttctgtcctgccacaccctccttgttttcttcttccctcatttggcctttcattttcagtgtctttgctagctcttccacttctatctgacccctaaatattggagttcctcgtgcttgctcttaggtttctctgtattcttagtgtcctccatttccacatgatctaaagtaatgattcccaaaagtatatagttaatctcagaccttttatcttaactacaggtttgtgtatatccacctgcctatttaacatttccacttggtgcctgataaatatctcaaacctaaaagacaaacctaaaccttaacataccaaaaaaaaaaaaaaaaacaccacaacaaatgttcttatccacccgtctctgcaaatggcccatctacacacttgtttgggccagaaacctagaaatcatcctcattttctctatttctctcctaaaccacattaatcactaagtcctagccattttggctctaaagtatatctagaagttcatccatgtctttctgtcttctctgccactacctcagatgaagcctagactacgactgtagcctgcttcttccttctccccttaattctgtctttacacagcagccagaatgatctttaaaatataaaatatatatgtatataacttaaattgggtcattagttccaccacttaaaatctttcagtggtttccctatgtactttgaaaaaaaaattcaaccttctcatgcctatcttcccacctccctcactgtgctccatttctttagtttatcaaatttgtctcaagagctttcttacctcagggccactgcccagactgtttccccattcaggaagacctctcccagtcattgcttgctgacccttcatcttctgatctgagcaagagtgaaactggacgcagtagttcatgcttgtaatcccagcactttgggaggattgcttgaggccaggagtttgagacctgcctgggcaacctagcaagaacccatctttacaaaaaacttaaaaattatccaggcaaggtggcacacatctgtagtcccagctacttgggaggctgaggtaggaggatcgcttgagcccaggagtttgaggctgtaatgacctgcgatcactccattgcactccatccagcctggtcaacaaaacaagaccctgcctctgagaaaaaaaaaaaagagtgacattgcttgaaagatgtcttctctgaattaaattagattctcctatttttttttattgtcatagcatctttagatttctttcaaagcccttatcgtattctgtcattataagttaccttgttattatctgtattgtccactagatagtaaactccatgaggacagaaattctgtaaattttattcactattgcatcactaatgtctataatccctaacagcaaataacagtgccaactaaatactgaatgaatgaataagcctgtttgtttcagccttctgtgtattatagaagacaagaaaatgagatggcctctataaagaatgcttgcatacattcttgtaccctaaatatgatcatttctttttctatatttttaactgtctccctctaccactttttctttttctgtgcttaaaaaagtacatgctaaaaatgccttcatctgatcttacaatgcagtcaggcaaattgtcttcaggctcagcttccattgtgttatattttccttccttctgttttgtttcttcctttccacttaaattgctgtcttaaaaattaccagttaattattctttgcctaactaaaagccttccctcagttgttattctctttgacttccatgctaataactcttccttcaaaattcctttcttatttggctctctaacttggcttcttccaagctcagttttcttttctcgctattaattttcatgtctgtaggtatcacttctctgcaggtactctcactgacttctcacttgtcttctcacttaaggcttagtcccttgtctagataactctatcaaaatgatgaggtctggttttagatgcttcttttactggcttctctactcattttttggtatctctattgttttcttactcaggctcaaaatcatagaaatcacctttgtcctattttcctcttttatgaagcagtgtaacatagtgattaagaacatatatctggagcaaaatgcctgggttcaaatcctggctcattgatctattagtttagtgaccttgatttatttattactgttaccatcttatctgctaagtcttattaatcttttcccttttttctcattctgctgcttccccagtcacaactataattacctcgtttgaattattatagtaacttcaaaactggtgccatttttgttttaaaagaaaactttaacacgagaacacaagtcacttgtgtttatattatgtgatgatgatttaagtcagttttctagcaatatgtatgcattgctaaaattgcggtttttaaaattaggcataaagtttcagtccctctgacctttcttctaaaagttccttgtgcatttttccactagggggcaagataatgtcatgggagttaaatactgctttaggaagaatgatcatgtagttattgctatgccatatctggagcatgagtcgtttttggtaggttttaatatttcttgaatttttattagctaaatatttaattgcaaacaatatttgtaactcatttcatttgtaactttgttttaggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtaagtatgaagagttactagaaaatatttatcctatttcttttaaaaaacaattttattgtctatatttaaggtattgaacatgatgttatatatagtacaaaagttactattgtgaagcaaatatttatctcagttacccatcttatttttgtttttacggcaagagcagctaaaatttactcatttagtatgaatctcatatacagtacagttttattacctgtaatcttcagagtgtgcattaggtctagatttatttatcctacatatctgctactttgtatcctctgacttatatctcttagatataatataacatactgcaatagccatgcacagattatttctgtttcagtttctttgtgattggaaagggaaatttggtgatgaagaagataaaattgtattagtggaataatgtacattattagatgtactatggttcagtggaaatagcatgaactaacagacttagagtctaataatttttgaccttagacatgtctcttatctctggacttcatttttcttttctagtaagtgaggggattggaccacatgatagccaatttcctgttttaacacaaaagttttatttttatgtatactttttaatgctgattataattatagagaaattataagctaaaaataacataaatacctctatataatggatcatattaaacataataatattataacttcttttttgagcttttatatgcctgactttttaattttctttaattggatcagattttaaaaccatgattttaatttttttaagctttcttaactagaaattatctgctatgatgccatctctgccaccatcagagaacaacggactgtgtttatgttatgtattcctcttctgccttattaacacagaccactggaaaaagaaaatttgattgtgggacaactcttaattttcaatcctggttagctgttaaattcttactttgtctggaaaacttatttttttttcttttttccagaatgttataaattcctaattgatcccaaaaagaattacagtttttatgaggatggtttgagagtattacaatgttactaagctttaattgctacagataagtaaaaatgcttaattttgtctcttaggtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggttctatctcttttatttcttaagtaccgacactgttttagaaatatactccttcaaccaacagagggagatagaatactaggatagtacttataatttaaaaaacttttttttgcatttgttatatgtattcatttgattaaattttcactaagatttgtactgaatcattttggttactattttaaaactaaaatttactttgtcagtttataacatctgtcattaactattatgaaatcatattttatgacaaaaatggaaaatattaaattttccctgcatgttaaaaagttcagattaattatcctttttaaaagaaagcattagttataggggaggaattctgaagtgtctatctccattttagctgcacagcaaaatgtaacatccatgcaggtggtttttgaatttttttttagttatatatatttgtggactatgataacattgtatgggtgttgagttctgtctagactattttctcctttcacagaagtggtttggtgcctgagaatgacttggatgcagctgtttttgtttcatctcacttaactctttcaaaactatggcagagtacagctggcagaaagtgttacagatataatccttattttccttgtttttgttggtattgtaggagggatctgtaggcctttctgtccagcgctctgtttttggagaaagaaatttcaatatacacagctccatttcacatgagagccctgcagtgaaagtaagtaatgtagcttaatagcataatggtcagtcagtcatacactgaagagaatttaggtaataactagattaacatttattatcagaaatttttttaaactagagtttggctttggcagaaggtattactgctttaagcatttagtcaaaacttgttttctccagtttttttctgaacttttctggtggaattttttctcatttttggttagctattactgtctttctctagaggaacatttagaacattaagggctttctgtcattgctagagtgtgagctccatacagttagctaactattctgacacatagttgatagtgtaaagatgtttgtaaagttaacaaaatcatcatcaatgtagatgatttcagattgacttatgatatcttgtgacagctagacagcatgagcaacaaattaaaactgtgattttagccaacgtacttgtgcagtttacagttctgaaatggagttagacactagaacataactgttttatacttctgtaatatatcaggaaaagttctaataaagtataactcaaatattggccaagctaggactaattagtaaattttaatataaggtgactttacagaaaaacccaagaagaccttaaacattttaatagacaacagtttatttacagtccaatagccattcagcagtttttaaagttatgcttccgctattgctttttgccatactagcattttaggacatcatgtttaatatcatgaaaatagaaaaatgagacttttcttttacagctcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggtaatgtgttttgatggtgttataaaatcaccagcatgctgccattagaaattgcattgacttgggtggataattttgtgagtgcaagggatcagttcagatcagtgaactgcaatgggccttgatgcagagcagtagtatgttgaagagcaaatgataacagttttcatatattatttatttaatatggatatactctggaaaacacatttgctcttatatgcaaataagtgggacggggtggcttttagaagcttagaatcacacattttgattgctgatgtagtcttttctgttttctctttttattcccgcttatgtggagtaaccagaaccaaatagtagagctcctcttttactcccacctccaactctttgactcataaatttcttcctttccttcaaggcttggctttcataaagcctttcttgattaactcaaatatataagtgtatctgtgatcaattactccaaacaaatgaatttttatacctgtgaattgctattgggttctattttttctattatggctcttattatccactactgctttttattcttggaggttattttaaacctttctggagtaagtccggggaactagtagagggggtaaaaaacagaagaagaaaaatctaggatttttatcacactagattatcatttactttatagtaacacttattatataggtatcaaggcaaaatttactgtgaactaaattgatgaatgttattttttagacttacatagttcaactttaacataactagagaaatcttatttcatcataaggcgtcagcaggttgcccctagggcaggtacaccaggattcagagcaccagaggtcttgacaaagtgccccaatcaaactacaggtatgttgtactggaaatacagaacctagttaaaatggattgttccagacgtattttattttatgatctttgtctatttataactaatatttgagttcttctgcttttaattatgtaagcagttcttgcagtgtggcattcctatttttgagctaatgctattctttatgaaagtttttaatcctaatgttgcctctctttttttgtttaaacagtttattccatagattacattttgcgtatttatttacaagatgatcttaccatcttgtaaataaatacgcaaaatgtaatctgtggaattttgctgacatcacctttgtgggggaaaaaattatgtttaatagtttttgccagccaaagacttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgggcggatcacctgagatcaggagtttgaaaccagcctgaccaacatggtgaaaccccatctctactaaaaatacaaaaatcagctgggtgtggtggtgcgcacctgtaatcccagctactcaggaggctgaggcaagagaatcacttgaacgcaggaggcggaagttgcagtgagccaagatcgcaccattgccctccaacctgggcgacagcaagacttcatctcaaaaaaaaaagtccaattttgctagaatattaagatgcaagttgaggaatggtgagagataaacctggaatgaggtagacaaggtcagaccacagttgttacagtttggactatatactgtagatattggaaagttaagtgaaaaaagtgacaatggtatatcctagatggatcattctggcaggcgtgcaaacagattagcttttggagagtggtggcatgaatttgtccgggtgagaggatgaaaatgtgaatgagggtattggtaataggaatgaaaagaaaagtgaagggttagaaaggcagagcttggtggataattggatgtagaattagggtgtggtatggtgagggaaaaaggcattcaggatgtttaccagattcctagcttgggagacttggatgtgtaccagtaaccaaggtggagagtaaaggagaagtaactggtttataggggaaggtaaggttagtttggggtataattggtttgaggtatttgtgggacatccaaatagagatttccagcagaatcaaagttaagtctgatgctcagcgaaggagctgggctagaaatacagatgaatgtcatcattatataaatgacagttgaagccatgaagtggatggaccaatcagggagagtatacagagggagaagttaaaactctgaggaatatccgtcagcacttaaggcttggagaaaacattgaaggagcaggcagaggtaccaaaggagctaagaaaggcaagtagggccgggcacagtggctcatgcctataataccagcactttgggaggccaaggcaggcagatcactaggtcaggagttcgagatcagcctggccaatatggcgaaatcccgtctctactaaaaagtacaaaaaattagcagggcatggtggcacacacctgtagttccagctactggggaggctgaggcaggagaattgaacccgggaggcagaggttacagtgagccaagatcgcaccattgcactccagcctgagcaacagagtgagactcagtctcaaaaaaaaaaaaaaaaaaaaaaaggtgatacagtagcccaaggaacagagagcagataacctggtgatactaggaagtcaacaattaagagagatgtcaactttaagaaaaaaaaaaaagagctttttaacatcaagttgagctagtcgtaatctttaactaccagaattcagaagattaaagtttctatagtgggaatgtaaattagtacaaccactatggaaaacaatttggacgttcctcaaaaaactaaaaatagagctactacatgatccaacaatcccactgctgggtatatacccaaaagaaaggaaatcaatgtaccgaagaggtatctgcactcccatgtttgttgaagcactattcataatagccaaaatttgaaagcgacctaagtgtccgtcaacagatgaatggataaagaaaatgtggtacttacacacaatggaagtactattcagccacgaaaaagaagatcttgtcatttgcaacaacatggatggaactggagatcattatgtcaggtgaaataagccaggcaccgaaagacaagagttgcatgttctcactaatttgtgggatctaaaaattaaaacaattgaacccatagagagcagaaagatggttaccagaggctgagaagggtggtgggagggtgtgggggatgtggggacagctgatgggtacaaaaaatagttataaagaatgaattatccagcactttgggaggccaaggcaggtggattgcttgagctcaggcactcgagaccagcttgggcaacatggtagaaccctatttctaccaaaaatacaaaaaagtagctggatgtggtagtgtgcatctgtggtcccagctactcaggaggctgaggtgggaggatcacttgagcctgggaggcggaggttgcagtgagccgagatcacactaccacactctagcctgggtaacagagccagaccccatctcgaaaaaaaaaaaaaaagaatgaattaagacctagtatttgatagcacagcagggggattatagtcagtaatttaattgtgcagtttaaaataactaaaagagtactttgaggggctgaggcaggcagatcacttgagcccaggagcttgagaccagcctggccaatgtggcaaaacctcgtctctactaaaaatacaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatataattggattgttcgtaacacaaaggataaatgcttgagggaatggataccctgttttccaggatgtgattattacacactgcatgcctgtatcaaaacatcttatataccccatcaatatatacacctactgtgtactcagaaaaattaaagtcttcacagtcacaaaaaaataaaaaagtaattttttaaaagtttctatagcagtagttggtgctagtgtcagctgaagaagagcttctaatgttcattacttttcactaaaatgaaagcactttgaccagtatggtatgtaattctcaaggatcattcagattttttcccacatagctatttttggattccttttgatcctataaaatgtgcgtttacttagtgtttcctagtgattaaatatccttttaaatttaccaacacgttgctcaagaaagaaaacatattttgcagtgaggattctcagtcctggttgtacattaaaatcacctgaggaacttttttaaaacattgatgcctgagccctacttcagaactgttcaatcaaaatctttgggtctgggcatctgaaatttttaaggctcccaaggtgattctaatgcataataaatgttgaggactattgatttagatgataaaattatagatttgaaatttatttttaaaatttgtcttctgttgcagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttggtaagcagttttgtattatagaaccaaacaaaatgcctttgattatctcctacaaatcacttaataaattattgtgaaattttctttacaaataaacattcagtcttgataaagttctctaatattaagtagaaaattcttcagttgcttgaaaataaatttatcacctctctatacatataatcatttaatcttattaagcacaaagtaatacactgttgcagtatttaaagtttacctttataattttataagaataaggagtaaaatcttaactccttttagttatggtttgacttttattacataaatttaccttttattaaaggcatgttttactttgtaatatgttttacttttttattgtcttttaaacatcagatgcactatgtcttggtacttagagtgtccttgccttaaatgatcttaggctatactaacaagtaaacagttaattattaatacagtgtaataaggactagggaagagaatggaaatgtgtgttgtcaggttgtgtaggtttacggtagcagagaagcagaatgcatagaaggccttaactgatgggatattattgtaagcatatattggacttggatgtcatctccttagccacgcaagttcttcaagactgggatgtgcagtgtacttcatagggcacataagaattatctcagccttgctctggccaacaatctgaactcaagtgcccatttaatgtttattttccacgctcagttatagttaatactttccaaggaataagtgggattgactcagcttactaccatacaatacagaacacctcaggagacaaagtttcagccagcctacctcaagagtagctgggctgtcttgtgctcaaccccaggatcagtgggtcttaaccagagttgcatgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatactctagatcaagtgccatgatagcaagcaagagcttttagagatttatcattgtaatacttctcatattaaaaaaaaaatagggccagccgtggtgactcacacctgtaatcccagcactttgagaggcttaggtgggcagatcatgaggtcaggagaccgagaccatcctggccaacgtggtgaaaccccatctctattaaaaacacaaaaattagttgggcatggtagcatgcacttgtagtcccagctactcgggaggctgaggcaggagaaccagctgaacctgggagatggaggttgcagtgagccaagattgcaccactgcactccagcctgacgacagagcaagactctgtctcaaaaaaacaaataataaaaataatgccataggacttgtctcagttgtattagtatgacatctgtagttattttagtcttgatcttactataactttggactgagtataaaagcctcaaaatttcaacaaacacaactgtgttcccctttgtaacctaaagaaatgacttggctgagattagcagtgagagcacctttacttctcttatctgtcctcaacccttaaacctggctccattgtgggttgtcattaagtactcagtgaattgtgttgaataaattaaaaagaaaagtcttgagctgaaacaaattcctgacacatagtagtctgtaataaaatatgttgactgatagtgttacttgaagttatttttcctgaatattgtaaatgaaccctctttttggtcatataaaaaaaagcatattgtataacttggggacatgctataacatatactattagttattttatgacttcagaacaagctaataaaggaataaaactatatgaatattcccccctggctataattttctagagagaataggaatgatagaatcagtttaaaagtaaaaaagcattggcatattgtactctcaaagaatttggtcttcagtaattgtttgtttcctccctttccctcccccatttttttccctggcttagtacaccagtccagtagttagttcagaatatgtaaaggtaactttttatcatccacagtcagattaatgactttgttgacaatctacattctcagaaaggcatctaaatgttgtggtacttgttgtttcgtacatttagtatatttctgtttaataaggaaatgtaaggcaaaaataatacatgattgccatttgtgtgattaacttttttttgcacatctgataataaacccatcaggaagttatttcaaatacatttatatttttaaaaacagatctagtttgtttatttgttcattcagaaacatttattggggctttatgtgtgccaagtactattgcgagtctctgctttcacagagcttaaattctagtgagggagagaacataaataaatactatgagaaatgagtggtactgagataaaaggaaaaggggagggaagaggcttatttaggataggttggtcaagaacagcatctctaaggatgtatgtgtcatttgaacagttgttgaaaagaataatgcctttttgtctagtccaacagacattaactgactacctaatctgtaccaggcataggctgggtttggggggttcaaagataaataagacagttcctgccttcaaagagctcagtctactaggtgggacagacatatataggatagcaaaagtaatagtagaactctcaagatacagtagaaactgaaattgatcagttctctctgagggtgtcaagcctcagaggtgattcttgatctgagtggtgatgtcagtgagagtgtcctgggcacacaaggggtgcagggcatcctaggcaaagacaggagtcatgtagtcaaagacatagaagcatggaaaggaagtagagtgggggcgtgggagctgcagctagttaaagattatagaagggtaagatgaagcttgagaaattggcagagtcaagtgagtgcctggcatagcttagtaagtcactgctttgtacttactatctcccactttatctcccactatgcaattcaaatacaacttaaatatagcatgtggtgctctatctcatactgtgtgtgtgtgtgtgtgtgtgtgtgtgtgtccatgtctataaagcatatgtttgaactttcatgtttctcatgagagaggcttctgatatattcaaataataaaatgtttttttctgtttttgttttttcttcttttgcttttagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 9931 - DNA, 11483 bp, Homo sapiens
ctagaggaacatttagaacattaagggctttctgtcattgctagagtgtgagctccatacagttagctaactattctgacacatagttgatagtgtaaagatgtttgtaaagttaacaaaatcatcatcaatgtagatgatttcagattgacttatgatatcttgtgacagctagacagcatgagcaacaaattaaaactgtgattttagccaacgtacttgtgcagtttacagttctgaaatggagttagacactagaacataactgttttatacttctgtaatatatcaggaaaagttctaataaagtataactcaaatattggccaagctaggactaattagtaaattttaatataaggtgactttacagaaaaacccaagaagaccttaaacattttaatagacaacagtttatttacagtccaatagccattcagcagtttttaaagttatgcttccgctattgctttttgccatactagcattttaggacatcatgtttaatatcatgaaaatagaaaaatgagacttttcttttacagctcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggtaatgtgttttgatggtgttataaaatcaccagcatgctgccattagaaattgcattgacttgggtggataattttgtgagtgcaagggatcagttcagatcagtgaactgcaatgggccttgatgcagagcagtagtatgttgaagagcaaatgataacagttttcatatattatttatttaatatggatatactctggaaaacacatttgctcttatatgcaaataagtgggacggggtggcttttagaagcttagaatcacacattttgattgctgatgtagtcttttctgttttctctttttattcccgcttatgtggagtaaccagaaccaaatagtagagctcctcttttactcccacctccaactctttgactcataaatttcttcctttccttcaaggcttggctttcataaagcctttcttgattaactcaaatatataagtgtatctgtgatcaattactccaaacaaatgaatttttatacctgtgaattgctattgggttctattttttctattatggctcttattatccactactgctttttattcttggaggttattttaaacctttctggagtaagtccgggcaactagtagagggggtaaaaaacagaagaagaaaaatctaggatttttatcacactagattatcatttactttatagtaacacttattatataggtatcaaggcaaaatttactgtgaactaaattgatgaatgttattttttagacttacatagttcaactttaacataactagagaaatcttatttcatcataaggcgtcagcagggttccctagggcaggtacaccaggattcagagcaccagaggtcttgacaaagtgccccaatcaaactacaggtatgttgtactggaaatacagaacctagttaaaatggattgttccagacgtattttattttatgatctttgtctatttataactaatatttgagttcttctgcttttaattatgtaagcagttcttgcagtgtggcattcctatttttgagctaatgctattctttatgaaagtttttaatcctaatgttgcctctctttttttgtttaaacagtttattccatagattacattttgcgtatttatttacaagatgatcttaccatcttgtaaataaatacgcaaaatgtaatctgtggaattttgctgacatcacctttgtgggggaaaaaattatgtttaatagtttttgccagccaaagacttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgggcggatcacctgagatcaggagtttgaaaccagcctgaccaacatggtgaaaccccatctctactaaaaatacaaaaatcagctgggtgtggtggtgcgcacctgtaatcccagctactcaggaggctgaggcaagagaatcacttgaacgcaggaggcggaagttgcagtgagccaagatcgcaccattgccctccaacctgggcgacagcaagacttcatctcaaaaaaaaaagtccaattttgctagaatattaagatgcaagttgaggaatggtgagagataaacctggaatgaggtagacaaggtcagaccacagttgttacagtttggactatatactgtagatattggaaagttaagtgaaaaaagtgacaatggtatatcctagatggatcattctggcaggcgtgcaaacagattagcttttggagagtggtggcatgaatttgtccgggtgagaggatgaaaatgtgaatgagggtattggtaataggaatgaaaagaaaagtgaagggttagaaaggcagagcttggtggataattggatgtagaattagggtgtggtatggtgagggaaaaaggcattcaggatgtttaccagattcctagcttgggagacttggatgtgtaccagtaaccaaggtggagagtaaaggagaagtaactggtttataggggaaggtaaggttagtttggggtataattggtttgaggtatttgtgggacatccaaatagagatttccagcagaatcaaagttaagtctgatgctcagcgaaggagctgggctagaaatacagatgaatgtcatcattatataaatgacagttgaagccatgaagtggatggaccaatcagggagagtatacagagggagaagttaaaactctgaggaatatccgtcagcacttaaggcttggagaaaacattgaaggagcaggcagaggtaccaaaggagctaagaaaggcaagtagggccgggcacagtggctcatgcctataataccagcactttgggaggccaaggcaggcagatcactaggtcaggagttcgagatcagcctggccaatatggcgaaatcccgtctctactaaaaagtacaaaaaattagcagggcatggtggcacacacctgtagttccagctactggggaggctgaggcaggagaattgaacccgggaggcagaggttacagtgagccaagatcgcaccattgcactccagcctgagcaacagagtgagactcagtctcaaaaaaaaaaaaaaaaaaaaaaggtgatacagtagcccaaggaacagagagcagataacctggtgatactaggaagtcaacaattaagagagatgtcaactttaagaaaaaaaaaaaagagctttttaacatcaagttgagctagtcgtaatctttaactaccagaattcagaagattaaagtttctatagtgggaatgtaaattagtacaaccactatggaaaacaatttggacgttcctcaaaaaactaaaaatagagctactacatgatccaacaatcccactgctgggtatatacccaaaagaaaggaaatcaatgtaccgaagaggtatctgcactcccatgtttgttgaagcactattcataatagccaaaatttgaaagcgacctaagtgtccgtcaacagatgaatggataaagaaaatgtggtacttacacacaatggaagtactattcagccacgaaaaagaagatcttgtcatttgcaacaacatggatggaactggagatcattatgtcaggtgaaataagccaggcaccgaaagacaagagttgcatgttctcactaatttgtgggatctaaaaattaaaacaattgaacccatagagagcagaaagatggttaccagaggctgagaagggtggtgggagggtgtgggggatgtggggacagctgatgggtacaaaaaatagttataaagaatgaattatccagcactttgggaggccaaggcaggtggattgcttgagctcaggcactcgagaccagcttgggcaacatggtagaaccctatttctaccaaaaatacaaaaaagtagctggatgtggtagtgtgcatccgtggtcccagctactcaggaggctgaggtgggaggatcacttgagcctgggaggcggaggttgcagtgagccgagatcacactaccacactctagcctgggtaacagagccagaccccatctcgaaaaaaaaaaaaaaagaatgaattaagacctagtatttgatagcacagcagggggattatagtcagtaatttaattgtgcagtttaaaataactaaaagagtactttgaggggctgaggcaggcagatcacttgagcccaggagcttgagaccagcctggccaatgtggcaaaacctcgtctctactaaaaatacaaaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatttaattggattgttcgtaacacaaaggataaatgcttgagggaatggataccctgttttccaggatgtgattattacacactgcatgcctgtatcaaaacatcttatataccccatcaatatatacacctactgtgtactcagaaaaattaaagtcttcacagtcacaaaaaaataaaaaagtaattttttaaaagtttctatagcagtagttggtgctagtgtcagctgaagaagagcttctaatgttcattacttttcactaaaatgaaagcactttgaccagtatggtatgtaattctcaaggatcattcagattttttcccacatagctatttttggattccttttgatcctataaaatgtgcgtttacttagtgtttcctagtgattaaatatccttttaaatttaccaacacgttgctcaagaaagaaaacatattttgcagtgaggattctcagtcctggttgtacattaaaatcacctgaggaacttttttaaaacattgatgcctgagccctacttcagaactgttcaatcaaaatctttgggtctgggcatctgaaatttttaaggctcccaaggtgattctaatgcataataaatgttgaggactattgatttagatgataaaattatagatttgaaatttatttttaaaatttgtcttctgttgcagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttggtaagcagttttgtattatagaaccaaacaaaatgcctttgattatctcctacaaatcacttaataaattattgtgaaattttctttacaaataaacattcagtcttgataaagttctctaatattaagtagaaaattcttcagttgcttgaaaataaatttatcacctctctatacatataatcatttaatcttattaagcacaaagtaatacactgttgcagtatttaaagtttacctttataattttataagaataaggagtaaaatcttaactccttttagttatggtttgacttttattacataaatttaccttttattaaaggcatgttttactttgtaatatgttttacttttttattgtcttttaaacatcagatgcactatgtcttggtacttagagtgtccttgccttaaatgatcttaggctatactaacaagtaaacagttaattattaatacagtgtaataaggactagggaagagaatggaaatgtgtgttgtcaggttgtgtaggtttacggtagcagagaagcagaatgcatagaaggccttaactgatgggatattattgtaagcatatattggacttggatgtcatctccttagccacgcaagttcttcaagactgggatgtgcagtgtacttcatagggcacataagaattatctcagccttgctctggccaacaatctgaactcaagtgcccatttaatgtttattttccacgctcagttatagttaatactttccaaggaataagtgggattgactcagcttactaccatacaatacagaacacctcaggagacaaagtttcagccagcctacctcaagagtagctgggctgtcttgtgctcaaccccaggatcagtgggtcttaaccagagttgcatgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatactctagatcaagtgccatgatagcaagcaagagcttttagagatttatcattgtaatacttctcatattaaaaaaaaaatagggccagccgtggtgactcacacctgtaatcccagcactttgagaggcttaggtgggcagatcatgaggtcaggagaccgagaccatcctggccaacgtggtgaaaccccatctctattaaaaacacaaaaattagttgggcatggtagcatgcacttgtagtcccagctactcgggaggctgaggcaggagaaccagctgaacctgggagatggaggttgcagtgagccaagattgcaccactgcactccagcctgacgacagagcaagactctgtctcaaaaaaacaaataataaaaataatgccataggacttgtctcagttgtattagtatgacatctgtagttattttagtcttgatcttactataactttggactgagtataaaagcctcaaaatttcaacaaacacaactgtgttcccctttgtaacctaaagaaatgacttggctgagattagcagtgagagcacctttacttctcttatctgtcctcaacccttaaacctggctccattgtgggttgtcattaagtactcagtgaattgtgttgaataaattaaaaagaaaagtcttgagctgaaacaaattcctgacacatagtagtctgtaataaaatatgttgactgatagtgttacttgaagttatttttcctgaatattgtaaatgaaccctctttttggtcatataaaaaaaagcatattgtataacttggggacatgctataacatatactattagttattttatgacttcagaacaagctaataaaggaataaaactatatgactattcccccctggctataattttctagagagaataggaatgatagaatcagtttaaaagtaaaaaagcattggcatattgtactctcaaagaatttggtcttcagtaattgtttgtttcctccctttccctcccccatttttttccctggcttagtacaccagtccagtagttagttcagaatatgtaaaggtaactttttatcatccacagtcagattaatgactttgttgacaatctacattctcagaaaggcatctaaatgttgtggtacttgttgtttcgtacatttagtatatttctgtttaataaggaaatgtaaggcaaaaataatacatgattgccatttgtgtgattaacttttttttgcacatctgataataaacccatcaggaagttatttcaaatacatttatatttttaaaaacagatctagtttgtttatttgttcattcagaaacatttattggggctttatgtgtgccaagtactattgcgagtctctgctttcacagagcttaaattctagtgagggagagaacataaataaatactatgagaaatgagtggtactgagataaaaggaaaaggggagggaagaggcttatttaggataggttggtcaagaacagcatctctaaggatgtatgtgtcatttgaacagttgttgaaaagaataatgcctttttgtctagtccaacagacattaactgactacctaatctgtaccaggcataggctgggtttggggggttcaaagataaataagacagttcctgccttcaaagagctcagtctactaggtgggacagacatatataggatagcaaaagtaatagtagaactctcaagatacagtagaaactgaaattgatcagttctctctgagggtgtcaagcctcagaggtgattcttgatctgagtggtgatgtcagtgagagtgtcctgggcacacaaggggtgcagggcatcctaggcaaagacaggagtcatgtagtcaaagacatagaagcatggaaaggaagtagagtgggggcgtgggagctgcagctagttaaagattatagaagggtaagatgaagcttgagaaattggcagagtcaagtgagtgcctggcatagcttagtaagtcactgctttgtacttactatctcccactttatctcccactatgcaattcaaatacaacttaaatatagcatgtggtgctctatctcatactgtgtgtgtgtgtgtgtgtgtgtccatgtctataaagcatatgtttgaactttcatgtttctcatgagagaggcttctgatatattcaaataataaaatgtttttttctgttgttgttttttcttcttttgcttttagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaactaatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctctgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttatatttttta

SEQ ID NO: 9932 - DNA, 102 bp, Homo sapiens
atatatataatcagcaacacctctgtgaaattgggcaaatgatttaacctccctgaattgagtttccttatctgaaaaatcaggataatcattcctgctctg

SEQ ID NO: 9933 - DNA, 239 bp, Homo sapiens
gtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaa

SEQ ID NO: 9934 - DNA, 1176 bp, Homo sapiens
cacgccattcttctgtctcggcctcctgaatagctgggactacaggcgcccgccaccacgcctggctaattttttgtatttttagtagagatggggtttcaccgtgttagccaggatggtctctatctcctgaccttgtgatccaccggccttggcctgccaaagtgctgggattacaggcgtgagccactgcgcccagccaaaagtgttaatcactgagatgtctactgagaactccagattcataaccactctcagaagcattaatcaaaccagaggaacttagaaccttatcagtgtaatcttgatattttgcatctctaccctgtggacaagtattttatttttttccctttgagtatataatgcattaatatttcaaaggactttgcaattaaacacagaagaagccatctttagactcaaccctaatactactttcagtagtgcagactaccttccatttggcatatgtttgtatactgtatacattttcatagttgaaatcatttatattctgattctttgcaccagacaaatactttctacaaattatcttcatatcattttagtaatttgacatttcgttgtgttactcatcttattccactcttgttggacaagtggactgttacagtgatgatagctttatggagtatttgcttttattgaattatatcaccaagataaatatccagaagtggaaatacttcgacagagagtatgaaatggctcttactacatattactgtattgtttttctgaagggctatatcattttaggattgagcaagttttaaaccaaattttatgtaataagtgtatcatagaattatatagatggaaaggatttctctggtgaacctccctgtttacaaatgaggaaactggccaggcatggtccctctcacctgtaatcccagcactttgggaggctgaagcaggcagatgccctgagcccaggagttcaagaccaggctggacaacatggtgaaaccccatctaccaaatatgcaaaaattagctgggcatggcggcgctacctgggaggctgggaggaatgtttgagcccaggaggcggaggttgcagtgagcagtgatcataccattgcactccagcctgggtatcagagtgagaccctggttcaagaaaactttttacaaaaaaaaaaaaaa

SEQ ID NO: 9935 - DNA, 1177 bp, Homo sapiens
cacgccattcttctgtctcggcctcctgaatagctgggactacaggcgcccgccaccacgcctggctaattttttgtatttttagtagagatggggtttcaccgtgttagccaggatggtctctatctcctgaccttgtgatccaccggccttggcctgccaaagtgctgggattacaggcgtgagccactgcgcccagccaaaagtgttaatcactgagatgtctactgagaactccagattcataaccactctcagaagcattaatcaaaccagaggaacttagaaccttatcagtgtaatcttgatattttgcatctctaccctgtggacaagtattttatttttttccctttgagtatataatgcattaatatttcaaaggactttgcaattaaacacagaagaagccatctttagactcaaccctaatactactttcagtagtgcagactaccttccatttggcatatgtttgtatactgtatacattttcatagttgaaatcatttatattctgattctttgcaccagacaaatactttctacaaattatcttcatatcattttagtaatttgacatttcgttgtgttactcatcttattccactcttgttggacaagtggactgttacagtgatgatagctttatggagtatttgcttttattgaattatatcaccaagataaatatccagaagtggaaatacttcgacagagagtatgaaatggctcttactacatattactgtattgtttttctgaagggctatatcattttaggattgagcaagttttaaaccaaattttatgtaataagtgtatcatagaattatatagatggaaaggatttctctggtgaacctccctgtttacaaatgaggaaactggccaggcatggtccctctcacctgtaatcccagcactttgggaggctgaagcaggcagatgccctgagcccaggagttcaagaccaggctggacaacatggtgaaaccccatctaccaaatatgcaaaaattagctgggcatggcggcgctacctgggaggctgggaggaatgtttgagcccaggaggcggaggttgcagtgagcagtgatcataccattgcactccagcctgggtatcagagtgagaccctggttcaagaaaacaaaaaacaaaaaaaaaaaaaaa

SEQ ID NO: 9936 - DNA, 1095 bp, Homo sapiens
cacgccattcttctgtctcggcctcctgaatagctgggactacaggcgcccgccaccacgcctggctaattttttgtatttttagtagagatggggtttcaccgtgttagccaggatggtctctatctcctgaccttgtgatccaccggccttggcctgccaaagtgctgggattacaggcgtgagccactgcgcccagccaaaagtgttaatcactgagatgtctactgagaactccagattcataaccactctcagaagcattaatcaaaccagaggaacttagaaccttatcagtgtaatcttgatattttgcatctctaccctgtggacaagtattttatttttttccctttgagtatataatgcattaatatttcaaaggactttgcaattaaacacagaagaagccatctttagactcaaccctaatactactttcagtagtgcagactaccttccatttggcatatgtttgtatactgtatacattttcatagttgaaatcatttatattctgattctttgcaccagacaaatactttctacaaattatcttcatatcattttagtaatttgacatttcgttgtgttactcatcttattccactcttgttggacaagtggactgttacagtgatgatagctttatggagtatttgcttttattgaattatatcaccaagataaatatccagaagtggaaatacttcgacagagagtatgaaatggctcttactacatattactgtattgtttttctgaagggctatatcattttaggattgagcaagttttaaaccaaattttatgtaataagtgtatcatagaattatatagatggaaaggatttctctggtgaacctccctgtttacaaatgaggaaactggccaggcatggtccctctcacctgtaatcccagcactttgggaggctgaagcaggcagatgccctgagcccaggagttcaagaccaggctggacaacatggtgaaaccccatctaccaaatatgcaaaaattagctgggcatggcggcgctactgggaggtgggaggaatgtttgagcccaggaggcggaggttgcagtgagcag

SEQ ID NO: 9937 - DNA, 454 bp, Homo sapiens
gctgctgttaaacacttcttcattgtgcttatgagtttagcatgttaatgcttacatgtaaaaactaattgcttaaaatgctggttctgaaattaatcacctaatgcactctttattaagaaggttaaggagagagtctttgacaatgattctagagtctcaaagggaacaaagagtttaaatggaaggacaatttgaaatatgaaaaaaaaactactaaatatccatgtaataaaatgacaaagagaacatttcattttttttttctaaccaaaaatgaaagtgtagtcacaaaactttagtaggcttacgaagcccagggaaaccaaagtaaaactgtacccaggatgctaataaagttcttaatctttggccgggcacagtgccatatgcctataatcccagcactttgggaggctgagacaggaggattgcttgagcccaggagttcaag

SEQ ID NO: 9938 - DNA, 454 bp, Homo sapiens
gctgctgttaaacacttcttcattgtgcttatgagtttagcatgttaatgcttacatgtaaaaactaattgcttaaaatgctggttctgaaattaatcacctaatgcactctttattaagaaggttaaggagagagtctttgacaatgattctagagtctcaaagggaacaaagagtttaaatggaaggacaatttgaaatatgaaaaaaaaactactaaatatccatgtaataaaatgacaaagagaacatttcattttttttttctaaccaaaaatgaaagtgtagtcacaaaactttagtaggcttacgaagaccagggaaaccaaagtaaaactgtacccaggatgctaataaagttcttaatctttggccgggcacagtgccatatgcctataatcccagcactttgggaggctgagacaggaggattgcttgagcccaggagttcaag

SEQ ID NO: 9939 - DNA, 27492 bp, Homo sapiens
tccaaagtatgttatgttaagtttcgtgatccatcaagtgttggcgtggcccagcatctaactaacacggtttttattgacagagctctgatagttgttccttgtgcagaaggttggtatctcgctttttttcctcttatttgaatttctgtcctgtctgttattgcctttagctttcctagagattggcaagtagacagtactcttggtgtgtgtgtgaaagtaagaatgaaatttggaggaggtaaacctttttacctaatagtaatattaaaatggttaatttatgacatgtacatttgaggttttacaatttaacattcattggcttctggtttgctttggctttctgtagtcaatttgcagattgcaaagaaagctttctgaaattaaaaaataattgatatgggaaattattttaaatgcataaacaagcatttaccttgtgtgttcaatattaatactattacaaatgaaaatagtgtacacattttggcaaattggggttaagtgatatttataagaaaatatttgtaatttatactttcaagtacactcttaaggtaatttaccttaattgttactatgagatcattattttatattcaatgtaattgtttgctttgcaactggaatttaatgttttcttttactggccccaaaaaggggcaggaggagtgttggaaaaaaaggaaagcaattttccaaagcctccatgaaggaagtagttgttgaagataggaacaaaggccttaaagtatccattaaattttatgacctaaactgctttaagaactaattattactaatattttttagtaacttctgtttacagagccactcacgtataatagactgtgctgaattttgacacttctggtgtataattaacttttattcagagcactgactagcatgtgtacaggattttagaattgggttattataaattaaaatgtcttaaagtagattttctctggtggatgattgaaactgttttaaacataaaggtttatggaaaacagtttgatgggctttcatatgtaatttttaaaacctcttttagtggccaggctgacattaaaataatatataataagcagtttgctgcactttaaaggttttatgcttatttcagaatgcctgttctgggatgtcaaaaacattacagtctaatacagtgagtaccaggctcgtattttttaagtcccagaataggacattctcagtatttttcagataaatttggaagtgtctttcccatgcttgggggttagagtgggtagggaagataaaaatggattaaagttaattattggccaaatgtatctttatctgctgatctgtaaggctacagtaagccccaaattggtgaggtgggaaaggagctggtgaatggtttcgttctacaaactttgtagtgaaatttcatactgagaaactgcatgggaaaaaagaaatcaggtaaaaggtttattaaactggaatattaattatatcagaaaattaataccaccaataacactgggtcttttattgtgttagcttattactgaattggaaggaagaattttatcagtgttgcttggttgaaacctgctttattcccatagaatctttcatatatctgagaagccctactgtattttgttataaatgttcaagatgatgggcgtgtagatgtcccttttattgtttattttacttgatagagatgaataaatgcacagtcagatgtacctttttagtgtttttaatattacaacttggacagttttactgtttttgaacagaaaaatttaagcatacttttattgcaatttagttataagtaagtaaatattttgaaacactaacctacagttggtattggtgaaacattcagatatacgtttttcattagttgtattaaatacggcagagatgaatttatggaacctcgagaatttcacagtgagctgttaaaatactgattatgcactacaagcaaagaaatagtgcattattgtactaaaaaagatagcagagtgagtgtgaaataaccaaagaaaagtattccagtggagtaagttctgtaagaggagatgtgctgtggtgctgtaagcaagcagtgttctgttgacctcactgaatgcatcctttccttgatgttgaacaaacagcatcatgacataagtgagaaaaaccatagaaaaaaatttaagaagttttttcagtttctttgaattgctgttttttagtgtagacagtaatgtgagaagatcctaagttgtaaaagtaacatttgatgtgtaacagtttcatgcatattaagccttagcctttgttaataaaacatgccatttcaaaataaaatatgctttcattatacttgtccaaatatgacctctttttgttgttgcgtgcatttcagatttctttttataaatgttaacacgtagaaaaagatacggtcaaacataacaagggtgtcagcctaatcatcagtcataactttatgtccacattttctggtagatggattttgactattaatttggttttgtatgttttctctatgtgatatttgtgcattattagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagtatctcaggaacactttctgatctcagcgcaacatttttctagtttttttcccccctagtctacatctctcataaaaactgatagcttctaatttttgtccttccccctggaattttaggcatacaaaatcatcaaggaaaataagtaaatataacaatctgggagtaaagaagagcctttcatttttatgatggttatttatcatataacttatttccttgacttatgaagactttttgttgcctatgtggggaatggatatttgagaaacttaagtatttgcatgtaggtttttgttagcttgaattttttgttgaatatttttcagaggttactagcttctaaatggattctgagattaggactataatactgtgagagatgttttcctcagttgactttgaggagtatagtttgggaaaaatgctaaatgcttatttgttttatacttttataagctctgttatttggagggtaaatttggtagaattctatcttggaaattaagcaatggagctttttcttaaagtacttttgccattacctttaggtaattagaataagtatatagagtaattagaatggtaattgaaagttaatttattaaaaaatgtgcttatagtggatttatacatttatagtagtatactatatttatagtagtatactcttttgaaaggcagtgggagagtttgacaacctactgatacttaagctgaaagtgaaagacttcataatactaagtagtcaacttttggccagtgttgaataccctttttgtttgtatagtctttctacaatgtcttcaataggtagttttacttattaaaggacaagtaatattaaatttgggacattactagattagaactctgagtttccttaggtgcatacattaaggtagtgacgatggagtttctgcctcaaaacctcaatttatcaagaatgttcaggttttacaaaccttttgagataataccaatttataacagataaaacaggtgaaatcaatataaatagtatagtgtatatgtgggtatatataaatacatgtgttaataccaataactaatacatataaagcagattattgttatttgatgttttcagtaaggcctacctgccttttgttgatgcatgttaagaaatctgttctccagaattttcactgaaataataaagataactttgtttttgaaagtaataaagtaatataaacttagatgctgcaaaggtagaaaatagtaggttttatttgcttcctataaataaggcatagccattatttaaatcaagttttaaattccaacttgagttccatccatgtttaaagatatattcagataatattgtttagggatttatctctgcacatgtggttgttttaaatatttttacaactgaaaccaggcatggtgcttgtggaaatttactgcatatgctatatttcagtttagcatgattttgtgcattgtcttttaaaacacttttggagaattaataatagaaatgctttaccagctaccacatgagtgttcttctaaatatatccacatgtagtcaactatttaagaattttttttttttttttttgcctaaggggataaggaaaaataatgtgaaagttgcagtccttatcagaagtaattgattagaattcagcaatgaatatgccaaatcgtacttatttcagagtaagtttttcatttttttaggttgtagggagtttttttcctactgagtgttattagattattttaatgttactattgttattaggcaattaaaatgtttttaagcaagctttaaggcattaacctcccccttcagataagtatacataaattggttctaaaagttaataagaagttttctgaaaccagggaactttttttttcctgaaacatttttagtagtttcccaaggcatattttttggaactgagttcttttaggcatctctgatgttggtgagatgctttattaactgaatggatgtaggcttccttttacgttgaagttgattacatggagtaagtttttgttttctatttgaaattaaatggaatctgttggagggttatcaaaattgtttgcatcacaaataggtagtttcagtaacaggataggggcactcattaagaaatttcaattcgcacatatttgttttttctttttcttttttttgactaatttggttatttgccatttctggggattaaactttaaaaaatgttcttcttttctgtatctgatgttctgtgtgctattagtgatgcagccaacacgaacggttgtcatgtgtaacacaactttcgatcaccgcgaaaacaccgtcctgggaaagcgtccatgcttgatatcgtttggttcatgaacattaagtttccagtacaggtgacccatagctcaaagtgttaaataattgtctacattattcaatttttaaaataatattccattaatgagattgttaatatttgaagttttgctcacttttatttttcctagtagagcaggataaaaggaaagacttaagttcttatttatttctttatacagatctgatagatagattcatttattattattattttttaactgcaagggtaattgtaaaatcatagtgtaaagtttgtgtggtgtttctgctttttgtaatgtttggaacttgcctctgcaggtaaaatcccagaggaatccaaagccctctctttattggctcctgctccaaccatgacaagtctgatgcctggtgcaggattgcttccaataccgaccccaaatcctttgactactgtaagtactataagctggcttatgaaagaggtgaatgttcaactgtgtgaccagttgaatagagagcttcagattatttgcatttggatcttcttcttttttttttttttaatagagaggattcgaaatcactgcttaaactttttttttcactttatcagtgacttaacgctgcgttttggatttactcctgaagtaataggggattcatttaaatttgagaaccccaatagattattcactagaaaatcagttattaaaactcaatattttagatagcatagaggatctaggtaactgtatttctcagttaatgaggattaaatccatttaaaatacgtgaaatgatccacaactttggtaatgggaaaaaaacaggtctttgtctgatattgagaaaatgtaataaggtgaaaacatggcaaaatatttttccattaactatgcagaattaaatcataatttagtaatgcttcctttgtgatttccaagtgggattaaaaaaggatattacggccaggcgcggtggctcatgcctgtaatcccagcactttgggaggccgaggcaggtggatcatgaggtcgggagatcgagaccatcctggctaacacagtgaaaccccgtctccactaaaaatacaaaaacttctctgggcgtggtggcgggtgcccgtagtcccagctgctcgggaggccgaggctggagaatggcgtgagcctgggaggcggagcttgcagtgagcgaagattgcgccactgcactccagcctgggcgacagagggagagtctcaaaaaaaaaaaaagggtatattactattactggttcttggtttttgcttaaaaaactctggccatatttattttaaaagaagtgccatttttcttcaaaagacaacatagaacaaaatacaaagcttgccttaattggaagttgaatctagctttgtggtgttggataggaattgaactaagaaatgaactatgtgattgtagttaatttatctagattgtaagagtggtttctgaaattttgaagtgcaaaattttagatttgtagtttttacataacattgctatgctgaagacctgcattctgattcttggggggaaatgttttttaattgaacttatgtgttcaaggaacagaatggtggtcagtatggttgaagcatagtgagtgagggtcatgagtgtttgagattggaggggatagataggacacagattatggtagggctttttagaccatggaaagaggggtttgagttttattcttaaggtaattagaaaccattgatgggttttaagcagggatatgacatgatttgacatgttttaaaaagatcagactggctgctgtgataagtgacattgatttcataaacttccgttttcaccattagcaagtgccattacttaacagttgttaaaatcttagttctgtatcatatttgtatatatagtcattaatggtcaaaatgttctctaatagtataagtggaaatgaaaagagttgtgcttttttccttgaaagctcttttcgttctgaaaaattttttctgttttcaaattctgagatcttacatttcttctagtttacattcatattaaaaataatacgttccttaatgctgaaagtaaaaactgaatttagtgatgctatagaaagatcattcaaagtttttttgaaggtttttgcccttttcctaccatggcataagtaagggctcaatattttagatatattttcttaggtaaactttcagcatgataataataacccatttcttagggttgatatgaggattaagttactacctcagttaaattcgatgctatgataattgttgactgttaggaactcatactcatactcatctgtgtttttcaatgaccaaggtacagttgattctcattctttgtgaattctgtatttttgaattcacttagtaagtaaaatttttttgaaatccccacatcaacagttggagcacttttgtggtcgttcgtggacatacacagagtggtgaaaaattggggtttgtctatttgcacggaggtcgaaatcttcttgttttggcactcaggcagtaaacaagcacgcagtctgtttagtgctatgttctttgaattgttgtgctttttgttggtgatttcactgttaagatgggcccacaagtgtagtgccaaactgctgtgtagtgttcctaagtacagggagattgtgaagtgcctcatggagaaaatattaaatacatgtattagataagcttcattcaggcctgaattgtagcgctgctggctgtaagttcagtgttaatgaatcgacaatatataacagctaaggtgtctttaaacagaagaacatataaaataaggttaaatattttactagttaatgtaaatgtgaccagaggcttgtaggaacttcaccctgtattttccctaggaataatggttcaatattcaataattcattgttcacggaaactatagaacatagctatgtcaggtaatgagaaacagcctgtcttttagggtcaagtttaaaagtggctaaaatatccagacagtaaaatatatttcaaattacatttaaaactaatgtgaccttactttaataactcagacatatatatgactgaaagttcggagtccctagtctcctttcattcttgttgagttagttcattcttttcaagattagagaatggtatctttggatactaatagaaaatatgtgttctgtgtgttttttttcttctttcgatagcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccaggtaactaattaaagaagaaacaaagcagcagtagcccttattctttttctcttcttaaaaatcatatcagtggatacagtaatatttatctgattttttaaatggatatattttatcaaagtgtcactttgttcccttagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaagtaagaaatcctaaacaaagaaattttaatgattttgaaacatttaaagtatttttgatgtaatgaaggctttttttttctttttaatagtaattggcaatttgtggaaaggaagactttgtgttaagtataaatgaaatacatgagatacttaccattttagtctttaaattcctttatttagagacatttattttctcattttctgttttctagggtctaattcagtgttaacattatttatataccctgcataacggttgtaggtctttttccataaactttaatagtcaggttggttttacattatgacactagactaattgagcaacttaacaggtgggttgaactacagtacttccagtaacaactgtggtaaattcaaaatctacagaaggaaattataagtgcccagaaatgttttaaaccagaaattttgacttttgaggtttgcttacatccttgtttgtaaaacgttgataatggccttcgagatactccagaccagaaattctatttcatgcagattgttgaggcatatatagttttgcttgaatttcatagattgctttagttatacaatttgatcaggatttttctgttaaggataagtttttagtgggtacttgtcttcccagtgtggaaggggtaaagcaagacacataatatccattcatgtgcatcagagaagtcactcttacctagtagaggaagaattttttcagatgccttgcacattcaaagctatgtctaactcagccatggttcagcgttggttaaaatggtgtacataatatgatgatatacaggtagcttacccttcttctagagtgtacaggatatcagtaagatcttttgatttgaaaatagaaatgattcattttcatattggtatcaacattttaatttattttaattctaagctatggaaaagcacttcatctagtctgtttgaattaagttagctagggttcaatttttcttttctccctgcttttggttgtattcgcaaggaatgataggaagtggggatgagagattaatcatggttttgaggttgcttttggttattctgtatatcattcttacgtgcttctgagatgtcctcacgtttataaatatgtgtatcatataaatgtttgtttcatgttttataaaatgtggtgtgtatttgtgatatgctaatatttttaatttagaataaatcactccaacaatgcaatagtaaaaccccctgagatgacacctcaggctgcagctaaggagttagaagaagtaatgaagcgagtacgagaagctcagtcatttatctcagcagctattgaaccaggtaagtacataacgttgttacataggtcatagtttaaagatcatagactcttagaactggaaggaattttagaaatcatcttgttcagtcacttcattttacaaacaagaagactgaaactcaagaaatagtaagtagcatactcatgtcaaagaacaacttagcccatattttatctctttctgtgatactgaattgaggcactttagtctgagctaatcagctctgtattttcatagcaaaatcagtgctcacaagtgatttgctgaaagcaaaaatgttattgcaaggctaaaaagagtacatatatttaaaacgttacgactcagcaggtttacttttcctcaacattttaattttagaagtagagaagagagcccgtgatttagaaaaaaatacagatactgtattttagtaaggtaaaagaacatctatttaaacttttgtgttgctaatgaaaataattaaaaaacccattctaaaaacatctaggtggtttacatttgagcagattttctaaatcaacacttagaatttaagcttcaaattctagcagaataagtggagaaaggacttaaaatcactgtcacaggaattacagacatgttgtaatcgtacgttacggcagcaacaaaatattacgaacagctgtttataatcatctggtttatatgtactgctgcagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggtgagaatttctgctgtcatatttaaattttattttagttttgtatttaaaatattaagattttatgagttttcgtcaaaatatcagaagttagaaattttagtagtgtacacctgaagtgtggttacctttaaatattgttctaattgtaatactgtagttgagaatgaaattttgtctaatgatacttaatttttaaatatttgaacttatctttatttttagaagttagttttgtgtctaaagatactctattccagatttttctaagagtaaactagtctttatatagaagtgacaaaagctgttttcattcttcatattgagaaaagggaacatccttagtgaccatgctgaaaataattgctcaagttgcagcttttttgttttgttttcccagtctattccaagtttggggagcaccaccccagatctttcacgcaattccctattttcagtaccacgtatccaaaggaacactttgagtccttggtattgctggtgataagagcctcctctgcccacttttggacctgaaacacaggagtaacttgcagtttcagcttcagttttagtactttgcttaagctctgtttatcttatttttgatcatagctttgtccttttgattttctttatctgtcatttctttgtctttggtataaaggggaccttaaaatgcaaatttggcaataccatcctaattggaagtaccctaaagatcattactaaagttacaaattttgttgtctattttaaggtacggagggggctgtttttgaaatgtgaaagtatgtatagtggatcctaattgcatgttatgtgtacatacgtactcctatgtatgtcttgagagagcagggagggaagagtgtatctgtgtatgttgggattttaaagaaggagaaaggatttgggggagggaaaaggaaccagtttgttgtacattgttttaccagcaggctcagtttactttgtttttgtgtgtgtgtgtgttgatcaaggagattcaaagaatgaggaaaaataggatgttctttcttagattctagtaaacaagtatacaccagatatactagtgtatacttgtctattcttagtttgcaaaatctcctttggaatatggttttactgcgtttatccaaggacttacagtaagacactttcagaaccaagtgaaggaggttgtttcacatacaagaataaggcagtgcagcagaggccagaatcaggaaaggacagtggaacagaagctgcagtgatactagactgtggatatttccatatgttgacaggatgtggtgagggtaaaggagatcaaggaaataatagaattgggctgaagagtaatattacaacttcttttctgaggaagactgatgacctggatctcatattgtgttgattgtaagagagagctaatgtccaagactggaacaagacaaaacttgatgatgaataaaattgttgtttctttgatcatctaagtgaagttttatgtgctttatgtagatatgtctatacagatgtacacacaatgtctgcgtagcattagaaataatgtatatatattccttttttttccccccccaagatgcagtttcagtccgttgccgaggctggagtgcagtagcttgatctcggctcactgcaacctccacctcccaggcacaagtgatcctcccacctcagcttctcgagtagctaagccacagacacgcaccaccacgcctggctaattttgtattttttgtagaaacggggttttatcatactgcccaggttggtcttgaactcctgagctcaagcgatcctcccaccttggcctccaaaagtgctgggattataggcatggtatacatgttcttaactgacatatatacatacatacatacttttgtcagcatattctgtttttgtgcatgcatgtggaaacatgtagccttaagttcaagaacaaatacaaaagagagaatgagttatctttaaatgagaaaaaaaaaattccttacctaaaaacatttaacttaaagattctgacctggaaggatcccactatcccccagaaatcaggaagggaatgataggcctttcttgacatttcctcctctgctagtgggagttgttgtccttgaatctcaccctgacctattagacttagcatgagcgtgggttgcaggaaccctttaacttaaaggcccaccttctactttttcaccattttcaaatgcttctagagccatgcttcctacctcccaaccctcccccacagcctttccctgttccttccgcttcttatggttagagagaggaaggggtttcttgtcactgtgaccttggctaggactagggaggtatgtttccattttatccaagttttgatgcctgttttatttattgagacatagaaaagatggatagtactataattgttataattttaagtaacctttatagattagaacaggaactgtaagacattttataatattttaatggaaaacaactgatttacaaatgaactttgatgcagcataatggtaagttgctggttttttacagtttaatttaaaaataagattttgcattattcagaataatacaatttcgcattaaaaatgagagttaatgataaatctttagttagattagatctgctcttgactacttctagcattcttaatcagaaaactactagtgggtaagattgacgtgaaaatatttaacgtcacagttaaaatgtaataattactcttagtcactgtcttttgacatctcaattgcagggtaaggttggaagccaagtgatcagtgctttttattattaacttatttatgagagttatacttaatttttaaaaataagttttgcttaaggttggtggaaagcattgctttgaggaaaacaaaagaattatatttttagcaaggacaacttaaaacagaaatcttatagtaagactttttattaagtatgtagaagcaaaggcactttaaaagattaccctatgtggatatctgtaaacggactaataatgttctcagttttgcagttttgccttaacatctactccttaactttcatggctcttaagtactagtgataaagatttcagcaagctatgaattatcttcttgtattaaaaacatggtatgtgatttcttatctagggtctttggaaaaaaataaaataaaaaataatgtggtatgttgaaccaagtgaggctaaaaaaaaaaaatatggaatgaagacaattgtatattatttttacagccaaatagtagatgagtagtttaaatggaaattagctattgaaattttgatttgtaatgttgattagtattttaatcagaattttgactaactgaaaaatgtgtttaaaaacaaaagattttgttattaatgaggattatttggaggtttttctggtttcaaagcataccacaaaacatggtctttttcttttttcttttatttttttgcgatagaatcttgctgtgttgcccaggctggagtgcagtggagcgacctcagctcattgcaacctctgccccccgggttcagttgattctcccacctcagcttcctcagtaactgggaatacaggtgcatgccaccatacccagctaatttttgtatttttagtagagacgggtttcactatgtttggcaaggctgatcttgaaatcctgacctcaaggcaggtggacctcaagtaccacctgcctcggcctcccagagtgctgggattacaggtgtgagccactgtgcccagcccaactatatttcttttactgataattgttctaaatttattaaaacatgactatcaagatgagttttagctgtataaaggatacttatagaagttcattcagcttccttggaatacgtacataaggatataaagtttacatttatgttaacttttaatgatgatgacattgagagttaagatttttaaacatttattttgtgctagagaatactacgcagttttacatacatcatcagttgtaatcctcatgacagccctaagagatgcaggtatgattgctactccactttatagaggaagaaactcaggcttggagaggttaagtgactagccagagttctcacaggtagcgtgtggcagagctgactttcagagccagattgtcagactccaaagctgttgagtctaatcactttgctatttaagttgtgtacatctgttttgttacaatttaataagcagttaggatacctcgttatgaaaaaaatcacattctcaaaaaactttttcagtgagaaagggggcctagtccaaattggaataacagttacttttcctgcaattaaacgtttcctgcagttaacagtttcttttcatacaggttgagactcacaaatttgaaaatctgaaattcaaaaggcttcaaaactttttgagcgctttcgtgatgctcaaaggaaatgctcactggagcattttggatttttcagttgtgtgtttgggatgctcaaccagttttatgcgtgtgtatatatagaatgcaaatattcgaaaatctccaaaaatgtgaaattcaaaacacttttggttccaagcatttcacataagggatactcaactggtagctatgattatagttacagctataaaatcaaggcattgcaaatccaatatttgattatatctagttttaacttatgagtaatgatttttattttcctgtcacagtggcgctgtcattaggactgtgcttccttttatatattctttttgtttgttatgacagacagcacacattcacaggaactactcaaccacgtaaccactactccctgtcatgatgtgttatgaccagattacatgcaagtcaacagggaaaaatcttctatactgatttgaggcataaaatgactagcaaaagccacatctgaaaatatacgaaataactgttaaattctttgtttctgtctctgttctagacaatgaaatatccggtaaagtttccagtaaatgtatttcagattatgtaactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacggtgagttttagagaaattaacaataatttttttttcctcagagttctgttagtgctaagggataatattttaattggcttcatttgttaaaaatctgttgtggtttaggtttttaatgagagaaattaaaccttttttattgttttagtaatctaggattaatattgattgccagtgatctgaatctgatgtcagtgtgactcatgaggtttccaaactactcagttcagcttgcgtagtatgaatagctttgtttagcagcttcttgtacacctgagctatataaaaatgtatatgtaaatgtctgtaggtactataaattgtcttgtgttggtaattgttgaagagagagaggtctttttggaggaggtagaactattttagttatgaatttatttatttttgtttttaaagggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcaggtttgataatgcttaaaatttttacaaagggatttgctgatgacaattggaaacaaaattttttacggagggagaaaaggttactgtacgcaagtggaacctgtaaagtaatataagaacattttctcctaatttcagagtaaacatttctctagcagagtggggaaagagatgatactgggcaacattatttgaagagttttagctattctttgtaaccactattttaatagaataataataattgttattttcttagagggtgggatggcagggaaaggtactttttttaaaaagcacattaagaatttgcgtcttaggctttttcctgaactttttttgaatggtgtgattaattttaatatgtaaaatgattgctgaagttgcagtgttagccctctttgtcacctaagttaatttttatccttattttgttaagtgcataacatttaaattttggtcgtgttttattttgtcagttttaagggttagagtttttccttaggaccgtgatttcagtttattaatagctttactaccaccaggtggcagcaagttgccatagtaacagctgtacaatgagaacaacttttgagatttaagattatctaaacccacatcctttacttcagatgataccatgactgtaaatggaagttcctaacttatactacactatcttaaaaatactaaatatatatattagcaaatttttgaagatttttaaagatggttttttaatagaaaataatttgagataaaggaatatatgtttcccatttttaaaacttgtgctttagtagtttatttttaataccagcctttgactagataataaaagataatcgtagacatttattgtgcactttactgtatgccagacatgatgtcagtagactttttcatgtctcaccttatttaatcctcacaacaggcctgggagaagattattatcatcactgttttaaaacatgaggaagctgacgctctgtatgagaagtatagtagcccttttcctttattttagagattaagtttgagaattctctagtacttgtacttacttttaaaaactacctcagaagcataaagttgaaagcagtagtatatgttaaaacaaggctcaaaataaacagatcactgctggatttcagcacattgaaccacagattgaagaattaatgtaacctcctttgctgtgggtactggtttgagccttgtaaccacacctttactgcaaagtgattttattgattctgtgtcacacatgcctttgtgtttctgtgattgtttagacattacctttcacagcaccaaatactattttcattcctttttaataacgaatttactttttttgatgacatgggaatgtttaactttttctcgggccattttaagttgtttggtgtagaggaaagttcaagtgttcacattcattcctaaatatatatgtatatattttttgaaacagagtcttgctcatcgcccaggctggagtgcagtgtcatgatcttgacccactgcaacctccccctcctcggttcacgtgattcttgtacctcagcctcccgagtagctgggattacaggtgtgcaccaccatgcctggctaatttttgtatttttagtagagatggagtttcaccatattggccaggttgatcttgaactcctggcctcaagtgatctgccctccttggcctcccaaagtgctgggattacaggcatcagtcactgcacctggctcaaatacattcttcagtaacaactggggccttgagaataaaagatgactgacattagtttataaaggcagcagtttggaatgtttcatgctttcagaagagcttggtaaagagttacaatttctttgaatttttttttttttttttttttttttagacagagtgtcactttgtcacccaggctagaatgcagtggcacaatatctgctcactgcaacctctgcctcctgggttcagcgattctcctgccttagcttcctgagtagctggaattacaggcgtgtgccaccacactcaactgatttttgtattttatttaatagagatggggtttcaccatgttggccaggctggtctcaaactcctgacctcaggtgatccacccgcctcagcctcccaaagtgctggaattacagacgtgagccgccaccgcccccagccaagagttacaatttcttgtcttttagcatttttctgcttttcaaatgttctgatttgtttactaaatggagaatattttaactgttcaaaaaatagttaatatttttatttctaacattgtctcctaatttatacttttaaagaaaatgatattaaataattttttaatgcttaaatttactgtcattaaaggtgataccaagaaagggaaggaaaaaacaatatttattgagcacctactctgtgtcacactctatgctttgcacattacagattttatcctaaatcctcaacaacctaataaaacttgaattattaattgtctttatttttcagttgaaaaacagattaggttaagtaatatgatcctggttgtatagctgggtaaggtgtataactcaaatttaagtctaaatctcaccaactttagttgttaatacaatttctttctcaagtaattgtctagattgctgtctatggagactttcctctcattatcgtcagctagtaggtattagacatccacttgtacatagtgctttctgaacaaataagtaaaagaattacactgataaaggcagagcgattttgtgtaatcttaaagtctggaatacgctgacattcacatgctttgaaaaaagtatttttggttcttaggctgagctgttaagagaatgtcattgatgtaatcaaataatgtatctaatttccacattagaagtgtaattgtggagtgtcttgggaataaaagtgggtaatggaggagagagtcttaggtagaggtagaattgagttgtgttctcagagttcttgagctttgtattttaatacatattatatataccgtgtgagcattttttattttagaaatgaaaaacttaaattattttattagtctcttagaatcagtttcctgaaatggtaaggataacatgaattccagaggatttggttttttagctatgtggtcactgattatcagaacttgtgagatagatcattgggtatgtcctcgtaccatatcccttaaattatagacctagtgaagttcattgtttctgagttgaagtagtttagaatatgtatcatttgctaatctgataagcaaaatggtttttaataataataacgtaatctattttataattattcctgtcatatttacttttcagattgtaactgttttgcttacatctaagcaacttgtacactaaattttaaattaatagaacaacagtaatgaaatgataggaggttggagggaaaagcaatttctctctaaaatgatagtaatgtaaatgctttttaagtagacattgttgataattgggtatagaaagttcacattttacaagccagtttatgtttcagtttttgaaaagggcctgttactttgttataatccacagtggggcagcaaggagctagatacatgacaaaggatttgataagcaaaacttgttttagctgctgagaaaatacacttgagagaagcagaaacgccacgccattaatattttttctactgaagaaattgttcaaataaacgaggtgaaaaggaggaggtcttctactcttcctaatatgaagtcttagatgatgttttcatcagtctgtaaaatttatggttcataatttgacccactctaaagttaggtaattgaacatgctcataaaggacataagtttaaactggcctctaaagaatactgttcatatgagaatatcaaggacccttttgcttttgtatatttgaattgccgtttatttcaattgctgtttttaaaaatgatgtgtttttgattttcagggaaaggcgtaggaggaggagcaggagttcttccagatcgccaagaacatcaaaaaccataaaaaggaaatcttctagatctccgtcccccaggaggtaggttgggagcttgtgctaaaactaaacaggagaaagcaataaatattttttgaaattttaaatttctctctttattttttaaactttatattttgaatgaataatacatatgcattattcagaaattaaagataaaagttatgtatcaggaagtcttaatttccactcttgcccatctacactgttcccagaagtaatgacttcgtgaggtttttttgtatatgcttccagtttcatatacagataacaagatgagaatgtatcatttttttctaatacaagaagcaacacagaatacacactgttgtgcccttggttttgtcatttaactaccaggaagtctttttgtcacttaacttaccaggtcagagagagcttcttcaattcctttttataattgcgtaggcttccgttgtatggccataccttagttttttaactaggctacagtagaaggggttttttgaattttttttaccataaattatgtaatgctgtaatgaatagctttggacttaagttgtttttagtgtgcatgtgtgtaggaaaaatctcaagaaatggcattgttaagttagataataagcatgtttgtaatttttgagagatatttcctaattatcctctataagagttggcagcagtttgcactcttaattatgagagaagtgaccacttcatagatttgaaagccatttgtatttctttttctgcgaattgtctgtatactctgcccattttcctgttggcctttttgtttccttttctatttccaagaactcttttatattagggagcttattgtttagtgatgtgattataaataacattctcagtttgctgtttcttttaaaaaattgtttgtgagacttgattttacaaaggtttttcatttttaaaataactttctctttttcttttatgacttcttatgtgagtcaaaaactgataaaaggcttttcctattccaagattatgatagaactttcccattgttccttcttgtacttttatggttttatattttgcagttaaatctctggttagagtcttattcttgtgtacaatatggcaaatgggttcagttttattttacaaatgcttccgtgttgttgcagtaccatttgttaaaaactcaatttttctaacattagtttgatatgttgcctttgtcatgtgctgtgtttttctgtgtgtttgggtctatttctgggtcttctgtgcccttggattggtttgactggccgttcatgtgccagtgtcccacccttttaattattgagattataccgtatttttaagtatttggcaaggcctgttctctatacccctcattgcttttttgagtatagttagctttcctttcagtggttatttttctgcttgaacatgagtcagttgtctgcattccagaaataaaacctattgatgatttgtgttacagttgcattcgatttataaattaacttagggaaaattgataaacaggtttattaataaagattcatgatgacaagtcgtctgtccaggaatatggtgtatctgatgagatcgggcatgctcagggtgatatggctgtagacaaggaatgtggtatatcttattaggccatcattagtgttttcagaaatatttcatcgtttgtttcatacaggctttatgcatttcttaattcctagaaatttttgttgttgttgctgttggaaatgaggtattttctttcattatgtttaattggaggttaggtttgtacataggaaagttattgatttctgtatatttatttttttaatcccactgccttactaattggttatggttttttaggtgattttctgtgattttccagcagaggggtcttttgtttatttgcttataggtttttggcttttgtgagaataacggaaggcttaggatactatagatgcaggccatgtttgtatttttgaaacaaatactttacccaggaaagtcaaaacttttctcttatgaactgaaattagacaaaaagatacattcagaaaatgtcactcctgtctccattccatctgccttgttcccattcaccctgtgtaattgaccaatcatttgattgtctttcctttgtttctctttgcgaaatgaggcggatacatattcatttggttttattttctccttattgcagtacataaacaaatattgaatattcgaaaactattaaataggctatgccaaatagtgttttatgagaacatatggtggcctctgccaaaatgacttgtgtatccttaagaaactaactggggtaagggtggggtaggtcaggttgtagggctcatttatgttactttgcaaaccagcttactgttgatgcttattaacaatgcattattttagatatccagtgttagaaaaggatattttgtcaagaatataatagatcttacaatttcttagaatttaactgacatatcaatattcttatagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagtaagcagcagtcattcggtgtctggcacttgaaatggttctttattgcatacaaatggttttagactgaaagctctttggggaacagtgtcttgtacattgttggcattttatggcattttaaaatatttaaaatatttaattggtaatttaaaaaaactaaatgttgaagagataagagccaattaaaactaaaaaaactaagttaaatcctaacatggcatgcaataagaaaaatttaagaaatcaacagtaacaaatgtatttgattttatgtagataggatttctgcctgatgccattttcctcaatttatgtttcagcaagtttgaaaagactttgtgtagttaacattaggtttgttgggttagaatacctaatggaaaaccacattccaccaagtgagcttttttgtcacttggataaatacttcaagtagttgtgaattaagttacttacactggtaaagtatatttgtatttggaaattatgaattttggaacatctatcttatagttttatgtactgtaatactgatagacgattatcatcatcatcaataacattgataacatttattaagcatttacgatgtgccgggcactgtttgttctcatttaactcttttaaattgagggtagaaattggagtgctcttgaacagccttttccaggaggcatagtgacttccttttccacatttccttatttttgctgcattggtttgcagattaaaaatctatcctggcatccttggaaattatttcactctttcaatagatctgtctccgtttttcaagtctgtcagcaacatttattgagcacttgcttaaaatttctgttcaccaattctaatttaatttccatggattgtccatcttttatgagaacacaaaggggaaattgatagtgtttgcatattcattttgtgtgaaaacgtaatgagagaaaatcatacccagttttttaaatttgcaaaagataaagtttcacatttttgtcgtcatagcaggcagttcttgaggaaaatattaaatgcataccttaattactcattgtaggagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcat

SEQ ID NO: 9940 - DNA, 18925 bp, Homo sapiens
  misc_feature (10313)..(10313): n equals a,t,g, or c
  misc_feature (10344)..(10345): n equals a,t,g, or c
cttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccaggtaactaattaaagaagaaacaaagcagcagtagcccttattctttttctcttcttaaaaatcatatcagtggatacagtaatatttatctgattttttaaatggatatattttatcaaagtgtcactttgttcccttagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaagtaagaaatcctaaacaaagaaattttaatgattttgaaacatttaaagtatttttgatgtaatgaaggctttttttttctttttaatagtaattggcaatttgtggaaaggaagactttgtgttaagtataaatgaaatacatgagatacttaccattttagtctttaaattcctttatttagagacatttattttctcattttctgttttctagggtctaattcagtgttaacattatttatataccctgcataacggttgtaggtctttttccataaactttaatagtcaggttggttttacattatgacactagactaattgagcaacttaacaggtgggttgaactacagtacttccagtaacaactgtggtaaattcaaaatctacagaaggaaattataagtgcccagaaatgttttaaaccagaaattttgacttttgaggtttgcttacatccttgtttgtaaaacgttgataatggccttcgagatactccagaccagaaattctatttcatgcagattgttgaggcatatatagttttgcttgaatttcatagattgctttagttatacaatttgatcaggatttttctgttaaggataagtttttagtgggtacttgtcttcccagtgtggaaggggtaaagcaagacacataatatccattcatgtgcatcagagaagtcactcttacctagtagaggaagaattttttcagatgccttgcacattcaaagctatgtctaactcagccatggttcagcgttggttaaaatggtgtacataatatgatgatatacaggtagcttacccttcttctagagtgtacaggatatcagtaagatcttttgatttgaaaatagaaatgattcattttcatattggtatcaacattttaatttattttaattctaagctatggaaaagcacttaatctagtctgtttgaattaagttagctagggttcaatttttcttttctccctgcttttggttgtattcgcaaggaatgataggaagtggggatgagagattaatcatggttttgaggttgcttttggttatttacgtgcttctgagatgtcctcacgtttataaatatgtgtatcatataaatgtttgtttcatgttttataaaatgtggtgtgtatttgtgatatgctaatatttttaatttagaataaatcactccaacaatgcaatagtaaaaccccctgagatgacacctcaggctgcagctaaggagttagaagaagtaatgaagcgagtacgagaagctcagtcatttatctcagcagctattgaaccaggtaagtacataacgttgttacataggtcatagtttaaagatcatagactcttagaactggaaggaattttagaaatcatcttgttcagtcacttcattttacaaacaagaagactgaaactcaagaaatagtaagtagcatactcatgtcaaagaacaacttagcccatattttatctctttctgtgatactgaattgaggcactttagtctgagctaatcagctctgtattttcatagcaaaatcagtgctcacaagtgatttgctgaaagcaaaaatgttattgcaaggctaaaaagagtacatatatttaaaacgttacgactcagcaggtttacttttcctcaacattttaattttagaagtagagaagagagcccgtgatttagaaaaaaatacagatactgtattttagtaaggtaaaagaacatctatttaaacttttgtgttgctaatgaaaataattaaaaaacccattctaaaaacatctaggtggtttacatttgagcagattttctaaatcaacacttagaatttaagcttcaaattctagcagaataagtggagaaaggacttaaaatcactgtcacaggaattacagacatgttgtaatcgtacgttacggcagcaacaaaatattacgaacagctgtttataatcatctggtttatatgtactgctgcagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggtgagaatttctgctgtcatatttaaattttattttagttttgtatttaaaatattaagattttatgagttttcgtcaaaatatcagaagttagaaattttagtagtgtacacctgaagtgtggttacctttaaatattgttctaattgtaatactgtagttgagaatgaaattttgtctaatgatacttaatttttaaatatttgaacttatctttatttttagaagttagttttgtgtctaaagatactctattccagatttttctaagagtaaactagtctttatatagaagtgacaaaagctgttttcattcttcatattgagaaaagggaacatccttagtgaccatgctgaaaataattgctcaagttgcagcttttttgttttgttttcccagtctattccaagtttggggagcaccaccccagatctttcacgcaattccctattttcagtaccacgtatccaaaggaacactttgagtccttggtattgctggtgataagagcctcctctgcccacttttggacctgaaacacaggagtaacttgcagtttcagcttcagttttagtactttgcttaagctctgtttatcttatttttgatcatagctttgtccttttgattttctttatctgtcatttctttgtctttggtataaaggggaccttaaaatgcaaatttggcaataccatcctaattggaagtaccctaaagatcattactaaagttacaaattttgttgtctattttaaggtacggagggggctgtttttgaaatgtgaaagtatgtatagtggatcctaattgcatgttatgtgtacatacgtactcctatgtatgtcttgagagagcagggagggaagagtgtatctgtgtatgttgggattttaaagaaggagaaaggatttgggggagggaaaaggaaccagtttgttgtacattgttttaccagcaggctcagtttactttgtttttgtgtgtgtgtgtgttgatcaaggagattcaaagaatgaggaaaaataggatgttctttcttagattctagtaaacaagtatacaccagatatactagtgtatacttgtctattcttagtttgcaaaatctcctttggaatatggttttactgcgtttatccaaggacttacagtaagacactttcagaaccaagtgaaggaggttgtttcacatacaagaataaggcagtgcagcagaggccagaatcaggaaaggacagtggaacagaagctgcagtgatactagactgtggatatttccatatgttgacaggatgtggtgagggtaaaggagatcaaggaaataatagaattgggctgaagagtaatattacaacttcttttctgaggaagactgatgacctggatctcatattgtgttgattgtaagagagagctaatgtccaagactggaacaagacaaaacttgatgatgaataaaattgttgtttctttgatcatctaagtgaagttttatgtgctttatgtagatatgtctatacagatgtacacacaatgtctgcgtagcattagaaataatgtatatatattccttttttttccccccccaagatgcagtttcagtccgttgccgaggctggagtgcagtagcttgatctcggctcactgcaacctccacctcccaggcacaagtgatcctcccacctcagcttctcgagtagctaagccacagacacgcaccaccacgcctggctaattttgtattttttgtagaaacggggttttatcatactgcccaggttggtcttgaactcctgagctcaagcgatcctcccaccttggcctccaaaagtgctgggattataggcatggtatacatgttcttaactgacatatatacatacatacatacttttgtcagcatattctgtttttgtgcatgcatgtggaaacatgtagccttaagttcaagaacaaatacaaaagagagaatgagttatctttaaatgagaaaaaaaaaattccttacctaaaaacatttaacttaaagattctgacctggaaggatcccactatcccccagaaatcaggaagggaatgataggcctttcttgacatttcctcctctgctagtgggagttgttgtccttgaatctcaccctgacctattagacttagcatgagcgtgggttgcaggaaccctttaacttaaaggcccaccttctactttttcaccattttcaaatgcttctagagccatgcttcctacctcccaaccctcccccacagcctttccctgttccttccgcttcttatggttagagagaggaaggggtttcttgtcactgtgaccttggctaggactagggaggtatgtttccattttatccaagttttgatgcctgttttatttattgagacatagaaaagatggatagtactataattgttataattttaagtaacctttatagattagaacaggaactgtaagacattttataatattttaatggaaaacaactgatttacaaatgaactttgatgcagcataatggtaagttgctggttttttacagtttaatttaaaaataagattttgcattattcagaataatacaatttcgcattaaaaatgagagttaatgataaatctttagttagattagatctgctcttgactacttctagcattcttaatcagaaaactactagtgggtaagattgacgtgaaaatatttaacgtcacagttaaaatgtaataattactcttagtcactgtcttttgacatctcaattgcagggtaaggttggaagccaagtgatcagtgctttttattattaacttatttatgagagttatacttaatttttaaaaataagttttgcttaaggttggtggaaagcattgctttgaggaaaacaaaagaattatatttttagcaaggacaacttaaaacagaaatcttatagtaagactttttattaagtatgtagaagcaaaggcactttaaaagattaccctatgtggatatctgtaaacggactaataatgttctcagttttgcagttttgccttaacatctactccttaactttcatggctcttaagtactagtgataaagatttcagcaagctatgaattatcttcttgtattaaaaacatggtatgtgatttcttatctagggtctttggaaaaaaataaaataaaaaataatgtggtatgttgaaccaagtgaggctaaaaaaaaaaatatggaatgaagacaattgtatattatttttacagccaaatagtagatgagtagtttaaatggaaattagctattgaaattttgatttgtaatgttgattagtattttaatcagaattttgactaactgaacaaatgtgtttaaaaacaaaagattttgttatgtaatgaggcattattatggaggtttttcctggtttcacaagcatacccacaaacaccatggtcttatttctattatcttctatattatttcttttcgcagatagaatcttgactgtagttgcccaggctggagtagcagtaggagcgacctcagctcattgcaacctctgccccccgggttcagttgattctcccactcagcttcctcagtaactgggaatacaggtgcatgccaccatacccagctaatttttgtatttttagtagagacgggtttcactatgtttggcaaggctgatcttgaaatcctgacctcaaggcaggtggacctcaagtaccacctgcctcggcctcccagagtgctgggattacaggtgtgagccactgtgcccagcccaactatatttcttttactgataattgttctaaatttattaaaacatgactatcaagatgagttttagctgtataaaggatacttatagaagttcattcagcttccttggaatacgtacataaggatataaagtttacatttatgttaacttttaatgatgatgacattgagagttaagatttttaaacatttattttgtgctagagaatactacgcagttttacatacatcatcagttgtaatcctcatgacagccctaagagatgcaggtatgattcctactccactttatagaggaagaaactcaggcttggagaggttaagtgactagccagagttctcacaggtagtgtgtggcagagctgactttcagagccagattgtcagactccaaagctgttgagtctaatcactttgctatttaagttgtatacatctgttttgttacaatttaataagtagttaggatacctcgttatgaaaaaaatcacattctcaaaaaactttttcagtgagaaagggggcctagtccaaattggaataacagttacttttcctgcaattaaacgtttcctgcagttaacagtttcttttcatacaggttgagactcacaaatttgaaaatctgaaattcaaaaggcttcaaaactttttgagcgctttcgtgatgctcaaaggaaatgctcactggagcattttggatttttcagttgtgtgtttgggatgctcaaccagttttatgcgtgtgtatatatagaatgcaaatattcgaaaatctccaaaaatgtgaaattcaaaacacttttggttccaagcatttcacataagggatactcaactggtagctatgattatagttacagctataaaatcaaggcattgcaaatccaatatttgattatatctagttttaacttatgagtaatgatttttattttcctgtcacagtggcgctgtcattaggactgtgcttccttttatatattctttttgtttgttatgacagacagcacacattcacaggaactactcaaccacgtaaccactactccctgtcatgatgtgttatgaccagattacatgcaagtcaacagggaaaaatcttctatactgatttgaggcataaaatgactagcaaaagccacatctgaaaatatacgaaataactgttaaattctttgtttctgtctctgttctagacaatgaaatatccggtaaagtttccagtaaatgtatttcagattatgtaactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacggtgagttttagagaaattaacaataatttttttttcctcagagttctgttagtgctaagggataatattttaattggcttcatttgttaaaaatctgttgtggtttaggtttttaatgagagaaattaaaccttttttattgttttagtaatctaggattaatattgattgccagtgatctgaatctgatgtcagtgtgactcatgaggtttccaaactactcagttcagcttgcgtagtatgaatagctttgtttagcagcttcttgtacacctgagctatataaaaatgtatatgtaaatgtctgtaggtactataaattgtcttgtgttggtaattgttgaagagagagaggtctttttggaggaggtagaactattttagttatgaatttatttatttttgtttttaaagggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcaggtttgataatgcttaaaatttttacaaagggatttgctgatgacaattggaaacaaaattttttacggagggagaaaaggttactgtacgcaagtggaacctgtaaagtaatataagaacattttctcctaatttcagagtaaacatttctctagcagagtggggaaagagatgatactgggcaacattatttgaagagttttagctattctttgtaaccactattttaatagaataataataattgttattttcttagagggtgggatggcagggaaaggtactttttttaaaaagcacattaagaatttgcgtcttaggctttttcctgaactttttttgaatggtgtgattaattttaatatgtaaaatgattgctgaagttgcagtgttagccctctttgtcacctaagttaatttttatccttattttgttaagtgcataacatttaaattttggtcgtgttttattttgtcagttttaagggttagagtttttccttaggaccgtgatttcagtttattaatagctttactaccaccaggtggcagcaagttgccatagtaacagctgtacaatgagaacaacttttgagatttaagattatctaaacccacatcctttacttcagatgataccatgactgtaaatggaagttcctaacttatactacactatcttaaaaatactaaatatatatattagcaaatttttgaagatttttaaagatggttttttaatagaaaataatttgagataaaggaatatatgtttcccatttttaaaacttgtgctttagtagtttattaataccagcctttgactagataataaaagataatcgtagacatttattgtgcactttactgtatgccagacatgatgtcagtagactttttcatgtctcaccttatttaatcctcacaacaggcctgggagaagattattatcatcactgttttaaaacatgaggaagctgacgctctgtatgagaagtatagtagcccttttcctttattttagagattaagtttgagaattctctagtacttgtacttacttttaaaaactacctcagaagcataaagttgaaagcagtagtatatgttaaaacaaggctcaaaataaacagatcactgctggatttcagcacattgaaccacagattgaagaattaatgtaacctcctttgctgtgggtactggtttgagccttgtaaccacacctttactgcaaagtgattttattgattctgtgtcacacatgcctttgtgtttctgtgattgtttagacattacctttcacagcaccaaatactattttcattcctttttaataacgaatttactttttttgatgacatgggaatgtttaactttttctcgggccagttttaagttgtttggtgtagaggaaagttcaacggtgcttacactattgcattgcactataactagtactatttgntaattagtaggtatatgtatatggaatgaannagagctctttgtgctcagtacgcaccaggctggtagtgcaggtgtcagtgatcgttgatcccgactgctaaacttccccctcctcggttcacgtgattcttgtacctcagcctcccgagttagctgggattacaggtgtgcaaccaccatgcctggctaatttttgtatttttagtagagatggagtttcaccatattggccaggttgatcttgaactcctggcctcaagtgatctgccctccttggcctcccaaagtgctgggattacaggcatcagtcactgcacctggctcaaatacattcttcagtaacaactggggccttgagaataaaagatgactgacattagtttataaaggcagcagtttggaatgtttcatgctttcagaagagcttggtaaagagttacaatttctttgaattttttttttttttttttttttttttagacagagtgtcactttgtcacccaggctagaatgcagtggcacaatatctgctcactgcaacctctgcctcctgggttcagcgattctcctgccttagcttcctgagtagctggaattacaggcgtgtgccaccacactcaactgatttttgtattttatttaatagagatggggtttcaccatgttggccaggctggtctcaaactcctgacctcaggtgatccacccgcctcagcctcccaaagtgctggaattacagacgtgagccgccaccgcccccagccaagagttacaatttcttgtcttttagcatttttctgcttttcaaatgttctgatttgtttactaaatggagaatattttaactgttcaaaaaatagttaatatttttatttctaacattgtctcctaatttatacttttaaagaaaatgatattaaataattttttaatgcttaaatttactgtcattaaaggtgataccaagaaagggaaggaaaaaacaatatttattgagcacctactctgtgtcacactctatgctttgcacattacagattttatcctaaatcctcaacaacctaataaaacttgaattattaattgtctttatttttcagttgaaaaacagattaggttaagtaatatgatcctggttgtatagctgggtaaggtgtataactcaaatttaagtctaaatctcaccaactttagttgttaatacaatttctttctcaagtaattgtctagattgctgtctatggagactttcctctcattatcatcagctagtaggtattagacatccacttgtacatagtgctttctgaacaaataagtaaaagaattacactgataaaggcagagcgattttgtgtaatcttaaagtctggaatacgctgacattcacatgctttgaaaaaagtatttttggttcttaggctgagctgttaagagaatgtcattgatgtaatcaaataatgtatctaatttccacattagaagtgtaattgtggagtgtcttgggaataaaagtgggtaatggaggagagagtcttaggtagaggtagaattgagttgtgttctcagagttcttgagctttgtattttaatacatattatatataccgtgtgagcattttttattttagaaatgaaaaacttaaattattttattagtctcttagaatcagtttcctgaaatggtaaggataacatgaattccagaggatttggttttttagctatgtggtcactgattatcagaacttgtgagatagatcattgggttcattgggtatgtcctcgtaccatatcccttaaattatagacctagtgaagttcattgtttctgagttgaagtagtttagaatatgtatcatttgctaatctgataagcaaaatggtttttaataataataacgtaatctattttataattattcctgtcatatttacttttcagattgtaactgttttgcttacatctaagcaacttgtacactaaattttaaattaatagaacaacagtaatgaaatgataggaggttggagggaaaagcaatttctctctaaaatgatagtaatgtaaatgctttttaagtagacattgttgataattgggtatagaaagttcacattttacaagccagtttatgtttcagtttttgaaaagggcctgttactttgttataatccacagtggggcagcaaggagctagatacatgacaaaggatttgataagcaaaacttgttttagctgctgagaaaatacacttgagagaagcagaaacgccacgccattaatattttttctactgaagaaattgttcaaataaacgaggtgaaaaggaggaggtcttctactcttcctaatatgaagtcttagatgatgttttcatcagtctgtaaaatttatggttcataatttgacccactctaaagttaggtaattgaacatgctcataaaggacataagtttaaactggcctctaaagaatactgttcatatgagaatatcaaggacccttttgcttttgtatatttgaattgccgtttatttcaattgctgtttttaaaaatgatgtgtttttgattttcagggaaaggcgtaggaggaggagcaggagttcttccagatcgccaagaacatcaaaaaccataaaaaggaaatcttctagatctccgtcccccaggaggtaggttgggagcttgtgctaaaactaaacaggagaaagcaataaatattttttgaaattttaaatttctctctttattttttaaactttatattttgaatgaataatacatatgcattattcagaaattaaagataaaagttatgtatcaggaagtcttaatttccactcttgcccatctacactgttcccagaagtaatgacttcgtgaggtttttttgtatatgcttccagtttcatatacagataacaagatgagaatgtatcatttttttctaatacaagaagcaacacagaatacacactgttgtgcccttggttttgtcatttaactaccaggaagtctttttgtcacttaacttaccaggtcagagagagcttcttcaattcctttttataattgcgtaggcttccgttgtatggccataccttagttttttaactaggctacagtagaaggggttttttgaattttttttaccataaattatgtaatgctgtaatgaatagctttggacttaagttgtttttagtgtgcatgtgtgtaggaaaaatctcaagaaatggcattgttaagttagataataagcatgtttgtaatttttgagagatatttcctaattatcctctataagagttggcagcagtttgcactcttaattatgagagaagtgaccacttcatagatttgaaagccatttgtatttctttttctgcgaattgtctgtatactctgcccattttcctgttggcctttttgtttccttttctatttccaagaactcttttatattagggagcttattgtttagtgatgtgattataaataacattctcagtttgctgtttcttttaaaaaattgtttgtgagacttgattttacaaaggtttttcatttttaaaataactttctctttttcttttatgacttcttatgtgagtcaaaaactgataaaaggcttttcctattccaagattatgatagaactttcccattgttccttcttgtacttttatggttttatattttgcagttaaatctctggttagagtcttattcttgtgtacaatatggcaaatgggttcagttttattttacaaatgcttccgtgttgttgcagtaccatttgttaaaaactcaatttttctaacattagtttgatatgttgcctttgtcatgtgctgtgtttttctgtgtgtttgggtctatttctgggtcttctgtgcccttggattggtttgactggccgttcatgtgccagtgtcccacccttttaattattgagattataccgtatttttaagtatttggcaaggcctgttctctatacccctcattgcttttttgagtatagttagctttcctttcagtggttatttttctgcttgaacatgagtcagttgtctgcattccagaaataaaacctattgatgatttgtgttacagttgcattcgatttataaattaacttagggaaaattgataaacaggtttattaataaagattcatgatgacaagtcgtctgtccaggaatatggtgtatctgatgagatcgggcatgctcagggtgatatggctgtagacaaggaatgtggtatatcttattaggccatcattagtgttttcagaaatatttcatcgtttgtttcatacaggctttatgcatttcttaattcctagaaatttttgttgttgttgctgttggaaatgaggtattttctttcattatgtttaattggaggttaggtttgtacataggaaagttattgatttctgtatatttatttttttaatcccactgccttactaattggttatggttttttaggtgattttctgtgattttccagcagaggggtcttttgtttatttgcttataggtttttggcttttgtgagaataacggaaggcttaggatactatagatgcaggccatgtttgtatttttgaaacaaatactttacccaggaaagtcaaaacttttctcttatgaactgaaattagacaaaaagatacattcagaaaatgtcactcctgtctccattccatctgccttgttcccattcaccctgtgtaattgaccaatcatttgattgtctttcctttgtttctctttgcgaaatgaggcggatacatattcatttggttttattttctccttattgcagtacataaacaaatattgaatattcgaaaactattaaataggctatgccaaatagtgttttatgagaacatatggtggcctctgccaaaatgacttgtgtatccttaagaaactaactggggtaagggtggggtaggtcaggttgtagggctcatttatgttactttgcaaaccagcttactgttgatgcttattaacaatgcattattttagatatccagtgttagaaaaggatattttgtcaagaatataatagatcttacaatttcttagaatttaactgacatatcaatattcttatagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagtaagcagcagtcattcggtgtctggcacttgaaatggttctttattgcatacaaatggttttagactgaaagctctttggggaacagtgtcttgtacattgttggcattttatggcattttaaaatatttaaaatatttaattggtaatttaaaaaaactaaatgttgaagagataagagccaattaaaactaaaaaaactaagttaaatcctaacatggcatgcaataagaaaaatttaagaaatcaacagtaacaaatgtatttgattttatgtagataggatttctgcctgatgccattttcctcaatttatgtttcagcaagtttgaaaagactttgtgtagttacattaggtttgttgggttagaatacctaatggaaaaccacattccaccaagtgagcttttttgtcactgggataaatacttcaagtagttgtgaattaagttacttacactggtaaagtatatttgtatttggaaattatgaattttggaacatctatcttatagttttatgtactgtaatactgatagacgattatcatcatcaataacattgataacatttattaagcatttacgatgtgccgggcactgtttgttctcatttaactcttttaaattgagggtagaaattggagtgctcttgaacagccttttccaggaggcatagtgacttccttttccacatttccttatttttgctgcattggtttgcagattaaaaatctatcctggcatccttggaaattatttcactctttcaatagatctgtctccgtttttcaagtctgtcagcaacatttattgagcacttgcttaaaatttctgttcaccaattctaatttaatttccatggattgtccatcttttatgagaacacaaaggggaaattgatagtgtttgcatattcattttgtgtgaaaacgtaatgagagaaaatcatacccagttttttaaatttgcaaaagataaagtttcacatttttgtcgtcatagcaggcagttcttgaggaaaatattaaatgcataccttaattactcattgtaggagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcat

SEQ ID NO: 9941 - DNA, 27501 bp, Homo sapiens
  misc_feature (16181)..(16181): n equals a,t,g, or c
  misc_feature (24223)..(24223): n equals a,t,g, or c
tccaaagtatgttatgttaagtttcgtgatccatcaagtgttggcgtggcccagcatctaactaacacggtttttattgacagagctctgatagttgttccttgtgcagaaggttggtatctcgctttttttcctcttatttgaatttctgtcctgtctgttattgcctttagctttcctagagattggcaagtagacagtactcttggtgtgtgtgtgaaagtaagaatgaaatttggaggaggtaaacctttttacctaatagtaatattaaaatggttaatttatgacatgtacatttgaggttttacaatttaacattcattggcttctggtttgctttggctttctgtagtcaatttgcagattgcaaagaaagctttctgaaattaaaaaataattgatatgggaaattattttaaatgcataaacaagcatttaccttgtgtgttcaatattaatactattacaaatgaaaatagtgtacacattttggcaaattggggttaagtgatatttataagaaaatatttgtaatttatactttcaagtacactcttaaggtaatttaccttaattgttactatgagatcattattttatattcaatgtaattgtttgctttgcaactggaatttaatgttttcttttactggccccaaaaaggggcaggaggagtgttggaaaaaaaggaaagcaattttccaaagcctccatgaaggaagtagttgttgaagataggaacaaggccttaaagtatccattaaattttatgacctaaactgctttaagaactaattattactaatattttttagtaacttctgtttacagagccactcacgtataatagactgtgctgaattttgacacttctggtgtgtaattaacttttattcagagcactgactagcatgtgtacaggattttagaattgggttattataaattaaaatgtcttaaagtagattttctctggtggatgattgaaactgttttaaacataaaggtttatggaaaacagtttgatgggctttcatatgtaatttttaaaacctcttttagtggccaggctgacattaaaataatatataataagcagtttgctgcactttaaaggttttatgcttatttcagaatgcctgttctgggatgtcaaaaacattacagtctaatacagtgagtaccaggctcgtattttttaagtcccagaataggacattctcagtatttttcagataaatttggaagtgtctttcccatgcttgggggttagagtgggtagggaagataaaaatggattaaagttaattattggccaaatgtatctttatctgctgatctgtaaggctacagtaagccccaaattggtgaggtgggaaaggagctggtgaatggtttcgttctacaaactttgtagtgaaatttcatactgagaaactgcatgggaaaaaagaaatcaggtaaaaggtttattaaactggaatattaattatatcagaaaattaataccaccaataacactgggtcttttattgtgttagcttattactgaattggaaggaagaattttatcagtgttgcttggttgaaacctgctttattcccatagaatctttcatatatctgagaagccctactgtattttgttataaatgttcaagatgatgggcgtgtagatgtcccttttattgtttattttacttgatagagatgaataaatgcacagtcagatgtacctttttagtgtttttaatattacaacttggacagttttactgtttttgaacagaaaaatttaagcatacttttattgcaatttagttataagtaagtaaatattttgaaacactaacctacagttggtattggtgaaacattcagatatacgtttttcattagttgtattaaatacggcagagatgaatttatggaacctcgagaatttcacagtgagctgttaaaatactgattatgcactacaagcaaagaaatagtgcattattgtactaaaaaagatagcagagtgagtgtgaaataaccaaagaaaagtattccagtggagtaagttctgtaagaggagatgtgctgtggtgctgtaagcaagcagtgttctgttgacctcactgaatgcatcctttccttgatgttgaacaaacagcatcatgacataagtgagaaaaaccatagaaaaaaatttaagaagttttttcagtttctttgaattgctgttttttagtgtagacagtaatgtgagaagatcctaagttgtaaaagtaacatttgatgtgtaacagtttcatgcatattaagccttagcctttgttaataaaacatgccatttcaaaataaaatatgctttcattatacttgtccaaatatgacctctttttgttgttgcgtgcatttcagatttctttttataaatgttaacacgtagaaaaagatacggtcaaacataacaagggtgtcagcctaatcatcagtcataactttatgtccacattttctggtagatggattttgactattaatttggttttgtatgttttctctatgtgatatttgtgcattattagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagtatctcaggaacactttctgatctcagcgcaacatttttctagtttttttcccccctagtctacatctctcataaaaactgatagcttctaatttttgtccttccccctggaattttaggcatacaaaatcatcaaggaaaataagtaaatataacaatctgggagtaaagaagagcctttcatttttatgatggttatttatcatataacttatttccttgacttatgaagactttttgttgcctatgtggggaatggatatttgagaaacttaagtatttgcatgtaggtttttgttagcttgaattttttgttgaatatttttcagaggttactagcttctaaatggattctgagattaggactataatactgtgagagatgttttcctcagttgactttgaggagtatagtttgggaaaaatgctaaatgcttatttgttttatacttttataagctctgttatttggagggtaaatttggtagaattctatcttggaaattaagcaatggagctttttcttaaagtacttttgccattacctttaggtaattagaataagtatatagagtaattagaatggtaattgaaagttaatttattaaaaaatgtgcttatagtggatttatacatttatagtagtatactatatttatagtagtatactcttttgaaaggcagtgggagagtttgacaacctactgatacttaagctgaaagtgaaagacttcataatactaagtagtcaacttttggccagtgttgaataccctttttgtttgtatagtctttctacaatgtcttcaataggtagttttacttattaaaggacaagtaatattaaatttgggacattactagattagaactctgagtttccttaggtgcatacattaaggtagtgacgatggagtttctgcctcaaaacctcaatttatcaagaatgttcaggttttacaaacctttgagataataccaatttataacagataaaacaggtgaaatcaatataaatagtatagtgtatatgtgggtatatataaatacatgtgttaataccaataactaatacatataaagcagattattgttatttgatgttttcagtaaggcctacctgccttttgttgatgcatgttaagaaatctgttctccagaattttcactgaaataataaagataactttgtttttgaaagtaataaagtaatataaacttagatgctgcaaaggtagaaaatagtaggttttatttgcttcctataaataaggcatagccattatttaaatcaagttttaaattccaacttgagttccatccatgtttaaagatatattcagataatattgtttagggatttatctctgcacatgtggttgttttaaatatttttacaactgaaaccaggcatggtgcttgtggaaatttactgcatatgctatatttcagtttagcatgattttgtgcattgtcttttaaaacacttttggagaattaataatagaaatgctttaccagctaccacatgagtgttcttctaaatatatccacatgtagtcaactatttaagaattttttttttttttttttgcctaaggggataaggaaaaataatgtgaaagttgcagtccttatcagaagtaattgattagaattcagcaatgaatatgccaaatcgtacttatttcagagtaagtttttcatttttttaggttgtagggagtttttttcctactgagtgttattagattattttaatgttactattgttattaggcaattaaaatgtttttaagcaagctttaaggcattaacctcccccttcagataagtatacataaattggttctaaaagttaataagaagttttctgaaaccagggaactttttttttcctgaaacatttttagtagtttcccaaggcatattttttggaactgagttcttttaggcatctctgatgttggtgagatgctttattaactgaatggatgtaggcttccttttacgttgaagttgattacatggagtaagtttttgttttctatttgaaattaaatggaatctgttggagggttatcaaaattgtttgcatcacaaataggtagtttcagtaacaggataggggcactcattaagaaatttcaattcgcacatatttgttttttctttttcttttttttgactaatttggttatttgccatttctggggattaaactttaaaaaatgttcttcttttctgtatctgatgttctgtgtgctattagtgatgcagccaacacgaacggttgtcatgtgtaacacaactttcgatcaccgcgaaaacaccgtcctgggaaagcgtccatgcttgatatcgttggttcatgaacattaagtttccagtacaggtgacccatagctcaaagtgttaaataattgtctacattattcaatttttaaaataatattccattaatgagattgttaatatttgaagttttgctcacttttatttttcctagtagagcaggataaaaggaaagacttaagttcttatttatttctttatacagatctgatagatagattcatttattattattattttttaactgcaagggtaattgtaaaatcatagtgtaaagtttgtgtggtgtttctgctttttgtaatgtttggaacttgcctctgcaggtaaaatcccagaggaatccaaagccctctctttattggctcctgctccaaccatgacaagtctgatgcctggtgcaggattgcttccaataccgaccccaaatcctttgactactgtaagtactataagctggcttatgaaagaggtgaatgttcaactgtgtgaccagttgaatagagagcttcagattatttgcatttggatcttcttcttttttttttttttaatagagaggattcgaaatcactgcttaaactttttttttcactttatcagtgacttaacgctgcgttttggatttactcctgaagtaataggggattcatttaaatttgagaaccccaatagattattcactagaaaatcagttattaaaactcaatattttagatagcatagaggatctaggtaactgtatttctcagttaatgaggattaaatccatttaaaatacgtgaaatgatccacaactttggtaatgggaaaaaaacaggtctttgtctgatattgagaaaatgtaataaggtgaaaacatggcaaaatatttttccattaactatgcagaattaaatcataatttagtaatgcttcctttgtgatttccaagtgggattaaaaaaggatattacggccaggcgcggtggctcatgcctgtaatcccagcactttgggaggccgaggcaggtggatcatgaggtcgggagatcgagaccatcctggctaacacagtgaaaccccgtctccactaaaaatacaaaaacttctctgggcgtggtggcgggtgcccgtagtcccagctgctcgggaggccgaggctggagaatggcgtgagcctgggaggcggagcttgcagtgagcgaagattgcgccactgcactccagcctgggcgacagagggagagtctcaaaaaaaaaaaaagggtatattactattactggttcttggtttttgcttaaaaaactctggccatatttattttaaaagaagtgccatttttcttcaaaagacaacatagaacaaaatacaaagcttgccttaattggaagttgaatctagctttgtggtgttggataggaattgaactaagaaatgaactatgtgattgtagttaatttatctagattgtaagagtggtttctgaaattttgaagtgcaaaattttagatttgtagtttttacataacattgctatgctgaagacctgcattctgattcttggggggaaatgttttttaattgaacttatgtgttcaaggaacagaatggtggtcagtatggttgaagcatagtgagtgagggtcatgagtgtttgagattggaggggatagataggacacagattatggtagggctttttagaccatggaaagaggggtttgagttttattcttaaggtaattagaaaccattgatgggttttaagcagggatatgacatgatttgacatgttttaaaaagatcagactggctgctgtgataagtgacattgatttcataaacttccgttttcaccattagcaagtgccattacttaacagttgttaaaatcttagttctgtatcatatttgtatatatagtcattaatggtcaaaatgttctctaatagtataagtggaaatgaaaagagttgtgcttttttccttgaaagctcttttcgttctgaaaaattttttctgttttcaaattctgagatcttacatttcttctagtttacattcatattaaaaataatacgttccttaatgctgaaagtaaaaactgaatttagtgatgctatagaaagatcattcaaagtttttttgaaggtttttgcccttttcctaccatggcataagtaagggctcaatattttagatatattttcttaggtaaactttcagcatgataataataacccatttcttagggttgatatgaggattaagttactacctcagttaaattcgatgctatgataattgttgactgttaggaactcatactcatactcatctgtgtttttcaatgaccaaggtacagttgattctcattctttgtgaattctgtatttttgaattcacttagtaagtaaaatttttttgaaatccccacatcaacagttggagcacttttgtggtcgttcgtggacatacacagagtggtgaaaaattggggtttgtctatttgcacggaggtcgaaatcttcttgttttggcactcaggcagtaaacaagcacgcagtctgtttagtgctatgttctttgaattgttgtgctttttgttggtgatttcactgttaagatgggcccacaagtgtagtgccaaactgctgtgtagtgttcctaagtacagggagattgtgaagtgcctcatggagaaaatattaaatacatgtattagataagcttcattcaggcctgaattgtagcgctgctggctgtaagttcagtgttaatgaatcgacaatatataacagctaaggtgtctttaaacagaagaacatataaaataaggttaaatattttactagttaatgtaaatgtgaccagaggcttgtaggaacttcaccctgtattttccctaggaataatggttcaatattcaataattcattgttcacggaaactatagaacatagctatgtcaggtaatgagaaacagcctgtcttttagggtcaagtttaaaagtggctaaaatatccagacagtaaaatatatttcaaattacatttaaaactaatgtgaccttactttaataactcagacatatatatgactgaaagttcggagtccctagtctcctttcattcttgttgagttagttcattcttttcaagattagagaatggtatctttggatactaatagaaaatatgtgttctgtgtgttttttttcttctttcgatagcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccaggtaactaattaaagaagaaacaaagcagcagtagcccttattctttttctcttcttaaaaatcatatcagtggatacagtaatatttatctgattttttaaatggatatattttatcaaagtgtcactttgttcccttagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaagtaagaaatcctaaacaaagaaattttaatgattttgaaacatttaaagtatttttgatgtaatgaaggctttttttttctttttaatagtaattggcaatttgtggaaaggaagactttgtgttaagtataaatgaaatacatgagatacttaccattttagtctttaaattcctttatttagagacatttattttctcattttctgttttctagggtctaattcagtgttaacattatttatataccctgcataacggttgtaggtctttttccataaactttaatagtcaggttggttttacattatgacactagactaattgagcaacttaacaggtgggttgaactacagtacttccagtaacaactgtggtaaattcaaaatctacagaaggaaattataagtgcccagaaatgttttaaaccagaaattttgacttttgaggtttgcttacatccttgtttgtaaaacgttgataatggccttcgagatactccagaccagaaattctatttcatgcagattgttgaggcatatatagttttgcttgaatttcatagattgctttagttatacaatttgatcaggatttttctgttaaggataagtttttagtgggtacttgtcttcccagtgtggaaggggtaaagcaagacacataatatccattcatgtgcatcagagaagtcactcttacctagtagaggaagaattttttcagatgccttgcacattcaaagctatgtctaactcagccatggttcagcgttggttaaaatggtgtacataatatgatgatatacaggtagcttacccttcttctagagtgtacaggatatcagtaagatcttttgatttgaaaatagaaatgattcattttcatattggtatcaacattttaatttattttaattctaagctatggaaaagcacttcatctagtctgtttgaattaagttagctagggttcaatttttcttttctccctgcttttggttgtattcgcaaggaatgataggaagtggggatgagagattaatcatggttttgaggttgcttttggttattctgtatatcattcttacgtgcttctgagatgtcctcacgtttataaatatgtgtatcatataaatgtttgtttcatgttttataaaatgtggtgtgtatttgtgatatgctaatatttttaatttagaataaatcactccaacaatgcaatagtaaaaccccctgagatgacacctcaggctgcagctaaggagttagaagaagtaatgaagcgagtacgagaagctcagtcatttatctcagcagctattgaaccaggtaagtacataacgttgttacataggtcatagtttaaagatcatagactcttagaactggaaggaattttagaaatcatcttgttcagtcacttcattttacaaacaagaagactgaaactcaagaaatagtaagtagcatactcatgtcaaagaacaacttagcccatattttatctctttctgtgatactgaattgaggcactttagtctgagctaatcagctctgtattttcatagcaaaatcagtgctcacaagtgatttgctgaaagcaaaaatgttattgcaaggctaaaaagagtacatatatttaaaacgttacgactcagcaggtttacttttcctcaacattttaattttagaagtagagaagagagcccgtgatttagaaaaaaatacagatactgtattttagtaaggtaaaagaacatctatttaaacttttgtgttgctaatgaaaataattaaaaaacccattctaaaaacatctaggtggtttacatttgagcagattttctaaatcaacacttagaatttaagcttcaaattctagcagaataagtggagaaaggacttaaaatcactgtcacaggaattacagacatgtgtaatcgtacgttacggcagcaacaaaatattacgaacagctgtttataatcatctggtttatatgtactgctgcagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggtgagaatttctgctgtcatatttaaattttattttagttttgtatttaaaatattaagattttatgagttttcgtcaaaatatcagaagttagaaattttagtagtgtacacctgaagtgtggttacctttaaatattgttctaattgtaatactgtagttgagaatgaaattttgtctaatgatacttaatttttaaatatttgaacttatctttatttttagaagttagttttgtgtctaaagatactctattccagatttttctaagagtaaactagtctttatatagaagtgacaaaagctgttttcattcttcatattgagaaaagggaacatccttagtgaccatgctgaaaataattgctcaagttgcagcttttttgttttgttttcccagtctattccaagtttggggagcaccaccccagatctttcacgcaattccctattttcagtaccacgtatccaaaggaacactttgagtccttggtattgctggtgataagagcctcctctgcccacttttggacctgaaacacaggagtaacttgcagtttcagcttcagttttagtactttgcttaagctctgtttatcttatttttgatcatagctttgtccttttgattttctttatctgtcatttctttgtctttggtataaaggggaccttaaaatgcaaatttggcaataccatcctaattggaagtaccctaaagatcattactaaagttacaaattttgttgtctattttaaggtacggagggggctgtttttgaaatgtgaaagtatgtatagtggatcctaattgcatgttatgtgtacatacgtactcctatgtatgtcttgagagagcagggagggaagagtgtatctgtgtatgttgggattttaaagaaggagaaaggatttgggggagggaaaaggaaccagtttgttgtacattgttttaccagcaggctcagtttactttgtttttgtgtgtgtgtgtgttgatcaaggagattcaaagaatgaggaaaaataggatgttctttcttagattctagtaaacaagtatacaccagatatactagtgtatacttgtctattcttagtttgcaaaatctcctttggaatatggttttactgcgtttatccaaggacttacagtaagacactttcagaaccaagtgaaggaggttgtttcacatacaagaataaggcagtgcagcagaggccagaatcaggaaaggacagtggaacagaagctgcagtgatactagactgtggatatttccatatgttgacaggatgtggtgagggtaaaggagatcaaggaaataatagaattgggctgaagagtaatattacaacttcttttctgaggaagactgatgacctggatctcatattgtgttgattgtaagagagagctaatgtccaagactggaacaagacaaaacttgatgatgaataaaattgttgtttctttgatcatctaagtgaagttttatgtgctttatgtagatatgtctatacagatgtacacacaatgtctgcgtagcattagaaataatgtatatatattccttttttttccccccccaagatgcagtttcagtccgttgccgaggctggagtgcagtagcttgatctcggctcactgcaacctccacctcccaggcacaagtgatcctcccacctcagcttctcgagtagctaagccacagacacgcaccaccacgcctggctaattttgtattttttgtagaaacggggttttatcatactgcccaggttggtcttgaactcctgagctcaagcgatcctcccaccttggcctccaaaagtgctgggattataggcatggtatacatgttcttaactgacatatatacatacatacatacttttgtcagcatattctgtttttgtgcatgcatgtggaaacatgtagccttaagttcaagaacaaatacaaaagagagaatgagttatctttaaatgagaaaaaaaaaattccttacctaaaaacatttaacttaaagattctgacctggaaggatcccactatcccccagaaatcaggaagggaatgataggcctttcttgacatttcctcctctgctagtgggagttgttgtccttgaatctcaccctgacctattagacttagcatgagcgtgggttgcaggaaccctttaacttaaaggcccaccttctactttttcaccattttcaaatgcttctagagccatgcttcctacctcccaaccctcccccacagcctttccctgttccttccgcttcttatggttagagagaggaaggggtttcttgtcactgtgaccttggctaggactagggaggtatgtttccattttatccaagttttgatgcctgttttatttattgagacatagaaaagatggatagtactataattgttataattttaagtaacctttatagattagaacaggaactgtaagacattttataatattttaatggaaaacaactgatttacaaatgaactttgatgcagcataatggtaagttgctggttttttacagtttaatttaaaaataagattttgcattattcagaataatacaatttcgcattaaaaatgagagttaatgataaatctttagttagattagatctgctcttgactacttctagcattcttaatcagaaaactactagtgggtaagattgacgtgaaaatatttaacgtcacagttaaaatgtaataattactcttagtcactgtcttttgacatctcaattgcagggtaaggttggaagccaagtgatcagtgctttttattattaacttatttatgagagttatacttaatttttaaaaataagttttgcttaaggttggtggaaagcattgctttgaggaaaacaaaagaattatatttttagcaaggacaacttaaaacagaaatcttatagtaagactttttattaagtatgtagaagcaaaggcactttaaaagattaccctatgtggatatctgtaaacggactaataatgttctcagttttgcagttttgccttaacatctactccttaactttcatggctcttaagtactagtgataaagatttcagcaagctatgaattatcttcttgtattaaaaacatggtatgtgatttcttatctagggtctttggaaaaaaataaaataaaaaataatgtggtatgttgaaccaagtgaggctaaaaaaaaaaaatatggaatgaagacaatagtatattatttttacagccaaatagtagatgagtagtttaaatgggaaattagctatggaaatttggattggtaatgttgattagtattttaatcagaattttggactaactgaaaaatgtgtttaaaaacaaaagattttgttattaatgaggattatttggaggtttttctggtttcaaagcataccacaaaacatggtctttttcttttttcttttatttttttgcgatagaatcttgctgtgttgcccaggctggagtgcagtggagcgacctcagctcattgcaacctctgccccccgggttcagttgattctcccacctcagcttcctcagtaactgggaatacaggtgcatgccaccatacccagctaatttttgtatttttagtagagacgggtttcactatgtttggcaaggctgatcttgaaatcctgacctcaaggcaggtggacctcaagtaccacctgcctcggcctcccagagtgctgggattacaggtgtgagccactgtgcccagcccaactatatttcttttactgataattgttctaaatttattaaaacatgactatcaagatgagttttagctgtataaaggatacttatagaagttcattcagcttccttggaatacgtacataaggatataaagtttacatttatgttaacttttaatgatgatgacattgagagttaagatttttaaacatttattttgtgctagagaatactacgcagttttacatacatcatcagttgtaatcctcatgacagccctaagagatgcaggtatgattgctactccactttatagaggaagaaactcaggcttggagaggttaagtgactagccagagttctcacaggtagcgtgtggcagagctgactttcagagccagattgtcagactccaaagctgttgagtctaatcactttgctatttaagttgtgtacatctgttttgttacaatttaataagcagttaggatacctcgttatgaaaaaaatcacattctcaaaaaactttttcagtgagaaagggggcctagtccaaattggaataacagttacttttcctgcaattaaacgtttcctgcagttaacagtttcttttcatacaggttgagactcacaaatttgaaaatctgaaattcaaaaggcttcaaaactttttgagcgctttcgtgatgctcaaaggaaatgctcactggagcattttggatttttcagttgtgtgtttgggatgctcaaccagttttatgcgtgtgtatatatagaatgcaaatattcgaaaatctccaaaaatgtgaaattcaaaacacttttggttccaagcatttcacataagggatactcaactggtagctatgattatagttacagctataaaatcaaggcatgcaaatccaatatttgattatatctagttttaacttatgagtaatgatttttattttcctgtcacagtggcgctgtcattaggactgtgcttccttttatatattctttntgttgttatgacagacagcacacattcacaggaactactcaaccacgtaaccactactccctgtcatgatgtgttatgaccagattacatgcaagtcaacagggaaaaatcttctatactgatttgaggcataaaatgactagcaaaagccacatctgaaaatatacgaaataactgttaaattcttgtttctgtctctgttctagacaatgaaatatccggtaaagtttccagtaaatgtatttcagattatgtaactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacggtgagttttagagaaattaacaataatttttttttcctcagagttctgttagtgctaagggataatattttaattggcttcatttgttaaaaatctgttgtggtttaggtttttaatgagagaaattaaaccttttttattgttttagtaatctaggattaatattgattgccagtgatctgaatctgatgtcagtgtgactcatgaggtttccaaactactcagttcagcttgcgtagtatgaatagctttgtttagcagcttcttgtacacctgagctatataaaaatgtatatgtaaatgtctgtaggtactataaattgtcttgtgttggtaattgttgaagagagagaggtctttttggaggaggtagaactattttagttatgaatttatttatttttgtttttaaagggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcaggtttgataatgcttaaaatttttacaagggatttgctgatgacaattggaaacaaaattttttacggagggagaaaaggttactgtacgcaagtggaacctgtaaagtaatataagaacattttctcctaatttcagagtaaacatttctctagcagagtggggaaagagatgatactgggcaacattatttgaagagttttagctattctttgtaaccactattttaatagaataataataattgttattttcttagagggtgggatggcagggaaaggtactttttttaaaaagcacattaagaatttgcgtcttaggctttttcctgaactttttttgaatggtgtgattaattttaatatgtaaaatgattgctgaagttgcagtgttagccctctttgtcacctaagttaatttttatccttattttgttaagtgcataacatttaaattttggtcgtgttttattttgtcagttttaagggttagagtttttccttaggaccgtgatttcagtttattaatagctttactaccaccaggtggcagcaagttgccatagtaacagctgtacaatgagaacaacttttgagatttaagattatctaaacccacatcctttacttcagatgataccatgactgtaaatggaagttcctaacttatactacactatcttaaaaatactaaatatatatattagcaaatttttgaagatttttaaagatggttttttaatagaaaataatttgagataaaggaatatatgtttcccatttttaaaacttgtgctttagtagtttatttttaataccagcctttgactagataataaaagataatcgtagacatttattgtgcactttactgtatgccagacatgatgtcagtagactttttcatgtctcaccttatttaatcctcacaacaggcctgggagaagattattatcatcactgttttaaaacatgaggaagctgacgctctgtatgagaagtgtagtagcccttttcctttattttagagattaagtttgagaattctctagtacttgtacttacttttaaaaactacctcagaagcataaagttgaaagcagtagtatatgttaaaacaaggctcaaaataaacagatcactgctggatttcagcacattgaaccacagattgaagaattaatgtaacctcctttgctgtgggtactggtttgagccttgtaaccacacctttactgcaaagtgattttattgattctgtgtcacacatgcctttgtgtttctgtgattgtttagacattacctttcacagcaccaaatactattttcattcctttttaataacgaatttactttttttgatgacatgggaatgtttaactttttctcgggccattttaagttgtttggtgtagaggaaagttcaagtgttcacattcattcctaaatatatatgtatatattttttgaaacagagtcttgctcatcgcccaggctggagtgcagtgtcatgatcttgacccactgcaacctccccctcctcggttcacgtgattcttgtacctcagcctcccgagtagctgggattacaggtgtgcaccaccatgcctggctaatttttgtatttttagtagagatggagtttcaccatattggccaggttgatcttgaactcctggcctcaagtgatctgccctccttggcctcccaaagtgctgggattacaggcatcagtcactgcacctggctcaaatacattcttcagtaacaactggggccttgagaataaaagatgactgacattagtttataaaggcagcagtttggaatgtttcatgctttcagaagagcttggtaaagagttacaatttctttgaatttttttttttttttttttttttttagacagagtgtcactttgtcacccaggctagaatgcagtggcacaatatctgctcactgcaacctctgcctcctgggttcagcgattctcctgccttagcttcctgagtagctggaattacaggcgtgtgccaccacactcaactgatttttgtattttatttaatagagatggggtttcaccatgttggccaggctggtctcaaactcctgacctcaggtgatccacccgcctcagcctcccaaagtgctggaattacagacgtgagccgccaccgcccccagccaagagttacaatttcttgtcttttagcatttttctgcttttcaaatgttctgatttgtttactaaatggagaatattttaactgttcaaaaaatagttaatatttttatttctaacattgtctcctaatttatacttttaaagaaaatgatattaaataattttttaatgcttaaatttactgtcattaaaggtgataccaagaaagggaaggaaaaaacaatatttattgagcacctactctgtgtcacactctatgctttgcacattacagattttatcctaaatcctcaacaacctaataaaacttgaattattaattgtctttatttttcagttgaaaaacagattaggttaagtaatatgatcctggttgtatagctgggtaaggtgtataactcaaatttaagtctaaatctcaccaactttagttgttaatacaatttctttctcaagtaattgtctagattgctgtctatggagactttcctctcattatcgtcagctagtaggtattagacatccacttgtacatagtgctttctgaacaaataagtaaaagaattacactgataaaggcagagcgattttgtgtaatcttaaagtctggaatacgctgacattcacatgctttgaaaaaagtatttttggttcttaggctgagctgttaagagaatgtcattgatgtaatcaaataatgtatctaatttccacattagaagtgtaattgtggagtgtcttgggaataaaagtgggtaatggaggagagagtcttaggtagaggtagaattgagttgtgttctcagagttcttgagctttgtattttaatacatattatatataccgtgtgagcattttttattttagaaatgaaaaacttaaattattttattagtctcttagaatcagtttcctgaaatggtaaggataacatgaattccagaggatttggttttttagctatgtggtcactgattatcagaacttgtgagatagatcattgggtatgtcctcgtaccatatcccttaaattatagacctagtgaagttcattgtttctgagttgaagtagtttagaatatgtatcatttgctaatctgataagcaaaatggtttttaataataataacgtaatctattttataattattcctgtcatatttacttttcagattgtaactgttttgcttacatctaagcaacttgtacactaaattttaaattaatagaacaacagtaatgaaatgataggaggttggagggaaaagcaatttctctctaaaatgatagtaatgtaaatgctttttaagtagacattgttgataattgggtatagaaagttcacattttacaagccagtttatgtttcagtttttgaaaagggcctgttactttgttataatccacagtggggcagcaaggagctagatacatgacaaaggatttgataagcaaacttgttttagctgctgagaaaatacacttgagagaagcagaaacgccacgccattaatattttttctactgaagaaattgttcaaataaacgaggtgaaaaggaggaggtcttctactcttcctaatatgaagtcttagatgatgttttcatcagtctgtaaaatttatggttcataatttgacccactctaaagttaggtaattgaacatgctcataaaggacataagtttaaactggcctctaaagaatactgttcatatgagaatatcaaggacccttttgcttttgtatatttgaattgccgtttatttcaattgctgtttttaaaaatgatgtgtttttgattttcagggaaaggcgtaggaggaggagcaggagttcttccagatcgccaagaacatcaaaaaccataaaaaggaaatcttctagatctccgtcccccaggaggtaggttgggagcttgtgctaaaactaaacaggagaaagcaataaatattttttgaaattttaaatttctctctttattttttaaactttatattttgaatgaataatacatatgcattattcagaaattaaagataaaagttatgtatcaggaagtcttaatttccactcttgcccatctacactgttcccagaagtaatgacttcgtgaggtttttttgtatatgcttccagtttcatatacagataacaagatgagaatgtatcatttttttctaatacaagaagcaacacagaatacacactgttgtgcccttggttttgtcatttaactaccaggaagtctttttgtcacttaacttaccaggtcagagagagcttcttcaattcctttttataattgcgtaggcttccgttgtatggccataccttagttttttaactaggctacagtagaaggggttttttgaattttttttaccataaattatgtaatgctgtaatgaatagctttggacttaagttgtttttagtgtgcatgtgtgtaggaaaaatctcaagaaatggcattgttaagttagataataagcatgtttgtaatttttgagagatatttcctaattatcctctataagagttggcagcagtttgcactcttaattatgagagaagtgaccacttcatagatttgaaagccatttgtatttctttttctgcgaattgtctgtatactctgcccattttcctgttggcctttttgtttccttttctatttccaagaactcttttatattagggagcttattgtttagtgatgtgattataaataacattctcagtttgctgtttcttttaaaaaattgtttgtgagacttgattttacaaaggtttttcatttttaaaataactttctctttttcttttatgacttcttatgtgagtcaaaaactgataaaaggcttttcctattccaagattatgatagaactttcccattgttccttcttgtacttttatggttttatattttgcagttaaatctctggttagagtcttattcttgtgtacaatatggcaaatgggttcagttttattttacaaatgcttccgtgttgttgcagtaccatttgttaaaaactcaatttttctaacattagtttgatatgttgcctttgtcatgtgctgtgtttttctgtgtgtttgggtctatttctgggtcttctgtgcccttggattggtttgactggccgttcatgtgccagtgtcccacccttttaattattgagattataccgtatttttaagtatttggcaaggcctgttctctatacccctcattgcttttttgagtatagttagctttcctttcagtggttatttttctgcttgaacatgagtcagttgtctgcattccagaaataaaacctattgatgatttgtgttacagttgcattcgatttataaattaacttagggaaaattgataaacaggtttattaataaagattcatgatgacaagtcgtctgtccaggaatatggtgtatctgatgagatcgggcatgctcagggtgatatggctgtagacaaggaatgtggtatatcttattaggccatcattagtgttttcagaaatatttcatcgtttgtttcatacaggctttatgcatttcttaattcctagaaatttttgttgttgttgctgttggaaatgaggtattttctttcattatgtttaattggaggttaggtttgtacataggaaagttattgatttctgtatatttatttttttaatcccactgccttactaattggttatggttttttaggtgattttctgtgattttccagcagaggggtcttttgtttatttgcttataggtttttggcttttgtgagaataacggaaggcttaggatactatagatgcaggccatgtttgtatttttgaaacaaatactttacccaggaaagtcaaaacttttctcttatgaactgaaattagacaaaaagatacattcagaaaatgtcactcctgtctccattccatctgccttgttcccattcaccctgtgtaattgaccaatcatttgattgtctttcctttgtttctctttgcgaaatgaggcggatacatattcatttggttttattttctccttattgcagtacataaacaaatattgaatattcgaaaactattaaataggctatgccaaatagtgttttatgagaacatatggtggcctctgccaaaatgacttgtgtatccttaagaaactaactggggtaagggtggggtaggtcaggttgtagggctcatttatgttactttgcaaaccagcttactgttgatgcttattaacaatgcattattttagatatccagtgttagaaaaggatattttgtcaagaatataatagatcttacaatttcttagaatttaactgacatatcaatattcttatagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagtaagcagcagtcattcggtgtctggcacttgaaagtggcttctcttactctgcantaccaaactcggttcttcagacgtgaaacgctctcttggcggaacagctgtcttgtacattgttggcattttatggcattttaaaatatttaaaatatttaattggtaatttaaaaaaactaaatgttgaagagataagagccaattaaaactaaaaaaactaagttaaatcctaacatggcatgcaataagaaaaatttaagaaatcaacagtaacaaatgtatttgattttatgtagataggatttctgcctgatgccattttcctcaatttatgtttcagcaagtttgaaaagactttgtgtagttaacattaggtttgttgggttagaatacctaatggaaaaccacattccaccaagtgagcttttttgtcacttggataaatacttcaagtagttgtgaattaagttacttacactggtaaagtatatttgtatttggaaattatgaattttggaacatctatcttatagttttatgtactgtaatactgatagacgattatcatcatcatcaataacattgataacatttattaagcatttacgatgtgccgggcactgtttgttctcatttaactcttttaaattgagggtagaaattggagtgctcttgaacagccttttccaggaggcatagtgacttccttttccacatttccttatttttgctgcattggtttgcagattaaaaatctatcctggcatccttggaaattatttcactctttcaatagatctgtctccgtttttcaagtctgtcagcaacatttattgagcacttgcttaaaatttctgttcaccaattctaatttaatttccatggattgtccatcttttatgagaacacaaaggggaaattgatagtgtttgcatattcattttgtgtgaaaacgtaatgagagaaaatcatacccagttttttaaatttgcaaaagataaagtttcacatttttgtcgtcatagcaggcagttcttgaggaaaatattaaatgcataccttaattactcattgtaggagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcat

SEQ ID NO: 9942 - DNA, 225 bp, Homo sapiens
taggcctgcctggattgccttctgttgtggtagacaaatcaccattaaatgactaagtttcactgttttatgtgttaatgatccttaataacaaaaagttttaaagtcttaatttcgtaagattatgtaaaggttaagaaagaaattttaagtgaaaatgataaaaccaagcaaatgtttattagttcaattgtttttctttttatcttgcagcaacgcacctct

SEQ ID NO: 9943 - DNA, 3046 bp, Homo sapiens
ataaaacaagtcatttaaagtatgagtgttttcttgtactctggacctattacatgtttctttatgttggtaattaacatttaatttggttcttgctgctaattattttctctgctgatatttattaagctttaaaataatcgtactataatcttgaaacactgatttgtaaaaactaagaatgagtaggaatacaagagatctggaggaacaaatcagattgttattagggtttgactttttttttacatgggcttatggaagcaaggcattctagggtctagagggatgtgtgtgtgtgcttgtgtgtccatgtgtgcgcatgcgcacgtgtgtatctgtttgagacatactttctctgttcacttaaaagagctcatgttttcatttgtttattcttttctttcagggtattttgtttttttctttaagacttctttttttaaatcccaggtagatgttgtcagataaacttgaggtaaggccaagaagacagacattttatgcttcatactttctgtaattatcttttgtagcttgattacatagagtaccctctcttccttaagttgtagttgctatttatcattgtagacaaattctgttgcctttcagcaacgtatgctgaactagtatcataagatggtgcatcagttcataagctagtgcataagttttgtgtcaaaacttttaaatcctgaagttctgcagttatcatcttagttattttctatctaattagcttataattgcaaacactagtcagcttgtgatctctgtgtttcaagttcttttcttcacgaggttcagtacctgctatgttgatctttggcagtgccagaggcttaaattttgacctgctcaattaaaaataaacactggcgtttataatgaaaaggtttttttgtcgggggggggggggtcaagagaatttattttgtgatagtaataattttcaagaccttcagtcattcctatgtctatgttgctatctttattttaaaacttagaaccctgatctaactcccttctcaagtgaagatactgtgtagattcaagaattataatgtagagtaataggcctttaagtttttttttaatctgttagaaataaagagcatgatttaattattgttgaattaacaattaaaatgaatccctttggagggatggcattgaataacttataatttcagtgaatcatttacgttttcattggaagacagtatctgatttcaactggtgcgttacgaagtagagccattcccacaaagtaaatgtgcagtgcccatgtttcttgtgtttaaatattttttattttcactacatatatattattttctcatgtttatttactaatgtaattttcacttaaaattagatgtttattttcaaattttaaaagctagtgctcttaaaagagctaaattatatttctggaagcaggagtttagtataaatgtaataaaattttaaaataaaattgacttccctacttaatcttgggtttgtgggtgagtttgtttttagtacactcttattggtggttttgcctgaagagtaatacattattattattacttttctttttgagacagggtctcactctgtcactcaggctggagtgcagtgacacgatcatggctcactgcaatcttgacctttctcggcatggatgatcctctcacctcagcctcttgaatagctgggaccacagacatgtgccaccaagcccagttaattttagaattttttttgtagagacaggatcttgccatgttgcctagactggtctcaaactcctgggctcaaacaatctgtctgcctcagccttctaaagtgctgagattacaggtgtgaggtactgcacctggcaatacgttattttaaaagtaaacgctaagccatttatgactttggttatattcagtcagttggatttagtaactaataactagctttcttccattctaaggtacttttatagtttctagcaattagtttgttacaattagcttatatcagatataacagttcttaatataatgtttataaaaggttttaagtctgttgcctgatttttaaatttatatctagttaacattttaattttaaaattgccaacttttgggagatttcacatattttacctctatattttatttttccaggattggtatggaggagtagtaccttctattcttggtttatttttatttgctagacataatttcttaactacatatgtaagtataaattcataaaaatcacactgaaagaataggttgatttcaaccattttgagggtactggtaggtaacacactgttggggaataaactaaagaatttctgatttctacaatagatttaagtatgaaatttgagtatactgtgtagctgtgtagatcaacttaatgcttaaaaaattacctccttaatgattagattaatagaacagtgttagattatcaagggaagagtttggaatgtaaacataaacatgctgcataggtggtggttatttgtgagtaggactacttttaaatggtactagtaaagatttatcaaacaatgctgctattatgttgctatatttttaataaaatgaaaatcttaaaatcttgccactgttgagtagtaatttcacctatttctggaacagttatttgcatatttacatcttatttctataactgaaaggtgataataggcttttccagggttcaagattactaccaaaaatggaaggttttgcatacggggcaatcttcgtgttttgtggcagttaactccagtcaaggcttttcatattaaacattgtgcagtatccaagtaagtgatagctgctctctgaatctcccttctccccagccgccacaaattcagcttcttgctaggatatttgtacaatgaaaactatcactttgtcttttaacaacaggtggaatgccttctcccacttataagaggtgtaactctccatttggtgaatgagctgtgtgctcagggtggtcacttaggtaagacagcctattagcctattag

SEQ ID NO: 9944 - DNA, 225 bp, Homo sapiens; identical to SEQ ID NO: 9942

SEQ ID NO: 9945 - DNA, 242 bp, Homo sapiens; identical to SEQ ID NO: 7548

SEQ ID NO: 9946 - DNA, 5088 bp, Homo sapiens; identical to SEQ ID NO: 7228
  misc_feature (5)..(304): n equals a,t,g, or c
  misc_feature (3943)..(4892): n equals a,t,g, or c

SEQ ID NO: 9947 - DNA, 181 bp, Homo sapiens; identical to SEQ ID NO: 7550

SEQ ID NO: 9948 - DNA, 142 bp, Homo sapiens; identical to SEQ ID NO: 7551

SEQ ID NO: 9949 - DNA, 319 bp, Homo sapiens; identical to SEQ ID NO: 7553

SEQ ID NO: 9950 - DNA, 316 bp, Homo sapiens; identical to SEQ ID NO: 6716

SEQ ID NO: 9951 - DNA, 322 bp, Homo sapiens; identical to SEQ ID NO: 7556

SEQ ID NO: 9952 - DNA, 286 bp, Homo sapiens; identical to SEQ ID NO: 7557

SEQ ID NO: 9953 - DNA, 305 bp, Homo sapiens; identical to SEQ ID NO: 7558

SEQ ID NO: 9954 - DNA, 168 bp, Homo sapiens; identical to SEQ ID NO: 8119

SEQ ID NO: 9955 - DNA, 300 bp, Homo sapiens
cggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtggtcccagctacttgggaagctgaggcaggagaatggcgtgaacccgggaggcggagcttgcagtgagccgagatcccgccactgcactccagcctgggcgacagagcgagactccgtctcaaaaaaaaaaaaaaaaaaaaacttgaga

SEQ ID NO: 9956 - DNA, 316 bp, Homo sapiens; identical to SEQ ID NO: 7560

SEQ ID NO: 9957 - DNA, 283 bp, Homo sapiens; identical to SEQ ID NO: 7561

SEQ ID NO: 9958 - DNA, 293 bp, Homo sapiens; identical to SEQ ID NO: 6719

SEQ ID NO: 9959 - DNA, 170 bp, Homo sapiens; identical to SEQ ID NO: 7565

SEQ ID NO: 9960 - DNA, 300 bp, Homo sapiens; identical to SEQ ID NO: 7568

SEQ ID NO: 9961 - DNA, 306 bp, Homo sapiens; identical to SEQ ID NO: 7570

SEQ ID NO: 9962 - DNA, 294 bp, Homo sapiens; identical to SEQ ID NO: 7571

SEQ ID NO: 9963 - DNA, 184 bp, Homo sapiens; identical to SEQ ID NO: 7572

SEQ ID NO: 9964 - DNA, 299 bp, Homo sapiens; identical to SEQ ID NO: 7575
  misc_feature (18)..(18): n equals a,t,g, or c
  misc_feature (27)..(27): n equals a,t,g, or c

SEQ ID NO: 9965 - DNA, 147 bp, Homo sapiens; identical to SEQ ID NO: 6794

SEQ ID NO: 9966 - DNA, 316 bp, Homo sapiens; identical to SEQ ID NO: 7580

SEQ ID NO: 9967 - DNA, 131 bp, Homo sapiens; identical to SEQ ID NO: 6213

SEQ ID NO: 9968 - DNA, 257 bp, Homo sapiens
tcacacctgtaatcccagcactttgggaggccgaggcgggtggatcacgaggtcaggagatcgagaccatcctggctaatacggtgaaagcccgtctctactaaaaatacaaaaaattagccgggcgtggtggcgggcacctgtggtcccagctacttcgggaggctgaggcaggagaatggtgtgaacccgggaggcagagcttgcagtgagccaagatcgcgccactgcattccagcctgggcgacagagcgaga

SEQ ID NO: 9969 - DNA, 227 bp, Homo sapiens; identical to SEQ ID NO: 7587

SEQ ID NO: 9970 - DNA, 296 bp, Homo sapiens
tatttaggccgggtgcggtggctcacgcgtgtaatcccagcactttgggaggctgaggcgggcggatcacaaggtcaggagatcgagaccatcttggctaacacggtgaaaccccgtctctactaaaaatacaaaaaatgtggcaggtgcctgtagtcccagctactcgggaggctgaggcaggagaatggcgtgaacccgggaggcggagcttgcagtgagccgagatcgcgccactgcactctagcctgggcgacagagcaagactccgtctcaaaaaacaaaacaaaacaaaa

SEQ ID NO: 9971 - DNA, 235 bp, Homo sapiens; identical to SEQ ID NO: 7589
  misc_feature (230)..(230): n equals a,t,g, or c

SEQ ID NO: 9972 - DNA, 220 bp, Homo sapiens; identical to SEQ ID NO: 7595

SEQ ID NO: 9973 - DNA, 306 bp, Homo sapiens; identical to SEQ ID NO: 7596

SEQ ID NO: 9974 - DNA, 143 bp, Homo sapiens; identical to SEQ ID NO: 7597

SEQ ID NO: 9975 - DNA, 170 bp, Homo sapiens; identical to SEQ ID NO: 7598

SEQ ID NO: 9976 - DNA, 171 bp, Homo sapiens; identical to SEQ ID NO: 7603

SEQ ID NO: 9977 - DNA, 125 bp, Homo sapiens; identical to SEQ ID NO: 7605

SEQ ID NO: 9978 - DNA, 196 bp, Homo sapiens; identical to SEQ ID NO: 7606
  misc_feature (106)..(106): n equals a,t,g, or c

SEQ ID NO: 9979 - DNA, 183 bp, Homo sapiens; identical to SEQ ID NO: 7394

SEQ ID NO: 9980 - DNA, 319 bp, Homo sapiens; identical to SEQ ID NO: 7609

SEQ ID NO: 9981 - DNA, 311 bp, Homo sapiens; identical to SEQ ID NO: 7611

SEQ ID NO: 9982 - DNA, 175 bp, Homo sapiens; identical to SEQ ID NO: 7613

SEQ ID NO: 9983 - DNA, 196 bp, Homo sapiens; identical to SEQ ID NO: 7614

SEQ ID NO: 9984 - DNA, 159 bp, Homo sapiens; identical to SEQ ID NO: 7616

SEQ ID NO: 9985 - DNA, 219 bp, Homo sapiens; identical to SEQ ID NO: 7618

SEQ ID NO: 9986 - DNA, 301 bp, Homo sapiens; identical to SEQ ID NO: 7619

SEQ ID NO: 9987 - DNA, 154 bp, Homo sapiens; identical to SEQ ID NO: 7620

SEQ ID NO: 9988 - DNA, 2548 bp, Homo sapiens; identical to SEQ ID NO: 7621

SEQ ID NO: 9989 - DNA, 6141 bp, Homo sapiens; identical to SEQ ID NO: 7622

SEQ ID NO: 9990 - DNA, 207 bp, Homo sapiens; identical to SEQ ID NO: 7625

SEQ ID NO: 9991 - DNA, 230 bp, Homo sapiens; identical to SEQ ID NO: 7626

SEQ ID NO: 9992 - DNA, 288 bp, Homo sapiens; identical to SEQ ID NO: 7627

SEQ ID NO: 9993 - DNA, 189 bp, Homo sapiens; identical to SEQ ID NO: 7630

SEQ ID NO: 9994 - DNA, 207 bp, Homo sapiens; identical to SEQ ID NO: 7631

SEQ ID NO: 9995 - DNA, 150 bp, Homo sapiens; identical to SEQ ID NO: 7633
  misc_feature (21)..(21): n equals a,t,g, or c

SEQ ID NO: 9996 - DNA, 162 bp, Homo sapiens; identical to SEQ ID NO: 6214

SEQ ID NO: 9997 - DNA, 301 bp, Homo sapiens; identical to SEQ ID NO: 7637
  misc_feature (98)..(98): n equals a,t,g, or c

SEQ ID NO: 9998 - DNA, 301 bp, Homo sapiens; identical to SEQ ID NO: 7639

SEQ ID NO: 9999 - DNA, 611 bp, Homo sapiens; identical to SEQ ID NO: 7640

SEQ ID NO: 10000 - DNA, 291 bp, Homo sapiens; identical to SEQ ID NO: 7641

SEQ ID NO: 10001 - DNA, 303 bp, Homo sapiens; identical to SEQ ID NO: 7643

SEQ ID NO: 10002 - DNA, 267 bp, Homo sapiens; identical to SEQ ID NO: 7644

SEQ ID NO: 10003 - DNA, 246 bp, Homo sapiens
gatcacgaggtcaggagatcgagaccatcctggctaacacggtgaaaccccatctctactaaaaatacaaaaaattagctgggcgtggtggcaggcgcctgtagtcccagctactcaggaggctgaggcaggagaatggcgtgaacctgggaggtggagcttgcagtgagccgagattgcgccactgcactccagcctgggcgacagagtgagactccgtctcaaaaaaaaaaaacaaaaaaacaa

SEQ ID NO: 10004 - DNA, 100 bp, Homo sapiens; identical to SEQ ID NO: 6215

SEQ ID NO: 10005 - DNA, 129 bp, Homo sapiens; identical to SEQ ID NO: 7645

SEQ ID NO: 10006 - DNA, 193 bp, Homo sapiens; identical to SEQ ID NO: 7396

SEQ ID NO: 10007 - DNA, 169 bp, Homo sapiens
attagccgggcgaggtggcgggcgcctgtagtcccagctactcgggaggctgaggcaggagaatggcgtgaacccgggaggcggagcttgcagtgagccgagattgcaccactgcactccagcctgggcaacagagtgagactctttctcaaaaaaaaataataataaa

SEQ ID NO: 10008 - DNA, 3991 bp, Homo sapiens; identical to SEQ ID NO: 7650

SEQ ID NO: 10009 - DNA, 177 bp, Homo sapiens; identical to SEQ ID NO: 7651

SEQ ID NO: 10010 - DNA, 292 bp, Homo sapiens; identical to SEQ ID NO: 7652

SEQ ID NO: 10011 - DNA, 140 bp, Homo sapiens; identical to SEQ ID NO: 6216

SEQ ID NO: 10012 - DNA, 294 bp, Homo sapiens
ctgctgggtgcggtggctcacgcctgtaatcccagcactttgggaggccagagcgggtggatcacgaggtcaggagatggagaccatcctgactaacatggtgaaaccccgtctctactaagaatacaaaaaattagctgggcgtgttggcgggcacctgtagtcccagctactcaggaggctgaggcaggagaatggcgtgaacccgggaggcggagcttgcagtgagccgagatcgcaccactgcactccagcctgggcgacagagcaagactctgtctcaaaaaaaaaaaa

SEQ ID NO: 10013 - DNA, 280 bp, Homo sapiens; identical to SEQ ID NO: 7656

SEQ ID NO: 10014 - DNA, 187 bp, Homo sapiens; identical to SEQ ID NO: 7657

SEQ ID NO: 10015 - DNA, 246 bp, Homo sapiens; identical to SEQ ID NO: 7658

SEQ ID NO: 10016 - DNA, 114 bp, Homo sapiens; identical to SEQ ID NO: 6217

SEQ ID NO: 10017 - DNA, 173 bp, Homo sapiens; identical to SEQ ID NO: 7661

SEQ ID NO: 10018 - DNA, 3905 bp, Homo sapiens; identical to SEQ ID NO: 7664

SEQ ID NO: 10019 - DNA, 153 bp, Homo sapiens; identical to SEQ ID NO: 6795

SEQ ID NO: 10020 - DNA, 269 bp, Homo sapiens; identical to SEQ ID NO: 7666

SEQ ID NO: 10021 - DNA, 202 bp, Homo sapiens; identical to SEQ ID NO: 7667

SEQ ID NO: 10022 - DNA, 203 bp, Homo sapiens; identical to SEQ ID NO: 7398

SEQ ID NO: 10023 - DNA, 166 bp, Homo sapiens; identical to SEQ ID NO: 7670

SEQ ID NO: 10024 - DNA, 295 bp, Homo sapiens; identical to SEQ ID NO: 7671

SEQ ID NO: 10025 - DNA, 280 bp, Homo sapiens; identical to SEQ ID NO: 7673

SEQ ID NO: 10026 - DNA, 190 bp, Homo sapiens; identical to SEQ ID NO: 7674

SEQ ID NO: 10027 - DNA, 2364 bp, Homo sapiens; identical to SEQ ID NO: 6735

SEQ ID NO: 10028 - DNA, 304 bp, Homo sapiens; identical to SEQ ID NO: 7677

SEQ ID NO: 10029 - DNA, 261 bp, Homo sapiens; identical to SEQ ID NO: 7678

SEQ ID NO: 10030 - DNA, 318 bp, Homo sapiens
gaaataggtgccgggcgcggtggctcacgcctgtaatcccagcactttgggaggccgaggcgggcggatcacgaggtcaggagatcaagaccatcccggctaaaaacggtgaaaccccgtctctactaaaaatacaaaaaattagctgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaagaaaggaaataag

SEQ ID NO: 10031 - DNA, 61 bp, Homo sapiens; identical to SEQ ID NO: 6218

SEQ ID NO: 10032 - DNA, 312 bp, Homo sapiens; identical to SEQ ID NO: 7681

SEQ ID NO: 10033 - DNA, 158 bp, Homo sapiens; identical to SEQ ID NO: 7682

SEQ ID NO: 10034 - DNA, 298 bp, Homo sapiens; identical to SEQ ID NO: 6737

SEQ ID NO: 10035 - DNA, 303 bp, Homo sapiens; identical to SEQ ID NO: 7688

SEQ ID NO: 10036 - DNA, 191 bp, Homo sapiens; identical to SEQ ID NO: 7689

SEQ ID NO: 10037 - DNA, 193 bp, Homo sapiens; identical to SEQ ID NO: 7690

SEQ ID NO: 10038 - DNA, 195 bp, Homo sapiens; identical to SEQ ID NO: 7691

SEQ ID NO: 10039 - DNA, 281 bp, Homo sapiens; identical to SEQ ID NO: 7692

SEQ ID NO: 10040 - DNA, 297 bp, Homo sapiens; identical to SEQ ID NO: 7695

SEQ ID NO: 10041 - DNA, 182 bp, Homo sapiens; identical to SEQ ID NO: 7696

SEQ ID NO: 10042 - DNA, 323 bp, Homo sapiens; identical to SEQ ID NO: 7699

SEQ ID NO: 10043 - DNA, 309 bp, Homo sapiens; identical to SEQ ID NO: 7702

SEQ ID NO: 10044 - DNA, 310 bp, Homo sapiens; identical to SEQ ID NO: 7703

SEQ ID NO: 10045 - DNA, 311 bp, Homo sapiens; identical to SEQ ID NO: 7706

SEQ ID NO: 10046 - DNA, 183 bp, Homo sapiens; identical to SEQ ID NO: 7707

SEQ ID NO: 10047 - DNA, 303 bp, Homo sapiens
actgtagaggccgggcgcggtggctcacgcctgtaatcccagcactttgggaggccgaggtgggcggatcacgaggtcaggagatcgaaaccatcctggctaacacggtgaaaccccgtctctactaaaaatacaaaaaaattagccaggcgtggtggcaggcacctgtagccccagctactcgggaggctgaggcaggagaatggcatgaacccaggaggcagagcttgcagtgagccgagatcccgccactgcactccagcctgggtgatagagcaagactccgtctcaaaaaaaaaaaga

SEQ ID NO: 10048 - DNA, 292 bp, Homo sapiens; identical to SEQ ID NO: 7708

SEQ ID NO: 10049 - DNA, 136 bp, Homo sapiens; identical to SEQ ID NO: 6219

SEQ ID NO: 10050 - DNA, 273 bp, Homo sapiens; identical to SEQ ID NO: 7712
  misc_feature (18)..(18): n equals a,t,g, or c

SEQ ID NO: 10051 - DNA, 279 bp, Homo sapiens; identical to SEQ ID NO: 8074

SEQ ID NO: 10052 - DNA, 243 bp, Homo sapiens; identical to SEQ ID NO: 7716

SEQ ID NO: 10053 - DNA, 296 bp, Homo sapiens; identical to SEQ ID NO: 7717

SEQ ID NO: 10054 - DNA, 202 bp, Homo sapiens; identical to SEQ ID NO: 7718

SEQ ID NO: 10055 - DNA, 192 bp, Homo sapiens; identical to SEQ ID NO: 7720

SEQ ID NO: 10056 - DNA, 320 bp, Homo sapiens; identical to SEQ ID NO: 6742

SEQ ID NO: 10057 - DNA, 311 bp, Homo sapiens
  misc_feature (301)..(301): n equals a,t,g, or c
agaagaggaagaggctgggtgcggtggctcacgcctgtaatcccagcactttgggaggccgaggcgggtggatcacgaggtcaggagatcgagaccatcctggctaacacggtgaaaccccgtctctactaaaaatacaaaaaaattagccaggcatggtggtgggcacctgtggtcccagctacttgggaggctgaggcaggagaatggcgtgaacccgggaggcggagcttgcagtgagctgagatggcgccactgcactccagcctgggcaacagagcgagactccgtctcaaaaaanaaaaaaaaaa

SEQ ID NO: 10058 - DNA, 308 bp, Homo sapiens; identical to SEQ ID NO: 6743

SEQ ID NO: 10059 - DNA, 153 bp, Homo sapiens; identical to SEQ ID NO: 7724

SEQ ID NO: 10060 - DNA, 300 bp, Homo sapiens; identical to SEQ ID NO: 6744

SEQ ID NO: 10061 - DNA, 308 bp, Homo sapiens; identical to SEQ ID NO: 7726

SEQ ID NO: 10062 - DNA, 150 bp, Homo sapiens; identical to SEQ ID NO: 7399

SEQ ID NO: 10063 - DNA, 198 bp, Homo sapiens; identical to SEQ ID NO: 7729

SEQ ID NO: 10064 - DNA, 266 bp, Homo sapiens; identical to SEQ ID NO: 7732

SEQ ID NO: 10065 - DNA, 322 bp, Homo sapiens; identical to SEQ ID NO: 6747

SEQ ID NO: 10066 - DNA, 250 bp, Homo sapiens; identical to SEQ ID NO: 7734

SEQ ID NO: 10067 - DNA, 142 bp, Homo sapiens; identical to SEQ ID NO: 7400

SEQ ID NO: 10068 - DNA, 181 bp, Homo sapiens; identical to SEQ ID NO: 7737

SEQ ID NO: 10069 - DNA, 122 bp, Homo sapiens; identical to SEQ ID NO: 7739

SEQ ID NO: 10070 - DNA, 123 bp, Homo sapiens; identical to SEQ ID NO: 6220

SEQ ID NO: 10071 - DNA, 270 bp, Homo sapiens; identical to SEQ ID NO: 6749

SEQ ID NO: 10072 - DNA, 237 bp, Homo sapiens; identical to SEQ ID NO: 7744

SEQ ID NO: 10073 - DNA, 45 bp, Homo sapiens; identical to SEQ ID NO: 6221

SEQ ID NO: 10074 - DNA, 214 bp, Homo sapiens; identical to SEQ ID NO: 7748

SEQ ID NO: 10075 - DNA, 297 bp, Homo sapiens; identical to SEQ ID NO: 7750
  misc_feature (22)..(22): n equals a,t,g, or c
  misc_feature (29)..(29): n equals a,t,g, or c
  misc_feature (94)..(94): n equals a,t,g, or c
  misc_feature (261)..(261): n equals a,t,g, or c

SEQ ID NO: 10076 - DNA, 177 bp, Homo sapiens; identical to SEQ ID NO: 7751

SEQ ID NO: 10077 - DNA, 318 bp, Homo sapiens; identical to SEQ ID NO: 7753

SEQ ID NO: 10078 - DNA, 154 bp, Homo sapiens; identical to SEQ ID NO: 7755

SEQ ID NO: 10079 - DNA, 177 bp, Homo sapiens; identical to SEQ ID NO: 7756

SEQ ID NO: 10080 - DNA, 187 bp, Homo sapiens; identical to SEQ ID NO: 7757

SEQ ID NO: 10081 - DNA, 243 bp, Homo sapiens
acgagatcaggagatcgagaccatcctggctaacacggtgaaaccctgtctctactaaaaatacataaaattagccgggcgtgttggcgggcgcctgtagtcccagctactcgggaggctgaggcaggagaatggcgtgaacccgggaggtggagcttgcagtgagctgagattgcgccactgcactccagcctgggcgacagagcgagactctgtctcaaaaaaaaaaaattaaattaaatt

SEQ ID NO: 10082 - DNA, 307 bp, Homo sapiens; identical to SEQ ID NO: 7758

SEQ ID NO: 10083 - DNA, 166 bp, Homo sapiens; identical to SEQ ID NO: 7759

SEQ ID NO: 10084 - DNA, 142 bp, Homo sapiens; identical to SEQ ID NO: 7402

SEQ ID NO: 10085 - DNA, 306 bp, Homo sapiens; identical to SEQ ID NO: 6754

SEQ ID NO: 10086 - DNA, 228 bp, Homo sapiens; identical to SEQ ID NO: 7231

SEQ ID NO: 10087 - DNA, 131 bp, Homo sapiens; identical to SEQ ID NO: 7764

SEQ ID NO: 10088 - DNA, 214 bp, Homo sapiens; identical to SEQ ID NO: 7765

SEQ ID NO: 10089 - DNA, 268 bp, Homo sapiens; identical to SEQ ID NO: 7767

SEQ ID NO: 10090 - DNA, 906 bp, Homo sapiens; identical to SEQ ID NO: 7771

SEQ ID NO: 10091 - DNA, 368 bp, Homo sapiens; identical to SEQ ID NO: 6222

SEQ ID NO: 10092 - DNA, 131 bp, Homo sapiens
ttttttttttgagatggagtctcgctctgtcgcccaggctggagtgcagtggcgggatctcggctcactgcaagctccgcctcccgggttcacgccattctcctgcctcagcctcccaagtagctgggact

SEQ ID NO: 10093 - DNA, 572 bp, Homo sapiens
agtcttgtttccacctgaattgactctcccttagctaagagagccagagagactccatcttggctctttcactggcagccccttcctcaaggacttaacttgtgcaagctgactcctagcacatccaagaatgcaattaactgataagatactgtggcaagctatatccgcagttcccaggaattcgtccgattgataaacgcccaaagccccggatctatcaccttgtaatagtcttaaagcccctgcacctggaactgtttactttcctgtaaccatttgtccttttaactttttgactactttacttccgtaaaattgttttaactagaccccccctccccttcctaaaccaaggtataaaagttaatcaagccccttccttggggccgagagaattttgagcattagccgtctctaggtcgccggctaataaaagactcttaatttgtctcaaagtgtggcgtttttctaactcgcttgggtacaacaaggccaaggtggaaggatcacttgaagctaggagtttgagcaacctgtgcaacctagtgagacccccatctttttaatag

SEQ ID NO: 10094 - DNA, 2925 bp, Homo sapiens; identical to SEQ ID NO: 6223

SEQ ID NO: 10095 - DNA, 3086 bp, Homo sapiens
gtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaacattttgtagcacttgagattgtcttatacctaaggtattacatatttggtatataattaagccttataaaacttggtaattgattaagttttaccataatttttcatcctattctgtagtttctaagataagcacagctaccacctctaaatctgcagcagaatgctggccccagggttattaattcacattaccaaaagcatttttagggaactttttataaagaaagaataattgtttgttaggcttcatgtcacttgagtgagtttggcagtgtaacaggatggttcgtacacttactacttttctgtgccgtgcatcatatgcttctggacagtttccaaaggcctccggaaaagtaggcgaggcctgctttttatggcaacttggcatccatagaaaattttaaaattggtgaaggttgcaatactccaaataatgtaaaatgactgccaggctacaatataaagtgagttcagttaatcatgctggacttgtgtttatctgtagtattcatctacaataaacaggcatagcatctttttccattcagttagttaggattttcagaacctcattgccttagtactttttaaaatatggctttagtttctcaaacatgttcgtgactctactggtagtctagaccgattgtttttcattctgacagatcatgtgaaccagctccagccatgtgagccctgtggatcggggacagctgaaggctggactcggtgctcccggtccctttgtgcagcacccactgggcctgactgatctcctcccacattgctggcttcctccaggtcatgggcacaggtaacagagaggcactgagtagcctcttcatatccagattggagcagccaacacggccgttttacacctcatttgcctgcggaaccctaaatataaagctaaacctgtgctgaggtgagcggtatatgggatggtgtcacggtcccatcccacctcagccttagaggtgacctccatcccagctggcctggtatgtgagttcaggttagagttccttgccaagccaggcag

SEQ ID NO: 10096 - DNA, 4706 bp, Homo sapiens; identical to SEQ ID NO: 7776

SEQ ID NO: 10097 - DNA, 1548 bp, Homo sapiens; identical to SEQ ID NO: 7779

SEQ ID NO: 10098 - DNA, 4704 bp, Homo sapiens; identical to SEQ ID NO: 7404

SEQ ID NO: 10099 - DNA, 1090 bp, Homo sapiens; identical to SEQ ID NO: 7782

SEQ ID NO: 10100 - DNA, 102 bp, Homo sapiens; identical to SEQ ID NO: 6224

SEQ ID NO: 10101 - DNA, 522 bp, Homo sapiens; identical to SEQ ID NO: 7784

SEQ ID NO: 10102 - DNA, 126 bp, Homo sapiens; identical to SEQ ID NO: 6762

SEQ ID NO: 10103 - DNA, 4852 bp, Homo sapiens
agatgctgcattcctggcccgagagaaagcgaaagcagatgctgaatattatgctgcacacaaatatgccacctcaaacaaggtgactggctccctggccactttcctaatgatgcatttcggggttttgctttctcttttcaggagctctgatatgatagaagtgattttatccattgtcaagaaagtgtagtgaccaagacatcctccagaattagtcagttagcaagaaatatttcacattgattgggtagggacacaggccaaatgccgtaattccattcatttgtactgctatataaggctgaataattaattaagttgaaggtcttctgaaataagagtgacagaagagtaaagtctatttagaattgctttccaaataaggtagtttttttggtagatacttagcttgattagagcagtatttctcatcaaaggcattcctggcatttggggttgagatactttttcattgttgaagaccatctcatgcattgtaggatattttgtatccctggcccttgtctactgaatgtcagtagtggtcaccagttgttttaactgccacacacacatgcatgtatttccatatgccccttgttgagtactccttgtttattggatttaaaaaactattccagtcatgaggaatttcatgtgggataacttgagaaggcaggttgggtgatatataggtgataatttggtgtaaggactggggtaagctggctagacggtacagggctagtgagcaggggctatttaagaggcagctagaactccgatagtattctgagaagggaagggtatgtccaagatttataaggttatcgtggagcagattggaacagataaagggttgagaaagagattactaaagtggatgatgcagtttgaaggattagagtcaagttttaagatatagacagggcttttaatttagaaaggaacaacataatccgtatttagaagaaatgataagatgatagaatgagagttgtcagtactttgaaaaccaatataaattttaaaatgaacataacattgaaagacacagttctatagacacagaatggaatttggccaaaagaaaggcatgacaggaaactccagttgaggaaactaggagtccaaatctaatgggagaagctcgtcaggcacaagtttcaagaccttgccattgaggtctaccttattcagaaaggggcagtagttttatgccattttgaaaaatgtgactcagatactaacctatattaaaaaggcttgaggaagaaatgtggttgtgcactatgaccagatttgattggagtgtttcgacagaggatatgaatcacctggagaagatagagatccaaagagtgaaagatgtcaaagtgtagaaaataaatgctgtaggactgtgaaggacaagatggacttttgcctgggggacaggccaggactcaagataaggagaggatcacagagcagggtctgaggggctttgaaaggcatatgttacagggaacagtggaaatgggttttaatcaaatccagatagattctggttagatacatcttggcatcctgatttagacaaaacaaaacagtgtgacagagggagatctggtggtcgacgagttttaatcaaacccagataggttctggttagatacatcttggcatcctgatttaaacaaaacactgtcacatagatctggtggtcgacaaacatctgtctgtcacaagcagcttaaacatccagcttctggggaaaggcagaaggccagatcaggtgacaacttgagattttattctagttctagaatttgttcaagaaaagcagaatcacagctaatgataagataatgagcaccagcccttcctttgaagttctgctctcatccactgacctgtgtatctctctcaagagaatcaacagagaaccaggcatgatggctcattcctgtagcctccctggaggctaagatgagagtatctcttgagcccagaagtttgaggctgcagcagcgagctataattgaaccactgtattccagcctgggcaacagagtgagatctcatctccagaaaaaaaaaaggctgggtgcagtggctcacatctttgattccgacactttgggaggccaaggtaggaggattgcttgaggccaggagtttgagaccagcctggcaacatagaccccatctctacaaaaataaaaataatttttttagaaaagagaatcaacagaaactccagaccaattccaggttgaattcaactagatgaaatgaaagtcactttagaaatattagttattatcattagttatcacaaattgttttccaactcccccatccttttattaaaaagtgaacagcttctcttgcattaagtcatgagcttaatgaaggaattttaagtcaggaacgcagctgttaatgtgataaccactctccaaagtgagagagggtcattggcagttattcagacttgactcatgatactcaggagagcaataggtgaaatgtatatagggagagagaagactgttgcaccagagtattctgatgcctttgctcttgtttgctcccacacagcacaagttgaccccggaatatctggagctcaaaaagtaccaggccattgcttctaacagtaagatctattttggcagcaacatcctaaacatgttcgtggactcctcatgtgcattcctaatacttagatgttggactggaagagaaagctcactcccctctaaggaggctcttgaaccctctggagagaactttatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtga

SEQ ID NO: 10104 - DNA, 102 bp, Homo sapiens
gtgcctataatccccagctactcaggaggctgaggcaggagaatcacttgaacctgggaggtggaggttgtagtgagctgagatcgagccactgcactccag

SEQ ID NO: 10105 - DNA, 323 bp, Homo sapiens
atctctggccgggcgggggggtttacgcctgtaatcccagcactttgggaggccgaggcgggcggatcacaaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaataaaaaaaaaattaaaaataaataaacccc

SEQ ID NO: 10106 - DNA, 4793 bp, Homo sapiens
cagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgaggtgagaactggctgaaggaacttcttccttactggataactttacctgaggaattcaactgtacttcactgaagggctgtcagctggcttattaggataaattctgggattttatgctgggcatagtgatttcgtgcttattttactgctggaccaaatgggaagcaaaggaagtgtgtcaaagaaggtggagggttagaaggtaccatctaatatttggggaatagaatctctttggatgtatcccctgggagttaactttatgtctttgaaaacaataacctgaaagaaaaggaagaatatataacagttacacatctgatctttggtgtcagactgcctgagttcaaatcccagttctgccacttaacagctatacgaccctagaaactgtgcttcagtttcttcatctgtaaaatgggataataaaagcctcccttatgagtttttcatgaggattagatgatatagtagacttaaaggacttggcccagtgttagcatatagtaagagctcaataaaggtttaagtattattaaatatgataaaacagctccaagattatagagcaagacagccagggtcctgcttggaaagaatccctgatgtatccgaagatacctatgatttaggtatcactgcataataaatgattggaacatgggtgtagttactttcctggaaggctaggataaagagttgggttcgcctttccaagtgaccagcagcccagccaggaacctgaatacctgcaatgagccttttctgtagaagcccttcttaaattttctgcagcttcctttttttttacaacagtggccttttttcctccagtttcctcaactaagtgtccaaggcaaatgtgaagtagaaaataaatacgtgaaaccatctgagtaaaattagctgaatttccctgacttccatattcttccattatttctcttatcccctgccagtcactttagcctgaattagctgtgaggcaaactattttgccatttctatgtgtggatcttccagtgtgattttatgcagtcattgaaattgtcttaagcacaaatgaaacctcatggaaatgttaattactgctcctacaattaaccttcctcatatattcaacaagcaaggaattattgagaactaatacctctgagacactactccttagtaggtttcaaaccaggaaggaggcaagttgaatagagtctaagttttataatccagatcaacacagagaagggtactgctctggtattgagggtgggagtggtcagagaaggcctcctggaaaggataggcctgaatcttcaagaacaagcagcagcccaagaggggaggtgagtgagatgagccaccttcctataggtctctcctccttccatgcccccactccccacccaaacttttcacactggggagaagtttctgacatgaacatctaacttgttttctctcttctgtgtttcagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaattgctctagaagtcatatgtcattggatgtcctgttgtttatggagtttccctggaaagatgttccttgacagatgcagccctgagtcacacacttgggccatgtctgatttcagcttcgctgtagtggacagttacaatcagcc

SEQ ID NO: 10107 - DNA, 2066 bp, Homo sapiens
ggtcttgctgtgttgcccaggctggagtgcagtggcacaatcactgctcactgcagcctcaatctcccaggctcaagcgatcctctgcctcctgagtagctgggactacaggcatgcaccattatgcccagttaatttttttaaaaatgttttgtatagacagggtctcgctatattgcccaggctggtctcaaactcctggcctcaaaagatcctcccacctcggcctcccaaagtgctgggattaaaggcatgagccagccaccatgcctggtctattttttattgataaatgaaatagaccatgcctgttctatttttaattgataaatatcctgggagaaatactttgggacaatgcaaatatcctgtttctcctccaacttttacccactgatttcagcatatatcagtggatcttgcctgcaaccattattaccatggcatttgcctactagtgattttgtgtttccttcatttgttctccatttattaattggaattcttctgtaaggaggagttgtcccttctccccaacttatccatttattcaattttttttgtaaactatggactcatgggcatctattttattctatgagctataattcaatactgtcatcatttagtttcttgctcaagttattctaacttcagccattgggagctccttcagactggctactatgctgtcttgtcatgcccccaccctttctctagcactttcttacattcttacaccaaaagacattacagcctcatcttgtattttccctgcttctgtccagaattagccattattccaaagatcccgagttcctttattggagaatgatattagacacaaagatgtgggtactaagtatactcgttgctgttggggtgttaattgcttctagggcttcccaagacagagctaggaaatgaaagcatacataataacccatgcatacacacagatcaatatctattcctgtatctatctgtatacatactcatgtgtcctttctaatccacaccacggtattcatcctaaccttccctttttatttttaacttttttcctctgatagtgagaaaataggctctcattatctactctatatacatttatttgttcaacctcagtatctacatacttacatatgcctgtgaggaacagatttactaactagaatcctgtatttgtgtgcaattctttttatctttattataaatatagcacctccaggcttctttttattagtgtcagcatgacatagcttttcccatctttttactgttaatattttaaactcaaaaaaagcaaggaggaaaacagtatgctactatctgtgtgaaaatggaaaataagtatggatatatttgctcatatgtatatatataatatctatgggagagggaaaaccaaaatatcagtttggaggtcaactgattaactggggaaaagagatgaggggaaaacttcgctgcatactctactatcgttgaaatttcttaaactttttcattgagtataattcacaaatcataaaactcacccttttaaagtctacacatcagtagtttttaacacatttatatacaaagttgtgtaactatcatcactaattccaggacattttcatcacccttaaaaaaaaagccatgtacccattagtagttaattcccatacccctcacccctcactcacccatctactgcccttcacaagaccctggcaaccactaatctgctttctgtctctatggatttgccaactcttgatgtttcatataaatggaatcacacaatatgtgaccttttatgtctggcttctttcacttaacatcatgtttttaaggttcatccatgttgtagcatggatcagtactttgttcctttttgtagctgagtaatattacattgtatgtatataccatattttgttgatgtactcattagttgactgtttttctaaatttttgaattatgaaaatatccattcaaaaattaaactttaaaaaatagaaacaaaatgaaaaagcccttctcataaaaaacagaaaaatgtaaaaaaaaaaaa

SEQ ID NO: 10108 - DNA, 1342 bp, Homo sapiens
gccccacctgatctccccacccccgggacctccctgccctcatctcccactgccctcccccttcatggctctgctccagccacgctggggatcttgagtttcctcacacacaccaggctgccgccagcttcagggccttagctgtcgccattctctttgcctggaatgttcttagaaatcctcttcactgtcccctcatctcctgcatgcctctcctcaaaggtcacctcactggaggcctcctggccactgtatctaaaacagtagcccctgccattctctgcaccctttcctcacacctgacaatgtattgttatcctgaatatttaattattttttacctgctcctcctccaactcccaatgagaatgtctgcaccatggaggcagggactgtttctggttcacggctaagtcccaaggccatgaacaagaaggggacagctgtcacactctgcagtagtatatgataggcacacacatatcacatcacttctaggactgctcactctccagtgttctgtctttccagtggcttgttgctgctattttctctgtcatgctcttggtccattttcccttgctctctttcttaattgactataattatagaagtacattaccaatcacttctaagatgaacacttgttcactttttaacatctaggacattgggatgcccattacgatcaatggcatattgtaggggatgatgaataaatgggggacatagttatcagtttttacaaaagaaaaactggtcatgttacagtggagaaatccagtagatgccacttgaaccagctaattaaagttaacataatgaataagatatatcaatatcccataccctcagatgtcatgcacatcatttctgcgtgtgggtttcttttttatttgtcaaaaccacatgatctcagtctaatcatgagaaaacattcaacaagcacaaggtgagatgtattttacagaataactgaccagtattcatcctaagtgtcatggtcatgaaagacaaggaaagactgggaaagtgtcacaggttggaggagactaaggagatataaggaataaatgccatgtgggatcccagattggatcctggaacagaaaaataacattaggaagaaaattggtgacattcaaataaggtcttgagtttacttaagaatcttgtaccagtgataattccctggttttgataactgtgcaatgcatggcatgtaagttgttgacattaggggaatctggataaaaagtatacaggagtttcctgtatcacttttgtaacttttctgtaagcctaaaattattaatatttcaaaataaaatgtttaaaaggc

SEQ ID NO: 10109 - DNA, 686 bp, Homo sapiens; identical to SEQ ID NO: 7114
  misc_feature (95)..(95): n equals a,t,g, or c

SEQ ID NO: 10110 - DNA, 1796 bp, Homo sapiens
attcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 10111 - DNA, 912 bp, Homo sapiens
tactcatatatactttagattgatttaaaacttcatttttaatttaaaaggatctaggtgaagatcctttttgataatctcatgaccaaaatcccttaacgtgagtttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttgccagtggctgctgccagtggcgataagtcgtgtcttaccgggttggactcaagacgatagttaccggataatgcgcagcggtcgggctgaacggtgggttcttgcacacagcccagcttggagcgaacgacgtacaccgaactgagaatacatacagcgtgagctatgagaaagcgccacgcttcccgaagggagaaaggcggacaggtatccggtaagcggcagggtcggaacaggagagcgcacgagggagcttccagggggatacgcctggtatttttatagtcctgtcgggtttcgccacctctgacttgagcgtcgatttttgtgatgctcgtcaggggggcggagcctatggaaaaacgccagctacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagc

SEQ ID NO: 10112 - DNA, 706 bp, Homo sapiens
cagcggtggtttgtttgccggatcaagaactaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagc

SEQ ID NO: 10113 - DNA, 631 bp, Homo sapiens
ccccacttcaagaactttgaagcgccgcctacatactcgctttgatatcttgtaccagtgctgctgcaggtggccaattaagtcgtgtctttaccgggttggactcaagcgaatagtttccggataaggcgcagcggtcgggctgaacggggggttcgtgcacacagcccagtttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaacagcctctcgccgcgcg

SEQ ID NO: 10114 - DNA, 87 bp, Homo sapiens
ctggggccagatggtaagccctcccgtatcgtagttatctacacgacggggagtcaggcaactatggatgaacgaaatagacagatc

SEQ ID NO: 10115 - DNA, 4813 bp, Homo sapiens
gcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggtgagaggccgggcgccggccgtgggcggacgccgcgggggatgggaggttggtggcgtggtggcgggacgcgggcgctcaccgtcctccgggcaggggcgggccaggaatgacagccccctccccctgctcctccgggctcccccgggccgccagcagccggccgggctcggcgagcgcgggtccgggagaacgcgcagggcgggactcggggctgtgggcgccctgggctgtcaagtcccgcctgagcccggaggggcccccccggctacaggctggggtgggggcgtcggcgcgccagcctgatttccgaggacaatccaggaccgtgtcgagcgcgttgtttgcgcctgctaacctttcccttggtgttcggttgctgttccaggccggcgcggtgaacaagcagggcgacagcattctgtgccgctgagccgcgctgtccaggtgagcgcgcatttcccgtctcgggtggccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgtactgtgatttctggtctcatttctttaaaaccttactcttatttttcttttaaggctcttttttctccttaaggaaggtaatattttctaggttagataggactatcagggtttgtgaacattatgcatttaatgttatgggtactttacacacaagttagatggaatttttagagtgaaagaattaagtaggatttaattgggtgctttgtaaatagtcaactgtgtgtataacgtggtctgtttgatttttaaaaggaaaggatttgtttcagattatacaagaataaaagtattatagacccaagggacttcttatgaggtcaaattcagatatttatatgaatatgaaataccatggtccctagtagtcagttgaagtggcaatgtctaaacagaaatgaacaaaactaatgctagcaggttaaaatcaatcaaaatgtttaaaaattgattctgtcctcagcatgttatttcctcagctctgataatttactggtcttgagtattttgagaatttgatgttgaacgttataaagtcaaagaactgcttgtttagatgaggtttatttttatttttgatattattcattcttgtcacacatcaagaagaaaacactagagtgctgctggaattccaaatctgaagaattctaacgactgcattctttgttattaaaaagggcacaatccttcctttttatttggcagtttaatttcagtaggaagcatgtcacatgtgcactgttggttagaattatgcatctgtcatgcctgactgctgaaccctacctaagccttttggcgcagtttaaaacttatactggtggactgtgaacctcaaaacaaatgggtatttttgggttttgaggatagatgttactccttaaagtttgtatttggggcatgaaaaactactgaaagaagaaaagtgctacagatactacatttcaaagagttggcattttccctttggccactcaagcagcatttgatgtatctaaagaaacaaagtcattgtttattttttaaaaaattatatgcagttgtacaagatactacattccattgaaatgttggctatgtcctaaccaggcaaccagataacaaaaacattttgagtcttttatctaggtagttctaattattcagctacttagtttaacaaaggaaaatatcctgacttctctcatttcatttgtagacttttcattgtataggcacaaccaaagagtcagactggtttaaaactccagaaggaaaaaaagtatcccacacagtggatgttgtttctaagaatgctacaaaatcctgacatctcagacatctcaatgttaaaggaagaaaaaaaataccttttcatttcaaagaactaatatactttgatattgtgtaaaccttactcaagtttattgtcaagctttaactgcctttttagaactttttaaaatttcgagcccacaaatctattgtattagttgccttctataacaataaatcttcactgagcaaaaggc

SEQ ID NO: 10116 - DNA, 509 bp, Homo sapiens
ttgctaagctttagcattttttaaaaagaaaacggaaaggctacacattccattccatcattatggtttcggcaaatgtgaaaaggcgaataatgaaacggaggagggaaatatagaacagaatgaacgtgccttcttgaacagcgcgtctttcttaaggcactggaatcccacggatggagtgatgggtggcggagggtccctgggcgccgtgctattaggagtggcagggtatccgcgagcagggcccaggcgctccctcagcagcctagtcgggataaggggggcggtggagagtgaattccggccgcacattcccgcagttcttcgcaggaacttcgctctctcttttcccctcccttgggcacacatcagcctggcccgactcccactcagctctcttttctcagaaccccgacccacagcgttgacggaatggagtgcccttcccattggcccgagcgtcattccccgaggtggcactgcccgcctgattggctggccactcc

SEQ ID NO: 10117 - DNA, 1654 bp, Homo sapiens
cagtgtctggtgcagtggtatgaaaacatttcatcctggaatttgggggttcatcctggaacaagtaaatctacttgttttggtcctttcaaaactattgtgtcattttgcttcttttgatttacaatttctactgagatatttgtgaaaaaaatctatgtttacaattcaattgttgtatattactacccctttagttttcaagttcagaattattgtaggaagaaatattgcagagtggttttggagttagacctgacccaattcagacaagttacttaatcttttgtcattctctggcataaaatacggataatatctactttataggattgtttgggtattaatgagataattcaagtcgattgcttagaacagtaacagtgcctggcccacaaactgtgctcagtaaatggtagctgcttttatttctattgtgtttgttaatgcagtctacagttactgttttaaaggacacacactttgagtttttcctatcatactgatgggtcagatacatgcagctgtttctgttatatataactctggagccgagaaaaattagttgatttacatggagatcaaatccctgtccttggactcagtaatatgttatggttaagttaacaacttggcaaagaacttctttctttgtctcatagttacagtacctctgtaagaagagctctgctggtcgaaacaaaaataatttccattgagaaaatttaagcataaaagctatgaatcaccgttaatgatatcagaataaaatactgattttcacagttaaattgcttgttttgttttatcagtatgatcgccctggagcatcccctaagaggaatcatgatggagaatgcacagctgcccccagtgagtcaggagtctcacactggttctttgctagacagtagtaatgttgttattgttagttgtattatgatagaaatatgtagttaaataagctacatataatagtaatatataaatgttatagtagtaacagttgcccttgtaaaacacaagttttaactgcaggcacctattatacacagatttttgttttcaataagtatattggattctttttctggagattgtcacaatttgaaaaaactcccagttgaaccacatagcctagaaatattgaaaaagttaaggaagccgggtgtggtggctcacacctgtaatcccagcaccttgggaggccgaggcaggtggatcacctgaggtcaggtgttcaagaccagcctggtcagtgtggcgaaaccccatctctactaaaaatacaaaaattagctgggcagtagtggccctcacctgtaatcccagctactcaggaggctgaggcaggagaattgcttgaatccaggaagcagaggttgccgtgagcacacatcgtgccactgcactccagcctgggcaacagagtaagactccgcctcaaaaaaaataatgtttagtgggacccatacgaagtgtcactagtgacgctggaagtgctcccaaagagcagaaaaaagtcataacatgacaagaaagagttgaactgcttgatgtctactgtagattgaggccggcagctgaggttgcctgccatttcaagaaaaatgaatccagtgtaaggaacattgtaaaaaaaaagaagagaaaa

SEQ ID NO: 10118 - DNA, 514 bp, Homo sapiens
tttgaggaactgccatactgttttccatagcagctgcaccatttgacattcccagcaacagtacaaaagggttccagtttttccacatcctcaccaacatgtgattttggggagggggggcaggggttacatcaaacccaattttgttttaaattttaacatttgattagggatagcattctccctgcgtatctctagagaaacaaattttggaaggctgggtgtggtggctcacacctgtaatcccagcactttgggaggctgaggtgggcggatcacgaggccacaaattcgagaccaacatggtgaaactctctactaaactctctaccaaaaatacaaaaattagccgggcgtggtggtcgtgtgcctataatcccagctactcaggaggctgaggcaggagaatcgcttgaaccagggaggcggaggttgcagtgagctgagatcaagccattgcactccagcctgggcgacagagcaagactctgtctccaaaaaaaagaaaaaaaaa

SEQ ID NO: 10119 - DNA, 8098 bp, Homo sapiens
tttgagtttttctggccctgtcagctgctgtggcatgacagatttatacagcatttgcaaaaaaccagcggctgctttttctttaacaatttttcttaaaaactccagttcctattctccagcttctttgtccagtctcctcccctctcctagccaccccccagactctccagatttggggctggtgtcatcaatccaatttattaagtcctcaatgagggggaggaagggccacatctccctctgcaggccctttgaccatcttgatggcttctgctcctccctgtcccctcagctctgccttggtttccccactgacaaaggggatcttctgctgtcctgtgtgccctgaaactaaaacccagggggaggccagaaatcctcagaagttttccagctccctgcaagaatagccaaggacagagaaatcacaggatcaggacgagcagggcaagctggagcagggggtagaacagaccaagtcctttaccgcagaggaagaaaccacactgtggaagggaaataaatagaggggtccagggcagcagagcccaggcccccagggcgcagtggctataggcgcagcaggcgagtgggagcccccggccgcttcagccactgaggaagagacgcttgtaggccttgttcatctgctccaagaagatgaaggtgaggacggtgtgggggcccaggcgggcatagtacggcgtgaagcccttccacaggctgaagaagccctcgtagcggacaactttgaacagcacgtcctagacacagacaggcagggcgctggggctaggactctaggtccccatccccctcacccagctgccttcacacctttcccaggggatccgacaccccctcccaggcccccagaatggcttcctcaccagcccgttcttgtattccggcttcccatcaatcatccgcatgttctggattctgcaggagaggacgcaggggcatgagagaccgaaagggcaccctcccacccacctccaggcccaggctgcacactcaccgggtcttggcaatgtccacaggcatggaggcagcagtggtgacaagaccgctgatcatgctggcacagaagtggcacaagatgttgtcagagaagtagcctgggggaggtgaggcgggggtggcagtcagctcagaggtggctcaggccaggctgggaactaagggcccagctctggatctcacctgagtccagtaagaactgcttggattgggagtaggaggcgagctgggcagcattgacgacgacggcccgagccatggtagggatgcagccctggagggaggggagcggggaagagtcagaaacccctaaaaccagacctcacagcccccaagtctccagcccctccactcacccgccacagtgtgaggacaccctcttcccgggtgattcgaatcagggcgttaaacacatttttgtagccacggcgctggtcagctggaagcctggtgggaaggcagaaagaggtcaagatcaggattgcccacaggtgcaaagaaaggaaggccagaacaggtaaacactctgctccagatccgggataaaaaactggtcctttcattctagattcgagggaatggggctggggttaggttcagacttggaactcaccggccatcggcagtcatgcggataagagccacttcggctggtgttcccacaaaggcaccagtggcacctgcggtcatgccaatcacagccttcagcagaaagccagggggagtaccatcagccccagtcaggcgctcaaacagcacggtatagatgccaaggcgggtagtggtgtaggtggcctgacgcagcaggccagccgacagcctgaggagcagaggggtcagcatatcaggccaaggtctagagctgccaacccacagtctaccctccatcctgaggccccaatacccagtgtaaatgcccctcaggccttctgccttcaggatactggtgagggcatggaagctggttttgtactctcgagtcttggccccttccccgctcaactgcatccggttcttcaccaggtccaggggctggacaaaaactgtagctcccatcctgggggaagacagaggtggagtgaagggccaggcattccagatctaccagtgcccactggagcctggcagcaagaggttacaaaggtcagggcctgccatgcgattcaagaatcaggatgctggtgagcatgtgtataagagtctatatgtacaccaagtgcaacgggtctgaaaagtctagttgtccagtaggggccatgcaatgaaagtgctccaagcagcttcatgacagtcaagcagtgacctggggctgcacgcagtccgacacagggaggggaggaaggggcatccaagatttaggactccaggtagtcctgcaggagccatttaatggcctggaaccccctgccgcccggccgagcttagcaatgcgctgggaaactcagctggcccggcgggggttgtgcaacgaccctgcatgcagtccataagggtcctgcaatggggccctagcagcccatcggggaactcgcaatacgctggagatcgcgctgaccccgtgccggcacagttcactgcaacagacccagagatgaaccgggcccggttccttttgcccttcccttcctcctcttttcccatccctggggcctgagcttacccggccaggcccccaaacaggaacttgacggacttaggggaggtacggggcttcccgtctatcccgccggccccggcactcgccgtcgccgccatcgccactcaatggccctcggctccgggtcccgtgcgcgcgcggccccgctcgcgcccaaggtgacaccgcgcgcgcaacagagcgagggcgcgcgcacgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggtgagtctgagggacggatggggaaagggcgctgaaaggaagggttgcaggctgaaggggaacatcgccttttttgtccgcagacctcggaccacaatgccagcatggactttgcagaccttccagctctgtttggggctaccttgagccaggagggcctccaggtgattttctttcttttcttttcctccttccctcccttccttccttttctgtcttttttctttttttagtatttcgcaagatcctccatcctaggctggggttggggaggtttgtcctgggtgaaactggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggtctcaggtgctagttattgcttatatgactttgggcaagttaatctctctgagccttagtttgttttactgtaaaatgggatattagaagttttcctagggttattgtgaagatcaaagtagatacgcaattttggtagtatttcatcccaaagactgccacatagcaagaactcagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactccagcctgggtgacaaaacgagactccatctcaaaaaaaagaaaaacaaaaagaaaactgaagggaggggagtgtgtctgtatgagtatgtgctggagaggggactgtgaaacagaacttgagagaaagtgacatgggtggtttgagaattgaattacaattggaatattagaaggcaaaaataattgcattagcttgcagtatagggtacagattagcccatctgggacagcgagagggatgatgggagagtttggtgaagggatgttttatgtcattgccttttcaagaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctgaatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccaatcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaaggggtaggacatgtgcctccttcccattcttccttcagcaagcagttccatgccaacctggagcccaggcctcctcattacccgaaccattcagcctcctgtccttccttccctgcctctttgactttcttcccattcctgtccccacctatgggctttgtccagagccagttactttgtccctctttttttctccctttgcctttctcgccctgctgagactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggatagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttcccttcttacctctgcttctctttgcttgtcccttctagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgtttctttgtggactaaggaag

SEQ ID NO: 10120 - DNA, 6462 bp, Homo sapiens
  misc_feature (328)..(328): n equals a,t,g, or c
accggccatcggcagtcatgcggataagagccacttcggctggtgttcccacaaaggcaccagtggcacctgcggtcatgccaatcacagccttcagcagaaagccagggggagtaccatcagccccagtcaggcgctcaaacagcacggtatagatgccaaggcgggtagtggtgtaggtggcctaacgcagcaggccagccgacagcctgaggagcagaggggtcagcatatcaggccaaggtctagagctgccaacccacagtctaccctccatcctgaggccccaatacccagtgtaaatgcccctccagccttctgccttcangatactggtgagggcatggaagctggttttgtactctcgagtcttggccccttccccgctcaactgcatccggttcttcaccaggtccaggggctggacaaaaactgtagctcccatcctggggggaagacagaggtggagtgaagggccaggcattccagatctaccagtgcccactggagcctggcagcaagaggttacaaaggtcagggcctgccatgcgattcaagaatcaggatgctggtgagcatgtgtataagagtctatatgtacaccaagtgcaacgggtctgaaaagtctagttgtccagtaggggccatgcaatgaaagtgctccaagcagcttcatgacagtcaagcagtgacctggggctgcacgcagtccgacacagggaggggaggaaggggcatccaagatttaggactccaggtagtcctgcaggagccatttaatggcctggaaccccctgccgcccggccgagcttagcaatgcgctgggaaactcagctggcccggcgggggttgtgcaacgaccctgcatgcagtccataagggtcctgcaatggggccctagcagcccatcggggaactcgcaatacgctggagatcgcgctgaccccgtgccggcacagttcactgcagcagacccagagatgaaccgggcccggttccttttgcccttcccttcctcctcttttcccatccctggggcctgagcttacccggccaggcccccaaacaggaacttgacggacttaggggaggtacggggcttcccgtctatcccgccggccccggcactcgccgtcgccgccatcgccactcaatggccctcggctccgggtcccgtgcgcgcgcggccccgctcgcgcccaaggtgacaccgcgcgcgcaacagagcgagggcgcgcgcacgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggtgagtctgagggacggatggggaaagggcgctgaaaggaagggttgcaggctgaaggggaacatcgccttttttgtccgcagacctcggaccacaatgccagcatggactttgcagaccttccagctctgtttggggctaccttgagccaggagggcctccaggtgattttctttcttttcttttcctccttccctcccttccttccttttctgtcttttttctttttttagtatttcgcaagatcctccatcctaggctggggttggggaggtttgtcctgggtgaaactggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggtctcaggtgctagttattgcttatatgactttgggcaagttaatctctctgagccttagtttgttttactgtaaaatgggatattagaagttttcctagggttattgtgaagatcaaagtagatacgcaattttggtagtacttcatcccaaagactgccacatagcaagaactcagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactccagcctgggtgacaaaacgagactccatctcaaaaaaaagaaaaacaaaaagaaaactgaagggaggggagtgtgtctgtatgagtatgtgctggagaggggactgtgaaacagaacttgagagaaagtgacatgggtggtttgagaattgaattacaattggaatattagaaggcaaaaataattgcattagcttgcagtatagggtacagattagcccatctgggacagcgagagggatgatgggagagtttggtgaagggatgttttatgtcattgccttttcaagaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctaaatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccaatcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaaggggtaggacatgtgcctccttcccattcttccttcagcaagcagttccatgccaacctggagcccaggcctcctcattacccgaaccattcagcctcctgtccttccttccctgcctctttgactttcttcccattcctgtccccacctatgggctttgtccagagccagttactttgtccctctttttttctccctttgcctttctcgccctgctgagactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgcttttatgcataaatacaacgaagacgggagaggagatggaaagcaaagatgattaagtgaaataattgtgggaaacaatagagggacagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttcccttcttacctctgcttctctttgcttgtcccttctagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaggaag

SEQ ID NO: 10121 - DNA, 327 bp, Homo sapiens
ttgccttcctggagtttaatgacaactgctgggacctacctggcagcagcctgcagtactaggggcaaaggtgggtgcctgctttgcacctgcagcctcagaagtgcagctctcctcactgcccaggtcagcaggacagcaaggggtggaccctgcagcatgcaccatcttggtgtgactgaatagtcttgggtttcctgctctcaggctgggacacaggcaaatggaaccccatttcttttctcataaatcctgccattctctaaacacactggtgtggcttcctctcctgccttgtctccagcccaatccaaggcttggggccca

SEQ ID NO: 10122 - DNA, 3387 bp, Homo sapiens
caccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgctggaggaggaggaaagagaaaggaggctaggatccaggtgtcacaattccaccccctgccagctgttcagcagctgtccagccctgggggctgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatgccacctccaggttctaacaaaagaactcaaacgatgaactcgatgattcaagaccccaacaatctacctatactcctagaaaacagtttctaatccgagctcaaggcagtaagtaatttaagaggtaatgcagttcagcaacttcgaattacaagatgaggaactgagacagaatggagggactatcccgtgttccagcatccagcagacaaggaacacaatactggtctgactcccttcatgttggggaatcacacaaaaaagcaccctcaagattaccagaaggcggtacattagagatcttggagctaaaggaagggtaagactcaggaactcactcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggctggaagaggaaccaagcgcccatcaagttagtcagtgcaccaagattcccaccgtgttctccaaagacccacctgtcttccacttctgagaaccaccccgccgtgggggctaagtataaattatatactcagtacacatcaatgaactgtgagaaactctgaggactgtgggacgttagtgcagaaaaagatcatgattctgaaacttagaatatggaaccagggaggaagggatgacatactcctctagagatttagatgtcagtgttaatggggaaagtaaacccaggaaataaagggagtcagtgaggtaagtgaggagcctttggatgctcagaactctccttcaggaaaagcagaagcggagaggggaagggaggggggcgggcgaggcaagagaagcaactttgcccttatttggtcaaaggttctgcaggagctgttagggcccggacgcctgggtctccaagtaacctagagtttagctccaggtatctctgctctgagatgaggaagcagacccctgggggctttccgggaaagttggaaaacttttgaaggtggacaggggccagacccggcaggccagctctcgggtctaggtaccccgggaacctttcccccctccccctttcaccccaagcccccacatccggtcccctcccgcccggaaacccccttccccccccttttgaacttccgctccccctccccacttccgggcagtgtggacagggagatggtggtgggagcagcggtagtaaaccaatatactttcgcttatgctgtctcagaacttctcacaaagttcccctgctccaggccccgccggatggcgggaagggagggcgaggggacttccgggattggcctcgcaggaatgttgaatccaacgtgctgagctgggggggcgtgtggtggcctcgccctctctaacggagttaggaggggccagaagcccacagagggtgggcaagggaccaagaccacgcgcctggggctcccttccgcaccaggagaaacaatggtagagggacgcgggctggcagccggacggggagctgggggtccaaggatccccgggtcccctctcaatcccaatccccagtaaaaactgaggcgcgtccccgccccgccctgggagaggcggaagtgggccgccgcaccgggcgccgcgcccctccccgccctgtgccccggatgtaacgccccgtcgcggaaagcggggtagcgggcgggatgggcgccgccgcctggggcataggacctacgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacaggtcccgtccgccatgaggttgtcgatgtaggcgttccacccggccatggcgctgctactggggctgctctcggcgctgctgctggggccgcggactgggctcgagctgcctcggctggcgggcggggggaggcggagagctcggggcacgcgctgccgtccggaccgcggctccgctcgctgtgcagcagccctcgcaccgccacttcctgctcctccccccccccgccccgctagatttttatttgcaaaggacggtaggggcggggcctactccccattccctccctcccccactcgccagcccagacaccgaactttgcaaatgcaattttaaaaatccctccccctattgcaaaatttgcagagttcgatggaaagcaatgcagaaggatggggggtggcgggagagaggtgaagggtagggtttgctccaatttgcactgaatataaaccagactttggtatcggggcagggagtgagccagaagaaggaaggaaggagaaagcaggaggaattagcaagctgcaaatttagcaaattaaggagagttcggggagcccagggttaaacgggatgactcctccttcccccacctccgccgaagggaaggaccggcgggcggcggcgcgtgtgcccgcgcctgcgcctgcgccggggccgggagtgcatggggcggtcggggcc

SEQ ID NO: 10123 - DNA, 2907 bp, Homo sapiens
caccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgctggaggaggaggaaagagaaaggaggctaggatccaggtgtcacaattccaccccctgccagctgttcagcagctgtccagccctgggggctgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatgccacctccaggttctaacaaaagaactcaaacgatgaactcgatgattcaggaccccaacaatctacctatactcctagaaaacagtttctaatccgagctcaaggcagtaagtaatttaagaggtaatgcagttcagcaacttcgaattacaagatgaggaactgagacagaatggagggactatcccatgttccagcatccagcagacaaggaacacaatactggtctgactcccttcatgttggggaatcacacaaaaaagcaccctcaagattaccagaaggcggtacattagagatcttggagctaaaggaagggtaagactcaggaactcactcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggctggaagaggaaccaagcgcccatcaagttagtcagtgcaccaagattcccaccgtgttctccaaagacccacctgtcttccacttctgagaaccaccccgccgtgggggctaagtataaattatatactcagtacacatcaatgaactgtgagaaactctgaggactgtgggacgttagtgcagaaaaagatcatgattctgaaacttagaatatggaaccagggaggaagggatgacatactcctctagagatttagatgtcagtgttaatggggaaagtaaacccaggaaataaagggagtcagtgaggtaagtgaggagcctttggatgctcagaactctccttcaggaaaagcagaagcggagaggggaagggaggggggcgggcgaggcaagagaagcaactttgcccttatttggtcaaaggttctgcaggagctgttagggcccggacgcctgggtctccaagtaacctagagtttagctccaggtatctctgctctgagatgaggaagcagacccctgggggctttccgggaaagttggaaaacttttgaaggtggacaggggccagacccggcaggccagctctcgggtctaggtaccccgggaacctttcccccctccccctttcaccccaagcccccacatccggtcccctcccgcccggaaacccccttccccccccttttgaacttccgctccccctccccacttccgggcagtgtggacagggagatggtggtgggagcagcggtagtaaaccaatatactttcgcttatgctgtctcagaacttctcacaaagttcccctgctccaggccccgccggatggcgggaagggagggcgaggggacttccgggattggcctcgcaggaatgttgaatccaacgtgctgagctgggggggcgtgtggtggcctcgccctctctaacggagttaggaggggccaggagcccacagagggtgggcaagggaccaagaccacgcgcctggggctcccttccgcaccaggagaaacaatggtagagggacgcgggctggcagccggacggggagctgggggtccaaggatccccgggtcccctctcaatcccaatccccagtaaaaactgaggcgcgtccccgccccgccctgggagaggcggaagtgggccgccgcaccgggcgccgcgcccctccccgccctgtgccccggatgtaacgccccgtcgcggaaagcggggtagcgggcgggatgggcgccgccgcctggggcataggacctacgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacaggtcccgtccgccatgaggttgtcgatgtaggcgttccacccggccatggcgctgctactggggctgctctcggcgctgctgctggggccgcggactgggctcgagctgcctcggctggcgggcggggggaggcggagagctcggggcacgcgctgccgtccggaccgcggctccgctcgctgtgcagcagccctcgcaccgccactt

SEQ ID NO: 10124 - DNA, 2213 bp, Homo sapiens
tttagggagagaattgtggctatgttacaaacaatctaccagagacttacagacggcagctgtctattccccatttgacttcatcatttatgagcagacgtttgttaagcacatattgggtagcaaaacatctataatattagcttttaattttttaaaaaacttttatttccagaaagcttagctttatctacaagtacagttggtccttgaacaatgtagattagggggtgctgaccctctgtgaagctgaaaaaccatgtataatttttgactccctgaaaacgtaacaatgaatagcctgttgttcactggaagcattgctgatgacataaatggtcaactaacacatatttgtttgttctatatattatatgctgtattcttacaataaagcaagctgggcctggcgctgtggttcacatgtgtaatcccagcaatttacgaggctgaggcgggcagatcacttgaggccagttgttcaagaccagcctggtcaacatggtgaaaccccatctctactaagaatacaaaaactattttgggtgtgggtggtgcgcacctgtaattccagttactcaggaggctgaggcaggagaatcgcttgaaccgggaggcggaggctacttgagccgagatcatgccactgcactccagctctgggcaacagagtgagactctgtctaataaataaataagtaactaaataaataactaaatagctaactaaagctagagaaaagaaaatgttattaagaaaataataaggaagagaaaatatatttactattcattaagtgcaagtggatcatcatgaagggcttcttcctcattgtcttcatgttgagtagggctgaggaggaggaagatgaggggttagtcttgctgtcttgcgggtgacagatgtggaagtaaatcctcatgtaggtgggaatgagcagttcaaacctatgttgttcaagggccaactatagttgattaactcatatctctacagttaattttcaaacagatgtgatagctgaatgagaacttttaagatagtactggacagtaaccttattggaactggaatggcctttagactttttgtgtccagtttcttctcacctcctctttctcttcaaatgtgcaactgaaactgagagacctcagtcccatgtccaaggtcaggcagatacttagcggcagagtgaggactccagcccatttctgcagctctgctgtgcagtggaagatttgggacaagtacattatttaaaaatgcccacccactaaatattacattcctaacttttcccaatacacaaatatgcttgaacttttaaaagcttgtttttggtcgtgcttggtttggaatgtgaatgactaaaactacctttagcaatttcccaaagtgtaagttcaaatgtacagagaatttttttcctgaatgcccaacacaatatgcagttttacaacacataccagattcttagattcatttggtgaaggaagcctctgaattaaaacttttaaatatttctgatttgcaaccagacgaaaaagaagaaaattgacaacttttttgatgcaactttgtgaaatcatggtgttcctggtttttctggtctggtttttgttgttgttttgttttgttttgccacagtttagttcctcacctgatctttccttgtatccacttcagagtctctgaaatgttatctgtttgttggttcctgggaaattgagagccttttcaaagactccatctagaagcatatttaaaagtgtgaaagaagacatttatgcgaccaacaaacatatgaaaaaaagcttatcatcatgggtcattagagaaatgcacagcagaaccacaatgagataccatctcataccagttagaatggtgatcactaaaaagtcaggaaaggccaggggcggtgactcatgcctgtaatcccagcactttgggaggctgaggcgggtggatcacctgaggtcaggagtacaagactagcctggccaacatagtgaaaccccatctctactaaaaatacaaaaattagctgggtgtggtggcgggcacctgtaatcctggctactcaggaggctgaggcaggagaatcgcttgaatctgggaggcagaggttgcagtgagccgagattgtcccactgcaactccagcctgggtgacagactccatctcagaaaaaaaaaaaaaaaaaaaattc

SEQ ID NO: 10125 - DNA, 1400 bp, Homo sapiens
tcatgaagggcttcttcctcattgtcttcatgttgagtagggctgaggaggaggaagatgaggggttagtcttgctgtcttgcgggtgacagatgtggaagtaaatcctcatgtaggtgggaatgagcagttcaaacctatgttgttcaagggccaactatagttgattaactcatatctctacagttaattttcaaacagatgtgatagctgaatgagaacttttaagatagtactggacagtaaccttattggaactggaatggcctttagactttttgtgtccagtttcttctcacctcctctttctcttcaaatgtgcaactgaaactgagagacctcagtcccatgtccaaggtcaggcagatacttagcggcagagtgaggactccagcccatttctgcagctctgctgtgcagtggaagatttgggacaagtacattatttaaaaatgcccacccactaaatattacattcctaacttttcccaatacacaaatatgcttgaacttttaaaagcttgtttttggtcgtgcttggtttggaatgtgaatgactaaaactacctttagcaatttcccaaagtgtaagttcaaatgtacagagaatttttttcctgaatgcccaacacaatatgcagttttacaacacataccagattcttagattcatttggtgaaggaagcctctgaattaaaacttttaaatatttctgatttgcaaccagacgaaaaagaagaaaattgacaacttttttgatgcaactttgtgaaatcatggtgttcctggtttttctggtctggtttttgttgttgttttgttttgttttgccacagtttagttcctcacctgatctttccttgtatccacttcagagtctctgaaatgttatctgtttgttggttcctgggaaattgagagccttttcaaagactccatctagaagcatatttaaaagtgtgaaagaagacatttatgcgaccaacaaacatatgaaaaaaagcttatcatcatgggtcattagagaaatgcacagcagaaccacaatgagataccatctcataccagttagaatggtgatcactaaaaagtcaggaaaggccaggggcggtgactcatgcctgtaatcccagcactttgggaggctgaggcgggtggatcacctgaggtcaggagtacaagactagcctggccaacatagtgaaaccccatctctactaaaaatacaaaaattagctgggtgtggtggcgggcacctgtaatcctggctactcaggaggctgaggcaggagaatcgcttgaatctgggaggcagaggttgcagtgagccgagattgtcccactgcaactccagcctgggtgacagactccatctcagaaaaaaaaaaaaaaaaaaaaa

SEQ ID NO: 10126 - DNA, 108 bp, Homo sapiens
tcacaatagcaaagacttggaaccaacccagatgcccatcaatgatagactggataaagaaaatgtggcacatatataccatggaatactatgtagctataaaaaagg

SEQ ID NO: 10127 - DNA, 1651 bp, Homo sapiens
tgaggttggggtgtggtggaagagtgggcagtcttctcagggcttcagccaccaagagaagctcctggtccaggcagggacgtggattcgtgaaccaatctttttttttctctgttgcaatgtggaccccatttctctccagagggaggaggagacataaagccatgagaccctggaaagcatttctgagctggggcacaagcctaggaggcagtgggtagcaaagtgagttgggatggaggaaaattactcttcatttgaggtgtggttctctctctcccactgagaagaaaatgcatggcagaaagaacatctgtcagttttgccccacagtggaaaatgcaaggctgggaaacctgagtcctgggttttcctacggccgttccaggcactgggcagcacgatgccaggaatgttctttcctttttctccagggaaggctaagtgggtgtcagccattcacacctctgtgggaaagactctaccactggcactgtccttccaacacctggataaagtcagggttttcaatgaggggcaggggctgggggaggtgatgtgattctcaaagccagggcctgtgtagggagatatctgggcccgggaccctcacccagacctgctgaggaaggcgtgagtctctcccgctcacagaggggttgggcaaagacttgaacctgagtctgtctaactccaacacagggatttttcctcccctgcccctctgtctcagccagctgcacagtttcactacaaacatcagtcccaggggagagggaggaaggagaggggcagggtggtgaggtctgcgttccttaaataaacggagggcagaattctagccagaagggggcgagggttacccagcccagtggagcatggagccgcccctctagttcccactgccaccgtgatgccatcagatgggagaaaacacagaactcgggatgaaacgtcacacggtctgggctaaagatcttgctctttaatttcccagcaggtaaccttgtggcagtcactaaccctctctacacctcaatgttctcatctgtaaaatggaaatgatgacccctgggtctcccaggaccgtgaggggtcctgaaagggcaggtgtgcgcggtgctttgtagatgataaggcatctcagaaacaccggggctttactgttattttctctccagcttgtttgggcagacaaaagagaaatcgagcccagtcattcttagcacagccaagaagggcagatttcaaaaggagccttgcttcaaactgaggaaaaccaaaaaggaaaaaacaacaaacacagctgcccctaccctccagtccacaaaacagtctgtgtctgacaagctgggctctgccagcggcccacccccagactcctgcaccagctggccttcctgacctgtgtgccctgggagccaggccgactcttcacacttccagtcaccgacacagtgcaatgcaacccattcttgctcaaggcctccttagaaattattcctcccattgctcgaacctgggagttggagattgcagtgagccacgatggtgccactccactctagcctgggtgacacagtgagaccctgcctcaaaaaaaagaaaagaaaagggaggggagggaagggaaaattaaaaaaaaagaaaa

SEQ ID NO: 10128 - DNA, 304 bp, Homo sapiens
acatcctctctctgagcctcagtttactcgtgtgtaaagcaaggaggctggactcgacaacccttaggatccattccaggtctaatctgtttccgaacctttaatgcgcacctagagtgtaccaaacactgtactatttattggggatatggtggggaacaagaggccaaggaaggggacagtaatcgggtaggcaaattaagaagcaggatagttttaggcagggatcaatgctgtgcaataaaccaggtgctgtaataagagtggctagggggtgatggaagtggagagggatttctaccat

SEQ ID NO: 10129 - DNA, 1012 bp, Homo sapiens
  misc_feature (39)..(838): n equals a,t,g, or c
ttgtttgtttgtttttgttttgttttgtttttgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaattaggtgggtgtggtggtcacatctgtagtcctagctactcaggaggctgaggcgggagggatcacttgagctcaggaagttgaggttacagtgaactgtgatcatcccactaaactctagcatggatgacagaacaagaccttgtctcagaaaacaaacaagtaacaa

SEQ ID NO: 10130 - DNA, 860 bp, Homo sapiens
cctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatcaccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaagaaaagaa

SEQ ID NO: 10131 - DNA, 861 bp, Homo sapiens
cctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatcaccctggctttttttttgtgctaatttttcctcttactacttttatgagtaccagaaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaagaaaagaa

SEQ ID NO: 10132 - DNA, 275 bp, Homo sapiens
cacgcctgtaatcccagcactttgggaggccgaggagggtggatcaggaagtcaggagatcgagaccatcctggctagcacagtgaagccccgttctctactaaaaatacaaaaaaagttagcagggcatggtggcgggcgcctgtagtcccagctactcaggaggctgaggcaggagaatggcgtgaacccaggaggcggagcttgcagtgagccgagatcgcgccactgcactacagcctggatgacagagcaagagtctgtctcaacaacaa

SEQ ID NO: 10133 - DNA, 361 bp, Homo sapiens
aaatagtctatttaaaaagttaaaataacaaaagaataaaaattgacagtctttttgaggctatcagatcagcaaagaaatttcccctcagttttgagtagccaggtagtgggaaacaagctcatattctattatttgaattacaagttaacatttttagatggtacttctacaaaaataaaaacatgtaaatcccctgactcagcaattcccaatttggtattttattctactgaaatacttgtagaaaatgtgctatggaaacgaaattattcaccacagttctgttcatatgtaatagcaaataactaaaatcctaaatacccttaatatgagatatagttaacagactatagtgcag

SEQ ID NO: 10134 - DNA, 1901 bp, Homo sapiens
ttattttgttaatagtttcttttgctatgcagaagctcttaataagtttaatgagatcctgatatgttaggctttgtgtccccacccaaatctcatcttgaattataatctccataatcaccacatggagagaccaggtggaggtaattgaatctgggggtggtttcacccatgctgttcttgtgatagtgaatgagttctcacgagatctaatggttttatgaggggctcttcccagctttgcctggtacttctccttcctgccgctttgtgaaaaaggtgcattgcgtccctttcaccttcttctataattgtaagtttcctgaggccttcccagccatgctgaacttcaagtcaattaaacctttttctttataaattactcagtctctggtggttctttatagcagtgtgaaaatggactaatgaagttcccatttatgaatttttgcttttgttgcaattgcttttgacatcttagtcatgaaatccttgcctgttctaagtacaggacggtattgcctaggttgtcttccagggtttttctaattttgtgttttgcatttaagtgtttaatccatcttgagttgatttttgtatattgtgtaaggaaggggtccagtttcaatcttttgcatatggctagttagttatcccagtaccatttattgaaaagacagtcttttccccatcgctcgtttttgtcagttttattgatgatcagataatcatagctgtgtggctttatttctgggttctttattctgttctattggtttatgtccctgtttttgtgccagtaccatgctgttttggttaacatagccctgtagtatagtttgaggtcagatagcctgatgcttccagctttgttctttttcttaagattgccttggctatttggcctcttttttggttccacatgaattttaaaacagttgtttctagtttttgaagaatgtcattggtagtttgatagaaatagcatttaatctgtaaattgatttgtgcagtatggccttttaatgatattgattcttcctatccatgagcatgatatgttttccattttgtttgtatcctctctgatttctttgtgcagtgttttgtaattctcattgtagagatttttcacctccctggttagttgtattttaccctagatattttattctttttgtgaaaattgtgaatgggattgccttcctgatttgactgccagcttggttactgttggtttatagaaatgctagtgatttttgtacattgattttctttctaaaactttgctgaagttttttttattagcagaaggagctttggggctgagactatggggttttctagatatagaatcatgtcagcttcaaatagggataattttacttcctctcttcctatttggatgccctttatttctttctcttgcctgattactctggctgggatttcctatgttgaataggagtcatgagagagggcatcaaatctacacatatcaaatactaaccttgaatgtaagtgggctaaatgccccacttaaaaggtaaaggggggcaagctgaataaaaaagcaagactcaatggtatgctgtctttgagacctatctcacatgtgatgacacccataggctcaaaataaaggaatggaggaaaatctaccaagcatgtagaaaacagaaaaaagcaggggttgcatcctaatttcagaccaaacagacttcaaaccaacaaagttcaaaaaagacaaagaaggggccgggagtggtggctcacacctgtaatcccagcactttgggaggccaaggtgggtggattaccaggtcaggagatcgagaccatcctggccaacattgtgaaaccccatctctactaaaatccaaaaaaaaaaaaaaaaaaaa

SEQ ID NO: 10135 - DNA, 2524 bp, Homo sapiens
ttattttgttaatagtttcttttgctatgcagaagctcttaataagtttaatgagatcctgatatgtttaggctttgtatccccacccaaatctcatcttgaattataatctccataatcaccacatggagagaccaggtggaggtaattgaatctgggggtggtttcacccatgctgttcttgtgatagtgaatgagttctcacgagatctaatggttttatgaggggctcttcccagctttgcctggtacttctccttcctgccgccttgtgaaaaaggtgcattgcatccctttcaccttctcctataattgtaagtttcctgaggccttcccagccatgctgaacttcaagtcaattaaacctttttctttataaattactcagtctctggtggttctttatagcagtgtgaaaatggactaatgaagttcccatttatgaatttttgcttttgttgcaattgcttttgacatcttagtcatgaaatccttgcctgttctaagtccaggatggtattgcctaggttgtcttccagggtttttctaattttgtgttttgcatttaagtgtttaatccatcttgagttgatttttgtatattgtgtatggaaggggtccagtttcaatcttttgcatatggctagttagttatcccagtaccatttattgaaaagacagtcttttccccattgctcgtttttgtcagttttattgatgatcagataatcatagctgtgtggctttatttctgggttctctattctgttctattggtttatgtccctgtttttgtgccagcaccatgctgttttggttaacatagccctgtagtatagtttgaggtcagatagcctgatgcttccagctttgttctttttcttaagattgccttggctatttggcctcttttttggttccacatgaattttaaaacagttgtttctagttttgtgaagaatgtcattggtagtttgatagaaatagcatttaatctgtaaattgctttgtgcagtatggccttttaatgatattgcttcttcctatccatgagcatgatatgttttccattttgtttgtatcctctctgatttctttgtgcagtgttttgtaattctcattgtagagatttttcacctccctggttagttgtattttaccctagatattttattctttttgtgaaaattgtgaatgggattgccttcctgatttgactgccagcttggttactgttggtttatagaaatgctagtgatttttgtacattgattttctttctaaaactttgctgaagttttttttattagcagaaggagctttgcggctgagactatggggttttctagatatagaatcatgtcagcttcaaatagggataattttacttcctctcttcctatttggatgccctttatttctttctcttgcctgattactctggctgggatttcctatgttgaataggagtcatgagggagggcatcaaatctacacatatcaaatactaaccttgaatgtaagtgggctaaatgccccacttaaaaggtaaaggggggcaagctgaataaaaaagcaagactcaatggtatgctgtctttgagacctatctcacatgtgatgacacccataggctcaaaataaaggaatggaggaaaatctaccaagcatgtagaaaacagaaaaaagcaggggttgcatcctaatttcagaccaaacagacgtcaaacaaacaaagttcaaaaaagacaaagaaggggccgggagtggtggctcacacctgtaatcccagcactttgggaggccaaggtgggcggattacaaggtcaggagatcgagaccatcctggccaacattgtgaaaccccatctctactaaaatccaaaaaaaaaaaaaaaaaataagctgggcttggtggtgtgtgcctgtagtcccagctactcgggaggctgaggcaggagaatcacttgaacccgggaggcggagattgcagtgagctgagattatgccactgcactatagcctggcgacagagtgaggctccgtctcaaaaaaaaaaaaaaaaaaaaagacgaagggcattacataatgatgaagggttttactcaacaagaagaccttactaacctaaatatatatgcacccaacacaggaacacccagattcataaagtaagttcttagagtacaaagaggctcccacacaataatagtaggagactttaacacaccactgatagtcatagacagatcatcaaggtagaaaattaacaatgatattcaggatctgaacccaacattccaccgaatgagtctgatagacatctacagaactctccatccaaaaacaacagaatatacattcttctcatctccacatggcacatgctctaaaattgaccacataatgcctttcttttcagtggtccatatgtaagtcttttgaaagtggcagcatctctactgctcatgcttgttgcaaggaactctactgaatacaaggaactttactaatctctaatgct

SEQ ID NO: 10136 - DNA, 2527 bp, Homo sapiens
ttattttgtcaatagtttcttttgctatgcagaagctcttaataagtttaatgagatcctgatatgtttaggctttgtatccccacccaaatctcatcttgaattataatctccataatcaccacatggagagaccaggtggaggtaattgaatctgggggtggtttcacccatgctgttcttgtgatagtgaatgagttctcacgagatctaatggttttatgaggggctcttcccagctttgcctggtacttctccttcctgccgccttgtgaaaaaggtgcattgcatccctttcaccttctcctataattgtaagtttcctgaggccttcccagccatgctgaacttcaagtcaattaaacctttttctttataaattactcagtctctggtggttctttatagcagtgtgaaaatggactaatgaagttcccatttatgaatttttgcttttgttgcaattgcttttgacatcttagtcatgaaatccttgcctgttctaagtccaggatggtattgcctaggttgtcttccagggtttttctaattttgtgttttgcatttaagtgtttaatccatcttgagttgatttttgtatattgtgtatggaaggggtccagtttcaatcttttgcatatggctagttagttatcccagtaccatttattgaaaagacagtcttttccccattgctcgtttttgtcagttttattgatgatcagataatcatagctgtgtggctttatttctgggttctctattctgttctattggtttatgtccctgtttttgtgccagcaccatgctgttttggttaacatagccctgtagtatagtttgaggtcagatagcctgatgcttccagctttgttctttttcttaagattgccttggctatttggcctcttttttggttccacatgaattttaaaacagttgtttctagttttgtgaagaatgtcattggtagtttgatagaaatagcatttaatctgtaaattgctttgtgcagtatggccttttaatgatattgcttcttcctatccatgagcatgatatgttttccattttgtttgtatcctctctgatttctttgtgcagtgttttgtaattctcattgtagagatttttcacctccctggttagttgtattttaccctagatatttttattctttttgtgaaaattgtgaatgggattgccttcctgatttgactgccagcttggttactgttggtttatagaaatgctagtgatttttgtacattgattttctttctaaaactttgctgaagttttttttattagcagaaggagctttggggctgagactatggggttttctagatatagaatcatgtcagcttcaaatagggataattttacttcctctcttcctatttggatgccctttatttctttctcttgcctgattactctggctgggatttcctatgttgaataggagtcatgagagagggcatcaaatctacacatatcaaatactaaccttgaatgtaagtgggctaaatgccccacttaaaaggtaaaggggggcaagctgaataaaaaagcaagactcaatggtatgctgtctttgagacctatctcacatgtgatgacacccatcggctcaaaataaaggaatggaggaaaatctaccaagcatgtagaaaacagaaaaaagcaggggttgcatcctaatttcagaccaaacagacgtcaaacaaacaaagttcaaaaaagacaaagaaggggccgggagtggtggctcacacctgtaatcccagcactttgggaggccaaggtgggcggattacaaggtcaggagatcgagaccatcctggccaacattgtgaaaccccatctctactaaaatccaaaaaaaaaaaaaaaaaaaataagctgggcttggtggtgtgtgcctgtagtcccagctactcgggaggctgaggcaggagaatcacttgaacccgggaggcggagattgcagtgagctgagattatgccactgcactatagcctggcgacagagtgaggctccgtctcaaaaaaaaaaaaaaaaaaaaagacgaagggcattacataatgatgaagggttttactcaacaagaagaccttactaacctaaatatatatgcacccaacacaggaacccccagattcataaagtaagttcttagagtacaaagaggctcccacacaataatagtaggagactttaacacaccactgatagtcatagacagatcatcaaggtagaaaattaacaatgatattcaggatctgaacccaacattccaccgaatgagtctgatagacatctacagaactctccatccaaaaacaacagaatatacattcttctcatctccacatggcacatgctctaaaattgaccacataatgcctttcttttcagtggtccatatgtaagtcttttgaaagtggcagcatctctactgctcatgcttgttgcaaggaactctactgaatacaaggaactttactaatctctaatgct

SEQ ID NO: 10137 - DNA, 247 bp, Homo sapiens
tgaaattatatttcattgtggttttaatttgcatttctctaatgatcagtgatattgagtttgttttttttcacatgcttgttggctgcatgtatgtcttcttttaaaaagtgtctgttcatgtactttgcccacattttaatggggttgtttttctcttgtaaatttgtttaaattccttataggtgctggattttagacatttgtcagacgcatagtttgcaaatagtttctcccattctgtagg

SEQ ID NO: 10138 - DNA, 129 bp, Homo sapiens
tggtgtgtgcctgtagtcccagctactcgggaggctgaggcaggagaatcacttgaacccgggaggcggagattgcagtgagctgagattgtgccactgcactatagcctggcgacagagtgaggctcc

SEQ ID NO: 10139 - DNA, 401 bp, Homo sapiens
aatttgataaaaatatttccatgaaattttttgtgtagtgttctaaaacttgaaattagactacattagttgatagtattattagaatcttccaaatccttactaatttttatatgttcatctattgtttattttgagccgatgattaaaatcttcaactatgagtgaaagtctatttctctgtttagttctgtctgtttttacttcatgcattttgacactctgttatcagttgtataaacattgagaattataatgcattgctaatgagcttaaccttttatcattccatctctgatatttcagcttattttgaatcctactttctctggtattagccagctacatcagttttacttcctttcattttcaaccaattttatgactccatctcaaaaaaa

SEQ ID NO: 10140 - DNA, 248 bp, Homo sapiens
tgaaattatatttcattgtggttttaatttgcatttctctaatgatcagtgatattgagtttttttttttttcacatgcttgttggctacatgtacgtcttcttttgaaaagtgtctgttcatgtactttgcccacattttagtggggttgtttttctcttgtaaatttgtttaaattccttataggtgctggattttagacatttgtcagacgcatagtttgcaaatagtttctcccattctgtagg

SEQ ID NO: 10141 - DNA, 249 bp, Homo sapiens
tgaaattatatttcattgtggttttaatttgcatttctctaatgatcagtgatattgagttttttttttttttcacatgcttgttggctacatgtacgtcttcttttgaaaagtgtctgttcatgtactttgcccacattttagtggggttgtttttctcttgtaaatttgtttaaattccttataggtgctggattttagacatttgtcagacgcatagtttgcaaatagtttctcccattctgtagg

SEQ ID NO: 10142 - DNA, 434 bp, Homo sapiens
aatttgataaaaatattttcatgaaattttttgtgtagtgttctaaaacttgaaattagactacattagttgatagtattattagaatcttccaaatccttactaatttttatttgttcatctattgtttattttgagccgatgattaaaatcttcaactatgagtgaaagtctatttctctgtttagttctgtctgtttttacttcatgcattttgacactctgttatcagttgtataaaaacattgagaattataatgcattgctaatgagcttaaccttttatcattccatctctgatatttcagcttattttgaatcctactttctctggtattagccagctacatcagttttacttcctttcattttcaaccaattttatgactccatctcaaaaaaaaaatgcattcattatacagagcatatagttt

SEQ ID NO: 10143 - DNA, 2802 bp, Homo sapiens
tcagatgtggtggaagtcaggctggccaacaggaccggaggtctggaggtgctgctgaaccaggaggtgctgagcttcaccgagcagagctggatggacctgaaaggtgagcagtccagccacgcgaggctgcgggctgccctcacctcctccccattcctgcagggagactgaggggaagccctgggccttcatgcctctcccagtcctggctagaggcctgggtggtccgacctcaggccttcacacccaccgaggtgcccccgtcgtacccacctggtcaaaagccgagaggccgtgacggtgggacatgtcctccctacggaggatcccgggagccttctggaggggaactcaccctggtaacgttcaccgctggcctgcacagagccactcctgtgctcctgtcactccctcagtcctcaaaagccactgcaaggtctccagccctgcacggttaaggatgcccctggcaagtggtagctccacatctgaaccccttgcctcagggaactgagtcaatgaaaggattcctggttgggatgggtgaggacctgggaggggcctgtcagcactgagggttcagggaccctcgggacgtgcccaggcaggtgtggctgctgcagccaaggccagagggacccacacgtgcatctcaacatgggggattcactgcaggggctgcacctcaggtgccgctgggagttccaccgcaagcatggcaggggtggcggagggtcatggtcagcagaattggccccgggaacgccctcccttcccctgcaggtgccctcacccacagcccctgggtgccgaccaccctgtcctggggctgcgggaggggacaagatgctcacagcgggtgaccctaatgcatcccccttgagcccaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactgtgagtgaccgtggagtatatggggcagacggggtgggggttactggaaacatggcacgggcagggcttggggaccaaagggagccatgcccagccaggccccggtcatgtatcttccagggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccaggtgagggcgggcaggtgggggtgggcggggagctgggacaggaccccccggggtggccagatgtgtgtatgcatggcagctcaggcctgttgtctgcactctgtccccatcccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggtgaggacactctgctcatacacctgcctgcacctgtccccactcaccaccccagagagccccctcactgacactcgctccctcaccaggacgcagctacgcggtgctgttgggcatcatctttgggggcctcgcggtggtggcggcggttgcgctcgtctatgtgctgctgcgccgcaggaagggcaacacgtgagaccccccagcccctctcccaagaccccgagacagccggtgggaccaccgaggctacttctaactgcgtttctgttgcaggcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttccctgg

SEQ ID NO: 10144 - DNA, 4250 bp, Homo sapiens
catgaagccagccctcctgccctgggccctgctgctgctggcgacagccctcggcccgggccccggacccacagcaggtatgcctccctgcccttctgtgtccccgtctgtctgtccatctgtctgcagccaggcctgggctgacatccctctgggctcagcctctgtccatctgtcaggccatctgtggctgtgctaggggtgatgggaagaaattctgagggtccatgtggaggggcagcccatggggatgggaggtctgagccgggcccaccctaaacctgctggtagctaggagggaggcgggggagaccagcagaggcctccgcctgtgtccccagccctgacagggcgggatcacggagggggagccaggattgtgggtcctcatcagggtggggctgaatccaggaaagtctagggaaagccccgaactccagaaccaggacactggtcccaggctgccccccgtcccccaccccatttcccatcgaccctcttgccacttatctcacttgcaagcatctctcggcctcctcccccgacccctgtgcgccaccaaatccttggccagtacatatttattgttgcttttaagtgccaggcactgcacttggtgaagtggggccagcggggtggctcaggcccaggcctggccctcgactggcctcttttgatgggggatggggaagggccagggaagtgcaattccagcctgggtgcatgcacctgccccagtccctccctgcaacccttccttcatgccagcccctggaaatatggccttgcccaccggtcttatggcccataggagaagttttgggcccggcgcccacagccccttgtggtgtgcacccccacttccctttccccactgctgggacccctgcttgaaatgtccctcctctccccagaaaggaggggagcggccctggccttctgccctgagcacggagctctctttggggtctcaattgcagcccctgggagagcgagaagtgtcacgttcagaccctgcaccattccctaccaggcctcaaatgagactcttggcagccatatcccccaccccagtccaggcaagcaagaggggttcttctgcaggcttcagggcccccagaaggcgtgctgaccacagacaccctggggagccaagagaggtcgagggctccagctaccgtggcccactgaggacccctgcctgtgggatagaggacttggtggctgaagggcagtcatgcccaggggcttctcctgaccctgcagggctgagcggatgcagctttttgcctcttctcgctgcattctagcccgtcagtcagggcaacagccagatggtctgtgctaagattcatcccatccccacgggccctgtggctttctactgtgtccacctggtggcctgtgcagttcctggccagcgttctcctggggatgctgctgtctaatgggctgtgggagaaacagagacaggccctgcacatggggcagccagtccagtacccgccgggccaggccctcagcatcctctcctccagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggttgggaggcccaggaggccgggcactggggccccacgcccccatccctgtgcatgctgagggctcagacccactgactggctgagtggagcccctcggacccaggacaggcaggagggcacagggacagctggctggttgggttccccagggaggttgggggcccagaccatcgagaggctcagcctgcaatgacccagcccctcccaccaccaccacgcccacaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctggtgagccctcctccctgcccacagcctgcccccacggggactttccccagcgctaatctatgcacaccgagacttggcctgtccgtgccctgcctctctggctgaaccagtcccttgggaggcctgcccgcctgcgagagttccttcagctcctttccactccctggcatccagaccgcggtcccagcccagagtgagtgggagctgcaggggtccctagagaggtgggccagtgcctatccactgagctccgccatgccagggcaggggagaagccaggtcgaggctagaggcgtgggcagtggagggagggcaggcccctgcctctgcggcctcagcgtccttttctgctgtgcgggccagagagaccatcacccagctgctgccatgcattggccctggaggctcccacagcccttgaagcctcagggcctcctccctgcttccctgggcccaggccctcactcacccctcacctcccctgcccagtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggtgaggccagctgagggctggggtggcatcagagctttgggcccccagagggggagaaagggggtcccagctgtgtgggaggaggaagggagtttccaggtggggttgaggagggaagggaattccaggcagagattgaggattcggatggagggaagtgcaggtcaggggggtcaggcaggtgggagggggcagctcatggggcctggctccaggggaggaggctcatgaggaacccctgcacggctggcatggccctgggcccagcttccagcagggacagggatcctggagtgtggcaggaggtgatggtcacccaagccggggtccctgctagaacagcccctcctaaggggaccgcctggcggtccatccacccatctgtcaggctgctgtaggtggcaaggcctggggccaggcctcgaaggaaccccagggctaaccaggcatcctctccctcaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaagtaagaaggcatggatgtgcaggtgatggctggagggcctcgccgcccgaggcccatcatgcttgcctgggcagcccaggctgggggtggggagagtggggcgaccatggggtggtgtgggctggcccagctccagcatcatcacctccacagggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcgtgagcctcccatcagggcccaggagaggggatgaggggttagcctccccactgaggacagcaccaggggaggcagacagaggtgtcctggagggtggggctggggtctcaggacccctgcagggttggcctcagggaggggatgacagaacccgaggccactgggtgacagccacctgctgctctgcagacggactacggctgtgacatggagcagggcagcgtgtgcacctaccaccccggggccgtgcactgtgtgcgttctgtgcaggccaggtgagcccccaggctggggccggtatggggattggggtcaggggtgggctcccaacagtggcctggccctgactcactggctcctgcagcctccggtacggctcaggtcagcagtgctgctacacagcggacgggacgcagctcctgacagctgactccagcggcggcagcactcccgaccgcggccatgactgggg

SEQ ID NO: 10145 - DNA, 734 bp, Homo sapiens
  misc_feature (648)..(648): n equals a,t,g, or c
  misc_feature (697)..(697): n equals a,t,g, or c
tagtccagttaaatctttggtttcagtagtgtctgaatagtacagtgagacgttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacattnttcctttgagtgctttgggtgcagccgtggaatcctgatgtaaagcatnaggtcttgcatactgagtaacattgaaatggagcatc

SEQ ID NO: 10146 - DNA, 1077 bp, Homo sapiens
ttaaaggtggaagggccaaatttgaaagtgttaatttgtcttaaccccttcccagtaagtgaactccacccttatttttatctccaatatccaccagcaggcatggataattattttaccaatgctaatatttgagttttgcagtatattatagaatatagtccagttaaatctttggtttcagtatgtctgaagagtacagtgagaggttaatttctgctcaagtggtcccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacatttttcctttgagtgctttgggtgcagccgtggaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagatttttcacaaagtaagg

SEQ ID NO: 10147 - DNA, 4925 bp, Homo sapiens
gggcttggctccccgcggcacgggatttagcgttcgcgctccttcccttcccgtggtcgagccgagtgagtcccgagctagggcgcctggtgcggaggtgccggagtggcgctggggcgggcaggggcggtgccgtggttctgagaggccgcaggtcgggccccgcggcctcagtgacccgtagaggacgcgtcgagggcggctgcggggtgctgagcgcccgctttgtgttggccgaggcgcgggcagggcgagggtggcgtgaggcacgagcggaggcagcggggcgtgcaggtctacgggctgtcatccacgctcccgagcaacactgaggcagggaagccagatgggtaaaaagatctcgcagaggaagggagtttgggcaatgtcaggggatgagctgaattgtgctttttttttttcagaagagagaaaagtgcatttcatttagcaggaatgtattgattgaaagggtaaagctgtgagagctgtggtgtgaaggagcttctgttttggggaaggaaaggaataggcaggaggtgatatctcacagatgcgctggaacaagctcaacactcattcatttagtaggcactcggtaaatgctgacttactgattaggacaattgagacttagtattgtttgcggtttgctaatactgtgctgagcattttatacatattctcatttaacgcaatatagtcacttaaggagtagtgtcaatctcattttatggtctgtggaaaaactcaagtcacttacctgagacctctgcatgagtaagtggtggatccaaggttagaactcagtcctattcgagtccagagcccatgcgcctaatagcagcattacatgcctgccacatgcgtttaggagtgaaggcagagtacactaagaggtaccgcttgtgattcacaaagggcataagcagcaggggccagtcaaaggcaagccctgtctgaggactggaagattccctctggccaaggtgtgcctcagctggagactgtgaagacatcaatgagcttatgttcagctgccagtcagaaagtctgtccaacgaaggcttaaatgatgatgagacagggtttgttccagagtttgttgtgaaatgccagggctctagaacgtgtctccaacgttctcttggctttcctttgtggtcactccattccccttatttcctttcagatgcctcttggcaaacttcccttaacatcttggtgacgagaactgggccttgcggtcacctagagcggaaggaaaagggcgcatttcctcctgaactaaactaaggaatttgtttatgtgtagagggctgtggggaggtgacttgttgtgtatgctgaggccaattgggaaggcttttgtgggagtgacacatatcactgctaaaataaaaccagatttgtggttttagatgtcatctgtgtactgacagttttcagtatatacccagccagcccaacctcactcctgaattttcaacttgtatatccaaatgccctaattttccatttataaatctaataggtatcttaaacattactgtatacaagacaacttttacatttaatctttttgcagtcttactcttttgagtatatggaaatttcataatttcagttgctcaggccaaaaatcttggtgtctcgtcctacatgaaattcatctgcaaatcctattgatggtacctttgaaatgtatccataatctggctgctttttgtcacttctgccaccaccagtctggtccaggacattcatctctagctggattgttgctagaaccttctgactggtttcctgtttttgttccttacccccaccccatagtctattcaaagcaccctcaaagcagcagctgtagagaccacatctgaggtcatatgactcttcccagacattccaggcacttcccatccattcagaataaaacccattgccctaaggcttacaaggtacccaccccagagggtacccacctcttttaccctcccctagtctgtttgagcccctctggcttctttgcccgttcttgaacacaggtgtgcttgcatctcagagcctttgcacttgtgccctcctcctgcctgggatgtacctcactgataaccacatggtgcctaccctcactccatccagatctctgatttgttgtcactttatcggaggtgtcttccctggccatcctgtgtaaaatatctcttaccaccagtcgctgccctcgtgctgcgtcattaattttttgtatcctttgtcattacctgacaccacctgggcgttgtgtctgtgtgtcatgcatatgtgttaacttctccatttgctcattcgctgccttagcaccagagcctggtccgctgttctcagctgtttgccgtctgcgcaggacctcataggtgggcctgggaaacgcagtccattgtctctcctggccaagtgcactgccacagtcctggctttcacatggtggcctcaggatgctgtcatcccaggggcctcaggaaggcctctcttgagacatggagaggtatggcagaaaattagggaggggatatggtctcagagaccactggctacttagttcatccacctttcctggggtgttcaggcagctcataattgggtctctgctaccacaaaatgtctaggcttagaagtctcagagcacctatggggagcagaaggttggtcaggctccatcaccctcctctccctacagctctgcccacacctcaggacaagctcagagacctagtgatggctgtcatgcagctccttcttggtgggctccaagtgagtggtcctcatggagtctcttccatgtgacctcagccttttctcagcaggagtctgtctataaggagctggtcccagagggtggacagctccctgtctccaccgatgtcctcagttcctgagttcaagtccctgaaatgtacttctcactgttttactgtccctggaccaggtacagtagaggtcagagttggggcacaccaagatgagccaatatagtgtctgcctcaaagagttcacattagtggggaagacaggtacatgttcccagagggattttaccagtcctgagcctaatatcttctccctccaggtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattaggtaagttccctccctggggctcagctcctgggcttcctgctccttaaccttgaggatcaagcttggggctcagaggctcctcaccccctgggcccaaagaccagacattttgaccatggtaccatgcaggtctggtttgcacagagagggggacaggtggtactgggaccctccttgatttttttttttaataggcaatgtctcactctgttgcccatcctggagtgcagtggtgagaccatagctcactgtaaccttgacgtctttggttgaagagatcctcctacctcagcctcccaagtacctgagactacaggcatgggccaccatgcctgtcttattttacttttttagagacagagcctctgtgttgcccaggttggtctcaaactcctagcctcaaggaatcctcccaccttggcctcccatgcctttccaaccctccctgatttatagaaggagaatattattcattgcacacctagtacctccctatcccctgaattaatctttctgcatcttgatgatcggtggtaggatacacagtttataaacgaacctgaggctaacaaatactgtcacttttcttaagtttacacagcctattggtggcagatctgggatatggatctgttcggtttcagagccctgctttcctttcactggaatgtgctcttcgctttagcccttttttttttttttttttggtttctgctagcctttatttgagaaaatttacacaaaaatccccaatgcaacatttacaagtgaatctgtataaatcccatatgcctctttcccaaactgaaaaatggctttatgacaggggtccatgacaatggtataaaaatacttacttaaactgcatcattctcatttatattatacagaccattttggataatatgctcaaaagtggaggaaagcacataacacccctgtttttaaagattatttgctcttgtatcagtcttttgtcaaaggcaaatacttttacttcttggataaaaccaaggtataatatcaattaacttttaaaccaaaagcacaaaatgtcctagttgatagttttggcatgagtaaagggaagggacatgagagaacatcagctcctacaaagcttaagtttagggtcacacttgggaacaaaagcatcaacaaaacaaaatattctcttctcctatcttcttgacattttgtcacatcagaagaacataactaacagagtagctttcattgctcctgaaaaggggaaaggcaccagtcagaaataggaaagaaaatcttgttaggttaatggtacatgataaaatttcacattaaaaagtttaatgatggaggatgggcgtattggcttacacatgtaatcccagcactttgggaggctgaggtcagtggatcacttgaggtcaggagttcaagaccatcccggccaacacggtgaaactccatctctaccaaaaatacaaaaaccagccaggtgtggtggcatgcacctgcactcccagccactctggaggccgaggcggaagaactacccgaacccaggaggtgaaggttgcagcaagctgagatagcaccattgcacttcagcctgggcatcgcagcaagactctgtcccaaaaaaaaaaaaaaaaaaaaaaaaa

SEQ ID NO: 10148 - DNA, 10920 bp, Homo sapiens
gggcttggctccccgcggcacgggatttagcgttcgcgctccttcccttcccgtggtcgagccgagtgagtcccgagctagggcgcctggtgcggaggtgccggagtggcgctggggcgggcaggggcggtgccgtggttctgagaggccgcaggtcgggccccgcggcctcagtgacccgtagaggacgcgtcgagggcggctgcggggtgctgagcgcccgctttgtgttggccgaggcgcgggcagggcgagggtggcgtgaggcacgagcggaggcagcggggcgtgcaggtctacgggctgtcatccacgctcccgagcaacactgaggcagggaagccagatgggtaaaaagatctcgcagaggaagggagtttgggcaatgtcaggggatgagctgaattgtgctttttttttttcagaagagagaaaagtgcatttcatttagcaggaatgtattgattgaaagggtaaagctgtgagagctgtggtgtgaaggagcttctgttttggggaaggaaaggaataggcaggaggtgatatctcacagatgcgctggaacaagctcaacactcattcatttagtaggcactcggtaaatgctgacttactgattaggacaattgagacttagtattgtttgcggtttgctaatactgtgctgagcattttatacatattctcatttaacgcaatatagtcacttaaggagtagtgtcaatctcattttatggtctgtggaaaaactcaagtcacttacctgagacctctgcatgagtaagtggtggatccaaggttagaactcagtcctattcgagtccagagcccatgcgcctaatagcagcattacatgcctgccacatgcgtttaggagtgaaggcagagtacactaagaggtaccgcttgtgattcacaaagggcataagcagcaggggccagtcaaaggcaagccctgtctgaggactggaagattccctctggccaaggtgtgcctcagctggagactgtgaagacatcaatgagcttatgttcagctgccagtcagaaagtctgtccaacgaaggcttaaatgatgatgagacagggtttgttccaaattttgttgtgaaatgccagggctctaaaacgtgtctccaacgttctcttggctttcctttgtggtcactccattccccttatttcctttcagatgcctcttggcaaacttcccttaacatcttggtgacaagaactgggccttgcggtcacctaaagcggaaggaaaagggcgcatttcctcctgaactaaactaaggaatttgtttatgtgtagagggctgtggggaggtgacttgttgtgtatgctgaggccaattgggaaggcttttgtgggagtgacacatatcactgctaaaataaaaccagatttgtggttttagatgtcatctgtgtactgacagttttcagtatatacccagccagcccaacctcactcctgaattttcaacttgtatatccaaatgccctaattttccatttataaatctaataggtatcttaaacattactgtatacaagacaacttttacatttaatctttttgcagtcttactcttttgagtatatggaaatttcataatttcagttgctcaggccaaaaatcttggtgtctcgtcctacatgaaattcatctgcaaatcctattgatggtacctttgaaatgtatccataatctggctgctttttgtcacttctgccaccaccagtctggtccaggacattcatctctagctggattgttgctagaaccttctgactggtttcctgtttttgttccttacccccaccccatagtctattcaaagcaccctcaaagcagcagctgtagagaccacatctgaggtcatatgactcttcccagacattccaggcacttcccatccattcagaataaaacccattgccctaaggcttacaaggtacccaccccagagggtacccacctcttttaccctcccctagtctgtttgagcccctctggcttctttgcccgttcttgaacacaggtgtgcttgcatctcagagcctttgcacttgtgccctcctcctgcctgggatgtacctcactgataaccacatggtgcctaccctcactccatccagatctctgatttgttgtcactttatcggaggtgtcttccctggccatcctgtgtaaaatatctcttaccaccagtcgctgccctcgtgctgcgtcattaattttttgtatcctttgtcattacctgacaccacctgggcgttgtgtctgtgtgtcatgcatatgtgttaacttctccatttgctcattcgctgccttagcaccagagcctggtccgctgttctcagctgtttgccgtctgcgcaggacctcataggtgggcctgggaaacgcagtccattgtctctcctggccaagtgcactgccacagtcctggctttcacatggtggcctcaggatgctgtcatcccaggggcctcaggaaggcctctcttgagacatggagaggtatggcagaaaattagggaggggatatggtctcagagaccactggctacttagttcatccacctttcctggggtgttcaggcagctcataattgggtctctgctaccacaaaatgtctaggcttagaagtctcagagcacctatggggagcagaaggttggtcaggctccatcaccctcctctccctacagctctgcccacacctcaggacaagctcagagacctagtgatggctgtcatgcagctccttcttggtgggctccaagtgagtggtcctcatggagtctcttccatgtgacctcagccttttctcagcaggagtctgtctataaggagctggtcccagagggtggacagctccctgtctccaccgatgtcctcagttcctgagttcaagtccctgaaatgtacttctcactgttttactgtccctggaccaggtacagtagaggtcagagttggggcacaccaagatgagccaatatagtgtctgcctcaaagagttcacattagtggggaagacaggtacatgttcccagagggattttaccagtcctgagcctaatatcttctccctccaggtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattaggtaagttccctccctggggctcagctcctgggcttcctgctccttaaccttgaggatcaagcttggggctcagaggctcctcaccccctgggcccaaagaccagacattttgaccatggtaccatgcaggtctggtttgcacagagagggggacaggtggtactgggaccctccttgatttttttttttaataggcaatgtctcactctgttgcccatcctggagtgcagtggtgagaccatagctcactgtaaccttgacgtctttggttgaagagatcctcctacctcagcctcccaagtacctgagactacaggcatgggccaccatgcctgtcttattttacttttttagagacagagcctctgtgttgcccaggttggtctcaaactcctagcctcaaggaatcctcccaccttggcctcccatgcctttccaaccctccctgatttatagaaggagaatattattcattgcacacctagtacctccctatcccctgaattaatctttttgcatcttgatgatcggtggtaggatacacagtttataaacgaacctgaggctaacaaatactgtcactttttttaagtttacacagcctattggtggcagatttgggatatggatctgttcggtttcagagccctgctttcctttcaatggaatgtgcttttcgctttagcccttttttttttttttttttggtttctgctagcctttatttgagaaaatttacacaaaaatccccaatgcaacatttacaagtgaatctgtataaatcccatatgcctctttcccaaactgaaaaatggctttatgacaggggtccatgacaatggtataaaaatacttacttaaactgcatcattctcatttatattatacagaccattttggataatatgctcaaaagtggaggaaagcacataacacccctgtttttaaagattatttgctcttgtatcagtcttttgtccaaggcaaatacttttacttcttggataaaaccaaggtataatatcaattaacttttaaaccaaaagcacaaaatgtcctagttgatagttttggcatgagtaaagggaagggacatgagagaacatcagctcctacaaagcttaagtttagggtcacacttgggaacaaaagcatcaacaaaacaaaatattctcttctcctatcttcttgacattttgtcacatcagaagaacataactaacagagtagctttcattgctcctgaaaaggggaaaggcaccagtcagaaataggaaagaaaatcttgttaggttaatggtacatgatagaatttcacattaaaaagtttaatgatggaggatgggcgtagtggcttacacatgtaatcccagcactttgggaggctgaggtcagtggatcacttgaggtcaggagttcaagaccatcccggccaacacggtgaaactccatctctaccaaaaatacaaaaaccagccaggtgtggtggcatgcacctgcactcccagccactctggaggccgaggcggaagaactacccgaacccaggaggtgaaggttgcagcaagctgagatagcaccattgcacttcagcctgggcatcgcagcaagactctgtcccaaaaaaaaaaaaaaaaaaaaaaaaaagtttaagaatggaatccaagtagacttggatgtaccctctgtaacttagtatatgtaatactacatgtagactttctcaacatctgctgcctatggtaaggatctgcagccaggttctcagaagcagtacctaccaattcttaacagcaggtggcaatgttgtacaagttaacgacagaactacttttatgccacatgagaggaagatacaaggagtcaaaagggggaaaaaaacaggtttgggttcatagtagcaggaacatgaacagaatagcctgagattttaacaacataactcattccctcttccacctttgtactttatccaggtcaacacatcagggttctctaacaattccagtattctgcttctttactgtaaaatacatgtaattcttgccactgtgattaaataagccctgtgatagcagggttaaaaagagattacagaaaggataaactctacctactttcttgagagatgtgggaaagatttcaagtgacagcatttttcatagctgtttataaacatggtcatttatatccacattttctcttatttacattagttttggcccttaggcacctcatactcctacagtgattattggctttgctttcattggctttgtatttttaagtatttaccctcttaatggccctcctagatatctattttatacatcatatttcttaattatctagatggaacactgaaggacaggaattaagtaagtgactggccatgcaagaagagttgtaaattttacttatttttccttggtagaagttatgttaaaaattcaagcaaccacgtatctaacagaagagttttatctaggatgtataaaaaaactctgaaaactcaatagtaaaaagaacaaatgacctaaatagaaaatagacaaaagacatgagcagacatttcactgaagaggatgtgtagatggcaaattagcacacgaaaagatactcaacatcattagccattggaaaatgcaaattaaaaccacatgtggtatcattacacacatctatatgaatggttaagataaaaaatagtagtaataccaaacgctggtgaggatgtgaagaaactggatcagtcatacattgctgtatgaattgtatgagtggctgtatgtaaaaggtacagccactctggaaaaaagagtagggtagtttcttacaaagatatacgtgtttaccacacaacccagcaattgcccttttgggcatttatcccagaaaatgaaaatgtgtgttcacataaaaacctgtacatgaatgttcacagcagctttattagtaagggcaaaaaactgaaaacaactcttttgtcctttagtaggtgaatggttaagcaaactgtggtacatccataccatgggatacgactcaacaatcaaaaggaactgcccagacttcaccacgatgcaatatatgcatgtaagaaatctgcacttataccccctaaatatataaaacatttttaaaagaaaaaaaggaagaagatacatgcaacaacttggatggatttcaagggaattatgctgaatgaaaaaaagtcaacctcataagattacattctatatgattccattcatatgacattcttgaaatgacaaaattacaaagatggaagacagaacagtggtagccacaggttggggtgaggggataagaaagggatgtggctgtggctgtaaaagcgcagcacaagggatccatgtgatagaactgttctgtctcttgtgatggtggtcacatgaatctacacatgataatactgcatataattgtctaaaatgacattttcttcaagagttatctacagtttaaagctcacttttatgaagtgtcacatccatcaccattttaagagacataaaatcatgaaaagatatcaccagaagctacgtaaacatttcagctaagggtaaagagaaagttaagagtgttttcacaaggaaattgaaagaaggcaatccgaatgaagtcaacttggtcacacaaaaatcttggtaaaagaactagaatggaagcccaaactgctgagcaagtgggagaagaaaagaaaacttggttcaaacagatcacacaagggaacccaggacaaatgctgactttggcattatctaggtaacccttttttttgtcataggtgactctaataatagacctgttgttgcaaaaccagtcaaaatcctaccaaattaaaaagaagtccctcattgacttgttgggtgtaggtggtaccccatgtcctcgcacaccaaaagagatcatttctggcaagaaagctcctacatgccttgatggtgctgctggtaggatgccttaggccaggcccatcccagcgatgttctgctggctgtggtaaaaggtgggaggagaatatgccttattcattactcaatcaacttcttagccttgaagaagcatcacaggtagaagacctgccaggtggctagtccagtgaggcagaacattgaaaagatgctgaagtgtatgaaccaagtgtttgttgactcactggtatcaccatctcctcttctctcttcttcatgtaggcaaaatcattaacaatagattctgaaaggtcttctaggtgtcgcagcttcacctctaatggtttgagcttctcaacttttgcaatctctctgtaatttttcacctccactccatgcttcatgtctaggatcacaagttggtcaggtatctgccctgtttccttgctctcaaaacacacttcaaacatgtcataatcttcagtggtaaaggcaaatttccccttggttgtattctttttggagtagaaaatatggccagcagaatctgtgatcttgaggtggctgcacaggccaccagtgcccccagactggtcagagatctcgtatgtgccagtcactagtaggtccttgtggatctcctcatggaagcagttgtgagaattaatggacagatggaaggagatggcgaggaccaagctggggcccagcaggaacaaaagcagcaacgccgatggacaagggccatgccgggctggtgggccagacaaaccagacatggtgctggagactcattccccctttagcccttctgctggggatcaacacccactactatgagtcctctaccatgatgtgttcaggccccaacactgtcctatctatgctccccgtcctcctgaaaagctagttttgacctttcctcagcttaggcagaggcctgtgtctttctccacggttagagaccaggtggcagggaaggacacaaccagcacaaagactcagaccacaggtccatcctgccctctacctgggatgacttttcaggtcttgcttcctttctctggagcaggacttcaagcttccaaacctgatgtcatctccaggctggagcggggggacgaaccatagacccctcacatcctgagaactcaggggagctggagctggaggcacaagagagaaggtgagtctgcccccactctctgcttctgtggtaggtgctgcagcttcactcacgaatcccttctctacaagccccagacaaatctcttgttaccctcaggcctttgctttcctcctcctttttctatcttgtcctctttccttgctgttatttgcccctgttatctgcccataagtaggtttgtgttttatttaccctagaaaaatgctatttcagccacaaaaaatagttcaagtgtccttcccaggcagctggctcccagtcccttcacttctatgtcatccactccttaggctgtttgggaaaaatgctaattacatttttcctctgctctgacaccacaacaacaatcaacaaagacttcgtgaccaaatgtatggagggtttttcccatgttccaagcagctctaattcaattcaattctggtgctcttttggagatagcctcagatcccacaggctgagggctcagtctctgagactgtccactcaaggcactagttgtaagttcggggtttccaaacttgagaccaaaaggattcaagttggggttcccatgaccctcactttgggttctattaatttgctggagcatctcacagaactcagggaaacacttagatttacaagtttaggctgggcgcagtggctcatgcctgtaatcccagcaatttgggaggccgaggtgggcagatcacttgaggtcaggagttcgagaccaacgtggccaatatagtgaaaccccgtctctacaaaagatacaaaaattagccaggcatggtggtgtgcatctgtagtctcagttacttgggaggatgaggcatgagaatcacttgaacccaggaggcagaggttgcagtgagctgagatcatgccactgcactccagcctgggtggcagagtgagaccctgtctcagaaaagaaaaagaaagatttaccaatttattataaaggataaagatgaagaaatgtgtaagctgaggtatgggggaaggggtgcagagttttcatgcccttcctgggtgcatcaccctctaggatcctgtccacttagctatccagcagctctctgaaccctgccctcttaggtttgtatagaggctttattatgtaggtatgattgattaaaccattggccattggtgataaacttaacctttagctcctttcccctctcttgagtttggggcattggagctgagaatcccaaccctgtaatcgtgccttggcctttccagtgaccagcttcatcctaaagctgtcagtcaacataagtctatgaaaaggcagcactttggagattacaaggattttaggagttgtatgccaggttatggggatgaagaccaaatatgtatttcacactatcccacagggtttgctggccagctctgttttggctgctgggaaataccaattagagagacgttctcttctaagtctctcattcctgctgttactcactcagagcatcccaggctgattctcggtcttaaggaaacagatgagctagaaagggtttcttcctgtgtagtgggggacctgggcatgtaaacagtaagcagagcagagtcctagggctccgtgctaccacacagctaacattggtcatttgcgcttgatgcaggcctggcactgtgctgtcacaatgaatttatggaattcaccaatatctctgcacaatcagtgtccaggaaactgaggcacagagaggttaaattattggccccagatcacacagccagccagggagagagcaacgttgggtccctggcagattggtctcagccccatactcttatttattttctttaaagaaccagccttattgaggtgtaattaacatataatatgttaataagtatttaaagtatatgattttatatcttttgacatatgtatacacatgtgaaaccattgctacaatctagggcagacatatccatcacccccaaaagttttctcctccttcatcatctttcactccttcccacctttctcactccttcccacttctatactgaagcaattactgatctcctttctgtcactataaattatatatatatgtatatatatatatatatatatatatatatatattttttttttttttttgagacggcgtctcgccctgtcacccaggctggagtgcggtggcacgatctcggctcactgcaagctccgcctcccgggttaaggccattctcctgcctcagtctcctgtgtagctgggactacaggcacccacgaccacgcctggcttttttgtatttttaatagagacggggtttcaccgtgttagccaggatggtctctatctcctgacctcgtgatccgcccgcctcgacctcctgaagtgctgggattgcaggcatgaagcaccgcaccaggccttttatattcttttgaataaatcaaactttatgtaattttatttttcttctccattagctttttagttgtacattcctttttaagtgatgactctaatgattaaatatgtctcttcaact

SEQ ID NO: 10149 - DNA, 10909 bp, Homo sapiens
  misc_feature (4570)..(4570): n equals a,t,g, or c
  misc_feature (4577)..(4577): n equals a,t,g, or c
gggcttggctccccgcggcacgggatttagcgttcgcgctccttcccttcccgtggtcgagccgagtgagtcccgagctagggcgcctggtgcggaggtgccggagtggcgctggggcgggcaggggcggtgccgtggttctgagaggccgcaggtcgggccccgcggcctcagtgacccgtagaggacgcgtcgagggcggctgcggggtgctgagcgcccgctttgtgttggccgaggcgcgggcagggcgagggtggcgtgaggcacgagcggaggcagcggggcgtgcaggtctacgggctgtcatccacgctcccgagcaacactgaggcagggaagccagatgggtaaaaagatctcgcagaggaagggagtttgggcaatgtcaggggatgagctgaattgtgctttttttttttcagaagagagaaaagtgcatttcatttagcaggaatgtattgattgaaagggtaaagctgtgagagctgtggtgtgaaggagcttctgttttggggaaggaaaggaataggcaggaggtgatatctcacagatgcgctggaacaagctcaacactcattcatttagtaggcactcggtaaatgctgacttactgattaggacaattgagacttagtattgtttgcggtttgctaatactgtgctgagcattttatacatattctcatttaacgcaatatagtcacttaaggagtagtgtcaatctcattttatggtctgtggaaaaactcaagtcacttacctgagacctctgcatgagtaagtggtggatccaaggttagaactcagtcctattcgagtccagagcccatgcgcctaatagcagcattacatgcctgccacatgcgtttaggagtgaaggcagagtacactaagaggtaccgcttgtgattcacaaagggcataagcagcaggggccagtcaaaggcaagccctgtctgaggactggaagattccctctggccaaggtgtgcctcagctggagactgtgaagacatcaatgagcttatgttcagctgccagtcagaaagtctgtccaacgaaggcttaaatgatgatgagacagggtttgttccagagtttgttgtgaaatgccagggctctagaacgtgtctccaacgttctcttggctttcctttgtggtcactccattccccttatttcctttcagatgcctcttggcaaacttcccttaacatcttggtgacgagaactgggccttgcggtcacctagagcggaaggaaaagggcgcatttcctcctgaactaaactaaggaatttgtttatgtgtagagggctgtggggaggtgacttgttgtgtatgctgaggccaattgggaaggcttttgtgggagtgacacatatcactgctaaaataaaaccagatttgtggttttagatgtcatctgtgtactgacagttttcagtatatacccagccagcccaacctcactcctgaattttcaacttgtatatccaaatgccctaattttccatttataaatctaataggtatcttaaacattactgtatacaagacaacttttacatttaatctttttgcagtcttactcttttgagtatatggaaatttcataatttcagttgctcaggccaaaaatcttggtgtctcgtcctacatgaaattcatctgcaaatcctattgatggtacctttgaaatgtatccataatctggctgctttttgtcacttctgccaccaccagtctggtccaggacattcatctctagctggattgttgctagaaccttctgactggtttcctgtttttgttccttacccccaccccatagtctattcaaagcaccctcaaagcagcagctgtagagaccacatctgaggtcatatgactcttcccagacattccaggcacttcccatccattcagaataaaacccattgccctaaggcttacaaggtacccaccccagagggtacccacctcttttaccctcccctagtctgtttgagcccctctggcttctttgcccgttcttgaacacaggtgtgcttgcatctcagagcctttgcacttgtgccctcctcctgcctgggatgtacctcactgaataaccacatggtgcctaccctcactccatccagatctctgatttgttgtcactttatcggaggtgtcttccctggccatcctgtgtaaaatatctcttaccaccagtcgctgccctcgtgctgcgtcattaattttttgtatcctttgtcattacctgacaccacctgggcgttgtgtctgtgtgtcatgcatatgtgttaacttctccatttgctcattcgctgccttagcaccagagcctggtccgctgttctcagctgtttgccgtctgcgcaggacctcataggtgggcctgggaaacgcagtccattgtctctcctggccaagtgcactgccacagtcctggctttcacatggtggcctcaggatgctgtcatcccaggggcctcaggaaggcctctcttgagacatggagaggtatggcagaaaattagggaggggatatggtctcagagaccactggctacttagttcatccacctttcctggggtgttcaggcagctcataattgggtctctgctaccacaaaatgtctaggcttagaagtctcagagcacctatggggagcagaaggttggtcaggctccatcaccctcctctccctacagctctgcccacacctcaggacaagctcagagacctagtgatggctgtcatgcagctccttcttggtgggctccaagtgagtggtcctcatggagtctcttccatgtgacctcagccttttctcagcaggagtctgtctataaggagctggtcccagagggtggacagctccctgtctccaccgatgtcctcagttcctgagttcaagtccctgaaatgtacttctcactgttttactgtccctggaccaggtacagtagaggtcagagttggggcacaccaagatgagccaatatagtgtctgcctcaaagagttcacattagtggggaagacaggtacatgttcccagagggattttaccagtcctgagcctaatatcttctccctccaggtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattaggtaagttccctccctggggctcagctcctgggcttcctgctccttaaccttgaggatcaagcttggggctcagaggctcctcaccccctgggcccaaagaccagacattttgaccatggtaccatgcaggtctggtttgcacagagagggggacaggtggtactgggaccctccttgatttttttttttaataggcaatgtctcactctgttgcccatcctggagtgcagtggtgagaccatagctcactgtaaccttgacgtctttggttgaagagatcctcctacctcagcctcccaagtacctgagactacaggcatgggccaccatgcctgtcttattttacttttttagagacagagcctctgtgttgcccaggttggtctcaaactcctagcctcaaggaatcctcccaccttggcctcccatgcctttccaaccctccctgatttatagaaggagaatattattcattgcacacctagtacctccctatcccctgaattaatctttctgcatcttgatgatcggtggtaggatacacagtttataaacgaacctgaggctaacaaatactgtcactttttttaagtttacacagcctattggtggcagatttgggatatggatctgttcggtttcagagccctgctttcctttcactggaatgtgcttttcgctttagcccttttttttttttttttttggtttctgctagcctttatttgagaaaatttacacaaaaatccccaatgcaacatttacaagtgaatctgtataaatcccatatgcctctttcccaaactgaaaaatggctttatgacaggggtccatgacaatggtataaaaatacttacttaaactgcatcattctcatttatattatacagaccattttggataatatgctcaaaagtggaggaaagcacataacacccctgtttttaaagattatttgctcttgtatcagtcttttgtcaaaggcaaatacttttacttcttggataaaaccaaggtataatatcaattaacttttaaaccaaaagcacaaaatgtcctagttgatagttttggcatgagtaaagggaagggacatgagagaacatcagctcctacaaagcttaagtttagggtcacacttgggaacaaaagcatcaacaaaacaaaaaattctcttctcctatcttcgtgacatttggtcacatcagaagaacataactaacagagtagctttcattgctcctgaaaaggggaaaggcaccagtcagaaatacgaaagaaaatcttgtnaggtaantggtacatgatcaatttcacattaaaaagtttaatgatggaggatgggcgtagtggcttacacatgtaatcccagcactttgggaggctgaggtcagtggatcacttgaggtcaggagttcaagaccatcccggccaacacggtgaaactccatctctaccaaaaatacaaaaaccagccaggtgtggtggcatgcacctgcactcccagccactctggaggccgaggcggaagaactacccgaacccaggaggtgaaggttgcagcaagctgagatagcaccattgcacttcagcctgggcatcgcagcaagactctgtcccaaaaaaaaaaaaaaaaaaaaaaaaaagtttaagaatggaatccaagtagacttggatgtaccctctgtaacttagtatatgtaatactacatgtagactttctcaacatctgctgcctatggtaaggatctgcagccaggttctcagaagcagtacctaccaattcttaacagcaggtggcaatgttgtacaagttaacgacagaactacttttatgccacatgagaggaagatacaaggagtcaaaagggggaaaaaaacaggtttgggttcatagtagcaggaacatgaacagaatagcctgagattttaacaacataactcattccctcttccacctttgtactttatccaggtcaacacatcagggttctctaacaattccagtattctgcttctttactgtaaaatacatgtaattcttgccactgtgattaaataagccctgtgatagcagggttaaaaagagattacagaaaggataaactctacctactttcttgagagatgtgggaaagatttcaagtgacagcatttttcatagctgtttataaacatggtcatttatatccacattttctcttatttacattagttttggcccttaggcacctcatactcctacagtgattattggctttgctttcattggctttgtatttttaagtatttaccctcttaatggccctcctagatatctattttatacatcatatttcttaattatctagatggaacactgaaggacaggaattaagtaagtgactggccatgcaagaagagttgtaaattttacttatttttccttggtagaagttatgttaaaaattcaagcaaccacgtatctaacagaagagttttatctaggatgtataaaaaaactctgaaaactcaatagtaaaaagaacaaatgacctaaatagaaaatagacaaaagacatgagcagacatttcactgaagaggatgtgtagatggcaaattagcacacgaaaagatactcaacatcattagccattggaaaatgcaaattaaaaccacatgtggtatcattacacacatctatatgaatggttaagataaaaaatagtagtaataccaaacgctggtgaggatgtgaagaaactggatcagtcatacattgctgtatgaattgtatgagtggctgtatgtaaaaggtacagccactctggaaaaaagagtagggtagtttcttacaaagatatacgtgtttaccacacaacccaacaattgcccttttgggcatttatcccagaaaatgaaaatgtgtgttcacataaaaacctgtacatgaatgttcacagcagctttattagtaagggcaaaaaactgaaaacaactcttttgtcctttagtaggtgaatggttaagcaaactgtggtacatccataccatgggatacgactcaacaatcaaaaggaactgcccagacttcaccacgatgcaatatatgcatgtaagaaatctgcacttataccccctaaatatataaaacatttttaaaagaaaaaaaggaagaagatacatgcaacaacttggatggatttcaagggaattatgctgaatgaaaaaaagtcaacctcataagattacattctatatgattccattcatatgacattcttgaaatgacaaaattacaaagatggaagacagaacagtggtagccacaggttggggtgaggggataagaaagggatgtggctgtggctgtaaaagcgcagcacaagggatccatgtgatagaactgttctgtctcttgtgatggtggtcacatgaatctacacatgataatactgcatataattgtctaaaatgacattttcttcaagagttatctacagtttaaagctcacttttatgaagtgtcacatccatcaccattttaagagacataaaatcatgaaaagatatcaccagaagctacgtaaacatttcagctaagggtaaagagaaagttaagagtgttttcacaaggaaattgaaagaaggcaatccgaatgaagtcaacttggtcacacaaaaatcttggtaaaagaactagaatggaagcccaaactgctgagcaagtgggagaagaaaagaaaacttggttcaaacagatcacacaagggaacccaggacaaatgctgactttggcattatctaggtaacccttttttttgtcataggtgactctaataatagacctgttgttgcaaaaccagtcaaaatcctaccaaattaaaaagaagtccctcattgacttgttgggtgtaggtggtaccccatgtcctcgcacaccaaaagagatcatttctggcaagaaagctcctacatgccttgatggtgctgctggtaggatgccttaggccaggcccatcccagcgatgttctgctggctgtggtaaaaggtgggaggagaatatgccttattcattactcaatcaacttcttagccttgaagaagcatcacaggtagaagacctgccaggtggctagtccagtgaggcagaacattgaaaagatgctgaagtgtaggacccaagtgtttgttgactcactggtatcaccatctcctcttctctcttcttcatgtaggcaaaatcattaacaatagattctgaaaggtcttctaggtgtcgcagcttcacctctaatggtttgagcttctcaacttttgcaatctctctgtaatttttcacctccactccatgcttcatgtctaggatcacaagttggtcaggtatctgccctgtttccttgctctcaaaacacacttcaaacatgtcataatcttcagtggtaaaggcaaatttccccttggttgtattctttttggagtagaaaatatggccagcagaatctgtgatcttgaggtggctgcacaggccaccagtgcccccagactggtcagagatctcgtatgtgccagtcactagtaggtccttgtggatctcctcatggaagcagttgtgagaattaatggacagatggaaggagatggcgaggaccaagctggggcccagcaggaacaaaagcagcaacgccgatggacaagggccatgccgggctggtgggccaaacaaaccagacatggtgctggagactcattccccctttagcccttctgctggggatcaacacccactactatgagtcctctaccatgatgtgttcaggccccaacactgtcctatctatgctccccgtcctcctgaaaagctagttttgacctttcctcagcttaggcagaggcctgtgtctttctccacagttagagaccaggtggcagggaaggacacaaccagcacaaagactcagaccacaggtccatcctgccctctacctgggatgacttttcaggtcttgcttcctttctctggagcaggacttcaagcttccaaacctgatgtcatctccaggctggagcggggggacgaaccatagacccctcacatcctgagaactcaggggagctggagctggaggcacaagagagaaggtgagtctgcccccactctctgcttctgtggtaggtgctgcagcttcactcacgaatcccttctctacaagccccagacaaatctcttgttaccctcaggcctttgctttcctcctcctttttctatcttgtcctctttccttgctgttatttgcccctgttatctgcccataagtaggtttgtgttttatttaccctagaaaaatgctatttcagccacaaaaaatagttcaagtgtccttccctggcagctggctcccagtcccttcacttctatgtcatccactccttaggctgtttgggaaaaatgctaattacatttttcctctgctctgacaccacaacaacaatcaacaaagacttcgtgaccaaatgtatggagggtttttcccatgttccaagcagctctaattcaattcaattctggtgctctcttggagatagcctcagatcccacaggctgagggctcagtctctgagactgtccactcaaggcactagttgtaagttcggggtttccaaacttgagaccaaaaggattcaagttggggttcccatgaccctcactttgggttctattaatttgctggagcatctcacagaactcagggaaacacttagatttacaagtttaggctgggcgcagtggctcatgcctgtaatcccagcaatttgggaggccgaggtgggcagatcacttgaggtcaggagttcgagaccaacgtggccaatatagtgaaaccccgtctctacaaaagatacaaaaattagccaggcatggtggtgtgcatctgtagtctcagttacttgggaggatgaggcatgagaatcacttgaacccaggaggcagaggttgcagtgagctgagatcatgccactgcactccagcctgggtggcagagtgagaccctgtctcagaaaagaaaaagaaagatttaccaatttattataaaggataaagatgaagaaatgtgtaagctgaggtatgggggaaggggtgcagagttttcatgcccttcctgggtgcatcaccctctaggatcctgtccaattagctatccagcagctatttgaaccctgccctcttaggtttgtatagaggctttattatgtaggtatgattgattaaaccattggccattggtgataaacttaacctttagctcctttcccctctcttgagtttggggcattggagctgagaatcccaaccctgtaatcgtgccttggcctttccagtgaccagcttcatcctaaagctgtcagtcaacataagtctatgaaaaggcagcactttggagattacaaggattttaggagttgtatgccaggttatggggatgaagaccaaatatgtatttcacactatcccacagggtttgctggccagctctgttttggctgctgggaaataccaattagagagacgttctcttctaagtctctcattcctgctgttactcactcagagcatcccaggctgattctcggtcttaaggaaacagatgagctagaaagggtttcttcctgtgtagtgggggacctgggcatgtaaacagtaagcagagcagagtcctagggctccgtgctaccacacagctaacattggtcatttgcgcttgatgcaggcctggcactgtgctgtcacaatgaatttatggaattcaccaatatctctgcacaatcagtgtccaggaaactgaggcacagagaggttaaattattggccccagatcacacagccagccagggagagagcaacgttgggtccctggcagattggtctcagccccatactcttatttattttctttaaagaaccagccttattgaggtgtaattaacatataatatgttaataagtatttaaagtatatgattttatatcttttgacatatgtatacacatgtgaaaccattgctacaatctagggcagacatatccatcacccccaaaagttttctcctccttcatcatctttcactccttcccacctttctcactccttcccacttctatactgaagcaattactgatctcctttctgtcactataaattatatatatatgtatatatatatatatatatatatatttttttttttttgagacggcgtctcgccctgtcacccaggctggagtgcagtggcacgatctcggctcactgcaagctccgcctcccgggttaaggccattctcctgcctcagtctcctgtgtagctgggactacaggcacccacgaccacgcctggcttttttgtatttttaatagagacggggtttcaccgtgttagccaggatggtctctatctcctgacctcgtgatccgcccgcctcgacctcctgaagtgctgggattgcaggcatgaagcaccgcaccaggccttttatattcttttgaataaatcaaactttatgtaattttatttttcttctccattagctttttagttgtacattcttttttaagtgatgactctaatgattaaatatgtctcttcaact

SEQ ID NO: 10150 - DNA, 568 bp, Homo sapiens
cagtcaacaggggaagtgagatgttgcaaaggccgctctcagaacggaccccactatccttaaaagaaaaggctagcttgtgccaatgggccagagtggaacaggcatcccatggagtatacctggaagattcctgggtcttctgcatgagttgcccctaatgcccacagtgtttctaaacgagaaggcaggtacgtggtacttggggcggccatctgtgttagctaactgcctttatccaaagttaaaataaacctcatgtctctatgacaagcaggtaattgcaacttggagccagccatctgctaaactcccacagagacaaggagggaagctatcttccttggcctttttatttcaaagaaatcactccaaggtccttaagaaaggtccttaagaaagaaattcctggtttataaaactggcaagaggcttatgcagctttttaaaaaatttacatacatttcaagagggcaaagaaagattttcctattacaaagttttctaaaagaaatggtcttagtaaaaggaaaggagtgtctcttcccttgggcaccatgaaaaatcc

SEQ ID NO: 10151 - DNA, 568 bp, Homo sapiens; identical to SEQ ID NO: 10150

SEQ ID NO: 10152 - DNA, 568 bp, Homo sapiens; identical to SEQ ID NO: 10150

SEQ ID NO: 10153 - DNA, 5235 bp, Homo sapiens
ttgcggccgctgcggcctccttgcccgggcttggggcgccgcgctggggaaagccgggggcccggtgagcccgcgggatgcgtcccctcggttccgccgggcggggctgaggcgaggaggccgggcctggggggagggggggccccggcctagagactcctccgggagcgcccggtccctaccgccgtgggtcccccactctgcccggacccccttttccgcccctggcgccgtgggcccctcactttgcctggactccttttcccgtccctgccgcccggaccccatctcttgcttggacccgctcccccatccttgctgcctggacccctatctccttccctggatccccctcacgtctgccgtgaaccccatctcttgcctggacccccatctgcttccctggattccccacccccaaccgtgaaatcccccatccctgccacctggaccctccgctccacctcctccgtgagccctcgttcttgctccctgagcccccccgcttctgctgtgacccccttctctgttgcctgaatcccccgttcctgcaagccgcaacccttcctccgccatgaaatcttgtccctgctgcctggacccctacttctgctgctgctgtgatcccctctcttgctggaaacgccacccctacctctgctgggaacctcctcttccctgctgcggggacgcccccctccgttgttgctaaattccacccccacccccaaacctccttttcatttctgtcaacagccaagccagtccttcccattgatgctgtgaacggtctgcagctgtccccgttctttcagggacatggcagccaaaagagcagtcgtttttccgctcttatttttgtgtgtgtgctgtggtcaactgttaactccccaaattggggagggttgtgagctttgattgtgtaaaatgcctctcctgccgaggtcggaggcaggtcttccgcacggagatgatttattcaggagccttttaaaactgatctagatagaacctttgggagggactgtgctgtattttatttatgaaaaaatgcaggcgcctccctggataccgagccccgtcgtttctgtttgtcagtctgctttttggcattgagcatctcaatgcaagattgtggaattaaaccatctacttgaggctaagtcgagctaacctttgcccctgagggctgtgtctgcgttaacatcgccagcaaacagttgtataaaccaccgtgcaaatttcgttccaggacacattggcgtgagacctgggagtacgttgtgccaaatcattgccacttgccacatgagtgtaaatgatggcggatgccaagtatgtcctctgccgatgggaaaagcgattatggcctgcgaaggtgacagccattattctgtaacttcaggacttagaaatgactttcgggtgacaagtaaaatcttgatcaggagatacctaggatttgcttcagtgaaataattgagccagaacacggttggcactgattctcgttccccatttaatggggttttggtctagtgcttccaaggttacacttccagaaatgtcttttttttttcacactaaaaaaaaaaaaagaatcagctgtaaaaaggcatgtaaggctgtaactcaaggaaagatctggcaagcagccctgtgatagtaaattatggtcgtgttcagggaatgctttccagcaattcagtagacagtgctcagctgcaatgcaaaagcccaggtccttgtctttgtctgccactggcctctcatgcctcagtttccccatctgtgaaacaatggggattggaccaaatatctgaaatcccatggttataggccttcaggattacctgctgcatttgtgctaaagtttgccactgtttctcactgtcagctgttgtaataacaaggattttcttttgttttaaatgtaggttttggcccgaaccgcgacttcaacaaaaaataagagaagaaaggaatattttctagctgtgcaaatcctctctctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttaggtaagagcgtatttttaagtggccactaggttttcataaaataagaggtcatttgggagaatgtgaaggctcagctttctgggtaaaaattcaccctgttcaccatgtttttcttcatacaagggaacgcgaatcccctgagctgaaggagaaggaaaaatggatccgctttcttaaacctttccagaatttgcccctagaaccactcctattcttgacgcccagaatggtcagtggtgagcatcaaggtcatctcgtacccccgtggcctccagtacacaagacgaggaaggactttgctgccataaggggggaggtcctcctttttcctttcctcttcctatagtaagatttgctgtggtactgtcgctgcctggccagtctggtctcagcccaaggtttgagaagcagttggttgtgtgtttaaaattccagagcagagcccaagggagagaacgggtggcctggcactggggttggtggcacccattgtttgaggcactgtcatggggggcacgaggcaggtcggaagtggagctctcggcttcccatccatccgggtgcgctttctcccaggccttcagtttagcacccacctcctttgcacactgtgggtgagaaaagctttgcctgagtccagccggggactggtcatgcacatacatgacaagtgaggagcactggtgactgcctgccccctagccacagttgtgcaaacccaaacctgccagccttccttctcaaagtggaactgtttatcccatttgcaaataattgtttctcttgtgaaaagatggaccggaattccttccaatgatgtttataaaatcaggtctattttcctgtgtcttccgaaaaacagctcttgtttaaagcaggatccatctctgcataacttaggccgggctgaccatcatcttggatggcgtcgtccttgttggcgcagattgtgttggggggctggttgtttgtgggcgcctttaatattcaaaggggagaatactgttctgattgaggcattatgcccgctgagttgtgatattacatccatcatcttgttcaaataaatagcgccgtatctatatgtcggaatgaataaataaaagtgctgcagcagggaggttgggctggaaaccagaggcccacgatgctctttgctggctttgaaatgcccttgcaaagaagtattgaaaatttaccagcccacaatgagtcttttaaatctccttttccttgctaccaccaacccctgcaccaaccaagaatacgttgccagcagagttctttatttagttggcattggtttttattgaccctgattgaatttgaaattgtaaggctgagagaggatttgcaaaacatttgaatacattttgctcacggtattgttttgtaacttggaggaatttatctttttagccaatcaggttaaggtcaataaatttggtttttaaaaaaatgaagcctcgaatcccggaatgaatagctgtcgttctgtagcctcgtctcctttttgggaaaatgtaggtgagaaatgttagtcctccccttcagtgatttaggtatgaaactagccgtcagaatgagacaagcgagcttctaaagcgatgccgtgaccgcagtgcctgtgcagtgaacgtaaccggcattgtgtatgttcggtccttgcagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcct

SEQ ID NO: 10154 - DNA, 6215 bp, Homo sapiens
agtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaaggtaaaagtttctcgtggaggaggagagcgcagagggtggagtcctgctcctccgcagccagactgggagccaggcacgtgggtgtttttgaccagattttaatgagatcgttgccaaaatagacttagagcagagacttcctcattcctttttgtctgtctccccactgggctataattgcttcaacttctaaatatttgtcttcttatttttgtttagaagggaagggagttgagtgagtggggagcccgtagaggggcggcgggccacgattgtctgcggcgcggctgggagcattgtggctgtgctgaggccgcagctgcggctgcaccccgaggattaactcttttaacggaagcagtaacgcattcctattaaattgggcagcaatctcaaaagtgattcactcactcaaaagactgactttttaaagaattcctgtgcagatatatttttgtgtggttgcaggcaagcactgtgacttttttccttttaacactgtagcatcctttattttttaaatgctagttcagaaatcttaattaccacatgatcaaatgtctggaaatctacttgctacaaacttaccgcgcagatatttcagtctgtactctgaacttctttcctgaggtcatcatctccttagcacgttggaagcggcagggaactgaggttgccacgctctgaagacaaagtgaccgcacccctaccctgttccatagtcagctcccgtcccggccccctccctgcgtatccgcacctctgtcctgttccatagtcagctcccgtcctggccccctccctgcgtatccgcacccctaccctgttctatagtcagctcctgtcctggccccctccctgcatatccactgattgcttcagatgtgaagggacagccaggccgggacaaaagggattcccacccagggtgcgcgcagcttctgtggccgaggtggctgctgcttacggcccgccttcccttcaccgcaggcctctctccctccctccttccctccttccctccttccctcttgcgtttttctttaaaatgtagtttattagaagcgcactctgtttgaatttggcagtgtggagttgtgtatagcatggaaccttttctttatgcatcgatggtcatgtgtcatgaaatgttttcttgggatgagtcatcaagacaatgcaatgaccatgaaagtctaatatcacattattggcagagtgccagtcttccgaagagtccatggggtctaattccatgcgttctatcctggaggaagacgaggaagacgaggagccaccaagagtccttttataccacggtaagaaatgatcagggggcgccggcagtcctaacggtgcgctcagaggcagcggcggcggggctccgagaccgggccccacattctccatgaaaggtctcctgcgagttcatttctctcccactgaaccgagacctggaagggaccttcagaagtgtcacgttttcagtcctctatcttaagaataacctacacaaagggacgagagactcctgggaagagacggcccagccctccctgttagagcattactcctgtcacttacctcaagcccttgtcctcctgtcccctcgcggggagtgagggatggcccagtgagccgaggggctgcgtcgccattgctcgggtgtggccacgtactgtctcgcggcttccgttggtgatggcgtttggggggctgtccagggaggcagggccttcagcccaagagtgaactgctcccgcgcccctcctgtaagtagctgcttgcactagaggaaaacctgcctttaggtgcccctgagcatctacgtggaagggactagaaatgagagacccaaagatctgagccagccgcgaacagaaagtcggcttcgcaaaccaagtcacaagaaccagccccacttgagactcgcccgtgaaccattcctcttaaccaagtcttgtttttcttttctttaaccttctagtttcagaataattatagattcacaggatgttgcaaaaatagtaaagggaggtgagggggcttctcacccgggcttccccactggcagcatccgtaaggcgcaggatgtccccggccaggaagctggtgcgtgtgcagcctcgggagcgccattccacgcacacttgcgtgccggtggccttgttatgtcgttctttttttgtctacactgtttgagtgcttttccatcattgaaagggcttcattacagtctcacattttcccttttttttgcctaatgctaatggtcagactttttaacagttttccacatgctcttctgatccttttcctctggggtgagcagtcaccactcaccaaaccctgccccacccattgggcacctgtctggatggtcccaggaccgcaggtgctgtggggcacccattggggacttccaggaaatcatttctgcaggatccgttcgcacacacgaagagcacagtgccctcgggaagggccctttccgaccacgctgccccactggggttgggtcaccgggacatacagaggctggtgctgcctggcttctcctgcctgcggtgggagctgggttttgctcccgtttggttttgttttctacctgtcaggctgggcgtctttctgagggttccctgaccggcctctgaattgattgtttgtccacgtgggcctggaagtttctcttaaagactaaatgcccctcactggggaaacgacgctgtgccatgttcacagcagacactcaccccagtgggcctccctttttctctggtcacgttggttacttcataggcctttaggttttgatctgtgtttatggaccacggcacttccttccttccacagtgcggtcagacacaggctttgtgtgtctaacgacagactgtttccagtagtttttctaatactttagttttaaaattttaaataattcacttgttttttggcattgaaaatatttcattcataaatagtttctagttatgatttaaataattttcccatttttgactgtagtttcccagaatcctctttagaatctcagtccttgtgtttgggtcttctccgcgtgccattacctcacctctgttttgtgccacacactctttaaaagtgtcttcccgcggggtttagagttaggaaagtcgcgcacacataggacagagccccagccgcccctcgtggcacccctcccatcccaagggtgcgtttgtcgcagctgggaacccagtgcagcaccccactcagctgctggtttcactgtctcatcattggtggttagactcaagtagtgtggggtatgtgaatctgcctttcagattctcctgatcttttaagcgaatgacacaaagtcaggttttaacaatatcgtgctaactgtgttttctcaggctgttacacctggtgcttgatatggatttgacttgtctattcttttttttttgtttttcttttttctttaattctagaaccacgttcgtttgaagtaggaatgctagtctggcataaacataaaaaataccccttctggccagcagtggtaagaacagcttcctccgtcttctcagatgtagttacttaaatttcatgaatttttattccatccatctttagttcttgataatttgatcaggataaatgttttcattgttttgtttttcctgggaaaagttggtgggtttttagaaaagacttcaggagatgcctgtacctaaattaaggcacaatggtgttaagttgataggccacattttcaccaagcaggcttagaaagacctactcgaaaaaaatatttgcggccgggtgcagtggttcatgcctgtaatcccagcactttgggaggccgaagtgggtggatcacctgaggtcgggagttcgagaccagcctggccaacatggtgaaaccctgactctactaaaaatacaaaaaattagccgggcgtggtggcgtgcgcctgtaatcccagctactcgggaggctgaggcaggagaatggcgtgaacccgagaggtagaggttgcagtgagccaagactgtgccattgtactccagcctgggtgacagagtgagactccgtctccgggggaaagaaaaaggaaaaaaaagaattgtgatttgctcattttaaatattgtgcatttcaccccatgagagctcattaatttggattttgtggtggggttggttgcatgtgtacaaacaggaattcgaaatcctgtccaagttcccggtgtgggtgatgagttcaagccggggcagattctctgcttctgtctctgcaggcctggaagttgcaggtcattggtttgggtgctgtcctggccttcgcctctccttcatatcttacccctttttccctttatcctcctaagacacaaacgccaaaaggcgttggccctgcagtaatccagagacgcctttgttgctctaatgactgacctcactcgagtcacccaggctccttgcatgtgactgattgtggttccgggaaaccggggattgaatctgtgtggtgttcgctggggaggttcaacacgtttatggcctagctgggctccttgtgtcgcctactggccggcggagatggaggccgggcttctggaccctccgccctcccttggcactggtttcctctcccgcaccttggtagtctttcccttgttttcatcagtttctggggtccctgctgggttaacaggtcactgatgtgacaggttcctggggcataagagcaggcagcctccctgagagcgcagggcggaagggccatcggaggcgctggtcgccactgctcctcactgccttctcacggtggccccgggaggccaggactggggaggctgtggggaggtggcagcgccctgtagtccctgcccctccccgtgtggcctgggcttgttcccgagcctttctgcacttcctccactcacccagagcattaggaggacaaacctgccctgctgagccgctggagaatctcaggacgcttatttaaagaggcagctggcagcggtagctgtggttctttttattcaaaaacccaaacaaaactggctgattccgctcagatgggaaaacgttcaagtgatgcgtgtggcagagcatggggccgtttctcagcgcctccttgcgggagacttcgctggggtcacccccagagctggggtcagcgcctgttagatgtatcatgtgatgtcacaaaaaaatatttaaaatccacgatctcttttgttttgacgttttattttcttggatttgtgaacaggtcaaaagcgtcaggcagagagataagaaagcaagtgtgctatacatcgaaggacacatgaacccgaaaatgaaagggtaacccgctgttcttggtttctgtgaatgggcctgaggggccaggccggccgctctcagagtcagagcgggcgtggggatggagggacagaggggaggccccggcaggagtccaggcccgggcagggctagtgaggtctcactggaggtgtgcccttcttgtggcctctcactccctgggatgggtgagtcagacagaggctgggtgtgaagggtctggtcaaacaccccagttttcacaacttgatttgctggctttgaaaggcagcccaaccagacactcactggggccctgtttcccacaaaccagcaaaatgtccacgcaggtgtgcagacagcatccctgcgtccacctgag

SEQ ID NO: 10155 - DNA, 2115 bp, Homo sapiens
tttttcaagcaaggctttccattccattcatttatttattcatcccggagtgctgggattaaaggcaagagccaccactcctggcgcaaggattccgtgtatatatatagaaatacatgtgtacagtgaaaggaaataaaaatggacaagaaggaagtcgagacccctgcagccgttattttttgggcaatagggaattcggtggttcttttggcctttggttttctgggttttctgagctagatttaaccatgctgaaaggctcttgatacacgaagttgccaggcctcaggattctcagagttaaaaccagcattgaatgggaatgtttgaaaacctcactgcagagccaagcctcccatgtgcaatttgcattttccctgtggaagcctgcggttccctgtaggaagccgcctcccttctccttgaagtctcctaggtctcagtttctgcatccacccaatggggatgacagtgaggcggtcagaagtcgcagctggggccaagcggggaggcagccagtggcgcgggctctgcaaggaaatcagtcgcgggccggcgcgaacacggagccctttcagacgctcgggcagcactagatggtcgggcggtcggttatctcagttggtgagcgcgtggtgctgataccgccatggtcgcgggcttgatccccgcaccggccctagtcccagttttttgttggtttgtttctttgttttctccccatgaactgtttctgcaactctttttcaaaatgcgcctttcaggttctgtaagccccatgcgggcaggagcgacttgcgggatctcttggactcggcccagaggttgtcgaggacagcctggcagggaggagcgggagaaacccggccagcgctggggcggtggctcctccccggagtccccgcggctggggcaaagcggaaggcagccagaggcgcgcgggcttggcgaggaatcgctcgtggacgggcgcgaacgtggagcccttttatacgctccaggggcactgtgccgtcgggcggccggttagctcagttggtaagagcgtggtgctgataacaccaaggtcgcgggctcgactcccgcaccggccacggcgttagcttttttttttttttttccccgccgccaccccgccatgaactctttctacaacagtttgtgaaaaatgcgcctttcgggtactgtgagcggcgtgcgggtaggagcgaactgcaggatctcttggtctccccgcccagaggttgtcgagggcagcctgctggggagagcgggaggtaccaggcatgcgctggggcggtggctccgcacccgagtccctgcaccctccgccacctgcaggccactcaggatatccaaagcgatccacatctccggccctcagcccccacccctgccgcccccgcgcttcctgaggctgtggctcccctggaggaatcgcccagtgaagacgggtgctcccagatgtcaccgcctcgtgttcccttggccgccttgcggggaagtcttagggttgaaaatccaggtctgcaatgaatgcattccacagatggtgtgtagggctactgcatgcccagcaccgttctaggcggggagcaaaacggtaagtgagacacaaatcccaagccacgtggagaaagtgaccagccagtagatgcctgccatgtttttagagaggcgttctggttgtggaagcctctggaaaccttctcttgctcttcccccccaccccccgtttcttttcagagacatcttaggcttcacatttcttcctcttggttctgcattttgcagccagagcaagtggatgagtttctcgctggtggttcaagtttctggggtggtcaggtgtgctccgttgaacgaagccagttgtgtagggtcagtgccattttctgtcacgatccagcaggggctccacctgcttttgaaaactctccagtggaaacatctactaactctgacctaaatcagtagctgctcaaaatctacagactactggcttaaaaccttggtaagtgcccagggtgtagtgaaagttctcaataaacgccggctggtggcgctgctgctactataagcaacgttaggagagcctgggtcggctgacac

SEQ ID NO: 10156 - DNA, 2708 bp, Homo sapiens
tttttcaagcaaggctttccattccattcatttatttattcatcccggagtgctgggattaaaggcaagagccaccactcctggcgcaaggattccgtgtatatatatagaaatacatgtgtacagtgaaaggaaataaaaatggacaagaaggaagtcgagacccctgcagccgttattttttgggcaatagggaattcggtggttcttttggcctttggttttctgggttttctgagctagatttaaccatgctgaaaggctcttgatacacgaagttgccaggcctcaggattctcagagttaaaaccagcattgaatgggaatgtttgaaaacctcactgcagagccaagcctcccatgtgcaatttgcattttccctgtggaagcctgcggttccctgtaggaagccgtctcccttctccttgaagtctcctaggtctcagtttctgcatccacccaatggggatgacagtgaggcggtcagaagtcgcagctggggccaagcggggaggcagccagtggcgcgggctctgcaagaaaatcagtcgcgggccggcgcgaacacggagccctttcagacgctcgggcagcactagatggtcgggcggtcggttatctcagttggtgagcgcgtggtgctgataccgccatggtcgcaggcttgatccccgcaccggccctagtcccagttttttgttggtttgtttctttgttttctccccatgaactgtttctgcaactctttttcaaaatgcgcctttcaggttctgtaagccccatgcgggcaggagcgacttgcgggatctcttggactcggcccagaggttgtcgaggacagcctggcagggaggagcgggagaaacccggccagcgctggggcggtggctcctccccggagtccccgcggctggggcaaagcggaaggcagccagaggcgcgcgggcttggcgaggaatcgctcgtggacgggcgcgaacgtggagcccttttatacgctccaggggcactgtgccgtcaggcggccggttagctcagttggtaagagcgtggtgctgataacaccaaggtcgcgggctcgactcccgcaccggccacggcgttagctttttttttttttttcccgccgccaccccgccatgaactctttctacaacagtttgtgaaaaatgcgcctttcgggtactgtgagcggcgtgcgggtaggagcgaactgcaggatctcttggtctccccgcccagaggttgtcgagggcagcctgctggggagagcgggaggtaccaggcatgcgctggggcggtggctccgcacccgagtccctgcaccctccgccacctgcaggccactcaggatatccaaagcgatccacatctccggccctcagcccccacccctgccgcccccgcgcttcctgaggctgtggctcccctggaggaatcacccagtgaagacgggtgctcccagatgtcaccgcctcgtgttcccttggccgccttgcggggaagtcttagggttgaaaatccaggtctgcaatgaatgcattccacagatggtgtgtagggctactgcatgcccagcaccgttctaggcggggagcaaagcggtaagtgagacacaaatcccaagccacgtggagaaagtgaccagccagtagatgcctgccatgtttttagagaggcgttctggttgtggaagcctctggaaaccttctcttgctcttcccccccaccccccgtttcttttcagagacatcttaggcttcacatttcttcctcttggttctgcattttgcagccagagcaagtggatgagtttctcgctggtggttcaagtttctggggtggtcaggtgtgctccgttgaacgaagccagttgtgtagggtcagtgccattttctgtcacgatccagcaggggctccacctgcttttgaaaactctccagtggaaacatctactaactctgacctaaatcagtagctgctcaaaatctacagactactggcttaaaaccttggtaagtgcccagggtgtagtgaaagttctcaataaacgccggctggtggcgctgctgctactataagcaacgttaggagagcctgggtcggctgacacctgcaatagaaacctgtacgcaacaagttggatgtcacatcttgcagtagtcgtgccgggttagatgcagggacagagcacggaggagtcggtggaggctgctgccctcaagtttcctgaacttgaaggggtttagaatgtgccacggtggcgtgaaaattattttgagcagaaggcatttgaattcctgaaatttcttgtctgctgaaaagcagagcttcccaaaagatctcaaaagaactcagttgtcataaatcccttcttgggaaggaactaggaaagattgacttgggccaggcgcagtggttcacgcctgtaattccagcactttgggaggcctaggcaagtggatcatctgagcccaggagttggagaccagcccgggcaacatggtgagatcctctctctattaaaaaaaaaaaaaaaaaaaagaaacgaaaattagctgggcatggtagcgcatgcctgtagtccgagctactccagaggctgaggtggaaggatcacctgagcccgggaagtcgaggttgtagcgagctgagatggcgccactgcactccagcctgggcaacagagtgagaccctgtctaaaaac

SEQ ID NO: 10157 - DNA, 335 bp, Homo sapiens
cgctgtgacattgttgggtatcttttcagcaataccccactcccggtaccaatttactatattagtctgtttttatgccactgatacagacatacccaagactgggaagaaaaggagctttaatttgactgacagttccacaggctgaggaagtctcgtaattatggcggagggcgaaaggcacttcttccatggtggcagcaagagaaaatgaggaggaagcaaaagcagaaaccctgataaacccattagatctcatgagacttattcactatcaccagaatagcacaggaaagaccggccaccatgattcaggtacttcccctgggtccctc

SEQ ID NO: 10158 - DNA, 335 bp, Homo sapiens; identical to SEQ ID NO: 10157

SEQ ID NO: 10159 - DNA, 7255 bp, Homo sapiens
aaaaaaattactcattccagcgctggggcagagaaaatacaagatgagcttagaacatcttgtgccagaaagtaaaaaagtgctgacagagtaatggagacaaatcaaaaacacaacaagtcagcttggaatgtctaccactggcctaatcttggggaattggagcatcagaatcatgagctttccttctcccttatttattggttttatttctccatgtagaccaaagaagagaataagaaaataatcatctggcaaccatcatagtaataattgttcaaacacaagtcatccatgaaatgctaaatctagtgggttctgaggagtaaccagatatttacagagcctcaaagtatctccatacaaaatatggttgaactacaaaaacaaaatagtagcattagcatggacaaacctggcaggtactccttaagtctcctaagtaataaaaactgtaaactgcaaataagccttcgatgacctttactaacctttactaaagtatcaatgatgacttggttgtttaaacagctgatatttgggcaatttgagtatgtcaaactaaataatacttgttttcatttgcaagatccacttaaaacttaaggaggctaaaaaacatcatttaaaataccctataaattatcatcgtacatatgatacaaaaatatcctacttcagtaaatattgtaatgttatatattttatgagaaacaattaaaatgtgtaaatagcccagtaataaagttttataatcttttaaatcatacaatttttccttaaaactttatggctaaatattctcttcattagatgtggcttaccagtggattctagagaagaaaatagatgggagcaagtgtccaacacagcaacagctagaaagaaaaataaagaattatgtcctttacctaaagcacttcagttaactaaatgtgagtttaaaaactaaagagttgtgaactttatcagagtttataagtatgagaaatatgtatgtacatttacaatacaaaattactatttaataatttacacatggcattaattctaattgtgtttaaatatcagagctttttcattcttcattcatgtaatcaacagccatgtgccaaggtactagaaccagcactgtaattacaagaggaagatggtgtggtccacctctcaacagtcatatgctataacctaaaaaaacagacaggcaggtaatgtccatatagagtcatagataccatgacaggtatacagcagggcactactggaacacacagaagggacacctacccacttttatgtcaacatcatgggctttctgatggaggagatatcataggttgatacctgaaggacaaggaaaagcttgccagatagagggaagaggcaaaggcaaagagcctgagatgaggaagagccctgcagagttccactccatcaagtttgggctacagcaaagggtagagtgaagtaagtggtgagagacaaggctgagtaacttgacaagaattacattgacatgggtgtttttatttcatggtgaaaaatctggaatgtttcctgagaacaagtgtaagccaatgacacagtaaatgacaggagatttaaaatgtcacctgtcaagtgactgcttatgaagggttattgctcaactaagcatttctgaatgagtctaaggtctgttggccttcaatttctaccaaaaccctgagaacttgatgatgcctgtgttttctgagaatcgtttcagtgtgctggctgacagttccatgaggatggcaaaacttaagaaagtgtagagccagtgaaaaagagatgcacagacttcttgggaattttttaagctacagaacatgatgaatttatggtgcataagtacagtcttctctgtgaaagtttttgttttcacatctttcattagatgtgtgtaagaaaaaaaatacttgacgtagtatctactaacccaagaatgaaaaggaatgccatttgctatttacactttatttctaaaataaacctaaatttaattaataaattttggcaacatacttctctttgtttctctaattatttgttccacacagtccagctccatctaaaataagtaaaaataataataatgtttaagttaaacaagaaacattatcatgaaaataatgtatcatttacaaaatgtggcctttagtatttttagtgactagacataacttgaagtttgcttaaatagaaaaataatcacataaataaagtaaaatttctacttattttaagtttagataacagaggatgtatatgtgtaatgctgtttagagtaatcggacaaaaatacagttaatattgatctattgcatatacatgattttagaaaggtagtgttttattagtacaaaggttaaacaatggccaggcatggtggctcatacctgtaatcccagcacttggggaggccaaagcaggcagatcacaaggtcaggagatcgtgaccatcctggcctacatggggaaaccccatctctactaaaaatacaaaaattagctgggcgtggtgatgcgaacctgtagtcccagctacttgggaggctaaggcaggagaattgcttgaagccaggaaatggaggttgcagtgagccaagactgcaccactgcactccagcctggtgacggtgagaccttgtctcaaaaaaaaaaaaaaaaagattaagtaattaaagccatcttttgcaatgaatgcattgctttgaaattcttagaaaactctgccctttataaaagtttaatccattttttacttcaataaattttatcttaaaaagaaatttctattctctacttatagtaaacttttctttcttttttttttttttttttagtttatattctaaattaaggtggtacctctgtaggattcttccaaaggcatattgagggatgccgaggtttgcagtacagttgagcccatcacacaggtagtgagcgtaggacccagtaagtagtttttcaaccctggcccactctgtccctccctgctcttatttcctagtgtctattattcccatgtttatgacaatgtgcacccaatgtgtagcttccacatgagtgaaaacatgagatacttggtttctgtttctgcattggtttgcttaggagagtggattccagctgtatccatgttgctgcaaatgatgtcactttgttctttttatggctgcttagtattccatggtatatatggaattttccaatctaccttggattttcaatctaccttggatgcacctggattgactccatgtctttgctattgtgaatagtgctgcaatgaacatacatgtgcatgcatctttttgttacaatgatttattgtcctttcagtataaccctagtatagtaatggggttgctgcatccaatggtcattcttagttcttaatttccaaactgctgtccatagtagcagaattaatttgcattgccacaaacggtgtgtgttcccttttctccacagcctccccaacatcttttatttatttatttatttattttactttttaacaaaagtcattctgactggtgtgaaatggtatctcactgatgttttgtttggcatttttctgattagcaatggtaagcatttgttaatgtttgttggccacttacatgtgttattttgagaagagtctgttcatgtcctttgcccatttttaatggtgttatttattttttgcttgttgatttgtttaggtctcttatagattctggataataggataatatgcatttgctatacccatagtttgtgaatattttcttccattctttaggctgtctgtttaatcccgtgatagtttctcgtgctgtgcagctctttagctaaattagatcacacttgtcaatttttgttattcttgcaattgcttttgaggacttagccataaattgacaaatatgatgtctagaagagtatttcctaggttttcttccaggatttttatagccagaagatgtactcttatgtaagaaaagcacaagcctttttttttttttttttttttttgagacggagtctccatcacccaggctatagtgcagtggtatgatcttggcttactgcaacctctgtctcctgggttcaagtgattctcctgcctcagcctcctgagtatctgagattacacatgcctgccaacatgccttgctaatttttgtatttttactagagacaggtttcatcatgttgaccaggctgatctcaaactcctgacctcaggtgattcacctgccttggcctccccaaattttgggattacaagtgtgagccaccacgcctggccaagcacaaagcttttaacataaaaatggaaatgaacattttagtgtttggtttaattcataaaatgcaattattttggattctcctaaataataaacatccatatgtggtaaagtgtttggatgccaatcattcagttgtgattatgggtgggaagagttgagatggtgcaaataaacttttttctaattttttattttcaagacggagtctttccctgttacccaggctggagtgcagtggtgcaatctcagctcctgcaacctctgtctcccaggttcaagcaattctctgcctcagccttcctagtagctgggattacaggtgcccgccaccacacctggcttttttttttttttttttttgtacttttagtagagacggggtttcaccatcttggccaggctggtcttgaacttctgacctcgtgacattcctgcctcggcctcccaaagtgctgggattacaggcatgagccaccgcacctgcctggtgcaaagaaactttaaaagtgacaagggccgggtgcggtggctcatcctgtaatcccagcactttgagaggctgaggcaggcagatcacaaggtcaggagttcaagaagagcctggccaatatggtgaaaccctgtctctactaaaaatacaaaccttagctgggtgtaatggtgggtgcttgtagtctcagctacttgggaggctgaggcaggagaatcacttgaacccgggaggtggaggttgcagtgagtggagatggcaccacaacactccagcctgggtgacagagtgagacactgcctcaaaaaaaagaaagaaaaatgtggtatgaaccacagccaaactacaatcaattagagagtaagccaaagtatctcaaagtatatcatcagttataaggcaataacatgcaatttctaaaacctaacttaaatgcagcttttaaagacattttaaacatgtcagtttagtcacatttattgaataaagttagcaaatggatatctctcaaaaatgagagctccagggaattaaaaaatgtaaagttcccatttcctttctgtgttaacacagctaattatgatctttacttaacatgcataagtcaacagaacaactcagtatttcaccaaattaaaaacaagaattacgctagagaaatgaaaccctaaagagaaacggtcatataacgaacctcagtcaagtagttctggcagttatttgaggtctgagggtttgaagtaggaattcttacgggcatttggggaatatattttctgttgagtcctatactagtaagattttcaacacaaggtgactctgggcctcgccttgtaggaagagtgctgagaaaatatttcacccgctctttctccataaggagcttggtgctgatcattgctattttcttattagatctataaagatagcaaagacaaatgcttagtatttcatttttccttaaatgattcttaatgacttgtagtttttaaaaacttgccctgagagtaaaccaaattacccactaaacagtgttttcacactgaagatgtgtgagagcatacctattgtaaggaattatacttttaaaatcactctaaagaagcacctgtgtttctaaggtgatttatactgaagaagcagctcaaacaaagtagacagggaagagaaatggctaccagtgatgtatggctcaacgggtaaaacttgctgccttctaaaatggctctacctgtaagattctgaagattccacttgaaatacttgtatttaaagggtaacaacatgggaaaaggaatatgttgatttgcttgattataagaaccacttcactagaaataattatatcaaaacatcatgttgtgctccttaatgtaggttaagaaaactaaaatgaacaaaaaaaatctaggaatacttgtgtttagtaaaccagtttcaggtttcacccttgtacatttcaccaattatctaggaccaattaaacatttggtaatgaggaataattcagagcaacaactcctaggggagaactagattgtttggttgttgatcaaaaagaactaaagcatctctgaaggcaattagcccccagcactgtgaccaaggcactggaggtggggcttgttctttttgccttccacacaccccttcagactgaacaaggtgttattttttaaccgctttgtgaattacacttctttaaattcctgtgataattattccctatttcataaggatgcctttctataacatcttgaatatgttacacaggtagtctttcttgaggcaccctctagtcataatactaaagatcacaattaaaaacgattgtgcccagagtagcagtaccacttgacactttgggtttaggtcgtgatctactgaaaaataaactcattaatattactatttagggaaattctgacaagtaatttaaaacaagatcactttattaattataaagcttcaaaaatacttagtaaaaaaacttacagattaactacaagagacttttcaggagaaaaaagccatacaaaagcaaaaaaaaaaaaaaaatgagaggagagacagaaactatccttgaataacattttaaaggtaagattacttactaacattattttccaaaattacattgtcaaattagcattgacttcctactaatatcctgaagccatctcactaaaaattatgctttcaaaacaaattattgagctgaattcattttctataagtgtatgtttggacttacttcgttaatttttttgacatggaattgttagctttcaatgctactgcaaaggcttccttgtattcttctaatttggttgtaacctcttcataagtagttttcattttggagaatttacattccacatctttaagtgtgagttccttcttatttagtgaagccgtattacccttgtttaac

SEQ ID NO: 10160 - DNA, 7255 bp, Homo sapiens
aaaaaaattactcattccagcgctggggcagagaaaatacaagatgagcttagaacatcttgtgccagaaagtaaaaaagtgctgacagagtaatggagacaaatcaaaaacacaacaagtcagcttggaatgtctaccactggcctaatcttggggaattggagcatcagaatcatgagctttccttctcccttatttattggttttatttctccatgtagaacaaagaagagaataagaaaataatcatctggcaaccatcatagtaataattgttcaaacacaagtcatccatgaaatgctaaatctagtgggttctgaggagtaaccagatatttacagagcctcaaagtatctccatacaaaatatggttgaactacaaaaacaaaatagtagcattagcatggacaaacctggcaggtactccttaagtctcctaagtaataaaaactgtaaactgcaaataagccttcgatgacctttactaacctttactaaagtatcaatgatgacttggttgtttaaacagctgatatttgggcaatttgagtatgtcaaactaaataatacttgttttcatttgcaagatccacttaaaacttaaggaggctaaaaaacatcatttaaaataccctataaattatcatcgtacatatgatacaaaaatatcctacttcagtaaatattgtaatgttatatattttataagaaacaattaaaatgtgtaaatagcccagtaataaagttttataatcttttaaatcatacaatttttccttaaaactttatggctaaatattctcttcattagatgtggcttaccagtggattctagagaagaaaatagatgggagcaagtgtccaacacagcaacagctagaaagaaaaataaagaattatgtcctttacctaaagcacttcagttaactaaatgtgagtttaaaaactaaagagttgtgaactttatcagagtttataagtatgagaaatatgtatgtacatttacaatacaaaattactatttaataatttacacatggcattaattctaattgtgtttaaatatcagagctttttcattcttcattcatgtaatcaacagccatgtgccaaggtactagaaccagcactggaattacaagaggaagatggtgtggtccacctctcaacagtcatatgctataacctaaaaaaacagacaggcaggtaatgtccatatagagtcatagataccatgacaggtatacaacagggcactactggaacacacagaagggacacctacccacttttatgtcaacatcatgggctttctgatggaggagatatcataggttgatacctgaaggacaaggaaaagcttgccagatagagggaagaggcaaaggcaaagagcctgagatgaggaagagccctgcagagttccactccatcaagtttgggctacagcaaagggtagagtgcagtaagtggtgagagacaaggctgagtaacttgacaagaattacattgacatgggtgtttttatttcatggtgaaaaatctggaatgtttcctgagaacaagtgtaagccaatgacacagtaaatgacaggagatttaaaatgtcacctgtcaagtgactgcttatgaagggttattgctcaactaagcatttctgaatgagtctaaggtctgttggccttcaatttctaccaaaaccctgagaacttgatgatgcctgtgttttctgagaatcgtttcagtgtgctggctgacagttccatgaggatggcaaaacttaagaaagtgtagagccagtgaaaaagagatgcacagacttcttgggaattttttaagctacagaacatgatgaatttatggtgcataagtacagtcttctctgtgaaagtttttgttttcacatctttcattagatgtgtgtaagaaaaaaaatacttgacgtagtatctactaacccaagaatgaaaaggaatgccatttgctatttacactttatttctaaaataaacctaaatttaattaataaattttggcaacatacttctctttgtttctctaattatttgttccacacagtccagctccatctaaaataagtaaaaataataataatgtttaagttaaacaagaaacattatcatgaaaataatgtatcatttacaaaatgtggcctttagtatttttagtgactagacataacttgaagtttgcttaaatagaaaaataatcacataaataaagtaaaatttctacttattttaagtttagataacagaggatgtatatgtgtaatgctgtttagagtaatcggacaaaaatacagttaatattgatctattgcatatacatgattttagaaaggtagtgttttattagtacaaaggttaaacaatggccaggcatggtggctcatacctgtaatcccagcacttggggaggccaaagcaggcagatcacaaggtcaggagatcgtgaccatcctggcctacatggggaaaccccatctctactaaaaatacaaaaattagctgggcgtggtgatgcgaacctgtagtcccagctacttgggaggctaaggcaggagaattgcttgaagccaggaaatggaggttgcagtgagccaagactgcaccactgcactccagcctggtgacggtgagaccttgtctcaaaaaaaaaaaaaaaagattaagtaattaaagccatcttttgcaatgaatgcattgctttgaaattcttagaaaactctgccctttataaaagtttaatccattttttacttcaataaattttatcttaaaaagaaatttctattctctacttatagtaaacttttctttctttttttttttttttttagtttatattctaaattaaggtggtacctctgtaggattcttccaaaggcatattgagggatgccgaggtttgcagtacagttgagcccatcacacaggtagtgagcgtaggacccagtaagtagtttttcaaccctggcccactctgtccctccctgctcttatttcctagtgtctattattcccatgtttatgacaatgtgcacccaatgtgtagcttccacatgagtgaaaacatgagatacttggtttctgtttctgcattggtttgcttaggagagtggattccagctgtatccatgttgctgcaaatgatgtcactttgttctttttatggctgcttagtattccatggtatatatggaattttccaatctaccttggattttcaatctaccttggatgcacctggattgactccatgtctttgctattgtgaatagtgctgcaatgaacatacatgtgcatgcatctttttgttacaatgatttattgtcctttcagtataaccctagtatagtaatggggttgctgcatccaatggtcattcttagttcttaatttccaaactgctgtccatagtagcagaattaatttgcattgccacaaacggtgtgtgttcccttttctccacagcctccccaacatcttttatttatttatttatttattttactttttaacaaaagtcattctgactggtgtgaaatggtatctcactgatgttttgtttggcatttttctgattagcaatggtaagcatttgttaatgtttgttggccacttacatgtgttattttgagaagagtctgttcatgtcctttgcccatttttaatggtgttatttattttttgcttgttgatttgtttaggtctcttatagattctggataataggataatatgcatttgctatacccatagtttgtgaatattttcttccattctttaggctgtctgtttaatcccgtgatagtttctcgtgctgtgcagctctttagctaaattagatcacacttgtcaatttttgttattcttgcaattgcttttgaggacttagccataaattgacaaatatgatgtctagaagagtatttcctaggttttcttccaggatttttatagccagaagatgtactcttatgtaagaaaagcacaagccttttttttttttttttttttttttgagacggagtctccatcacccaggctatagtgcagtggtatgatcttggcttactgcaacctctgtctcctgggttcaagtgattctcctgcctcagcctcctgagtatctgagattacacatgcctgccaacatgccttgctaatttttgtatttttactagagacaggtttcatcatgttgaccaggctgatctcaaactcctgacctcaggtgattcacctgccttggcctccccaaattttgggattacaagtgtgagccaccacgcctggccaagcacaaagcttttaacataaaaatggaaatgaacattttagtgtttggtttaattcataaaatgcaattattttggattctcctaaataataaacatccatatgtggtaaagtgtttggatgccaatcattcagttgtgattatgggtgggaagagttgagatggtgcaaataaacttttttctaattttttattttcaagacggagtctttccctgttacccaggctggagtgcagtggtgcaatctcagctcctgcaacctctgtctcccaggttcaagcaattctctgcctcagccttcctagtagctgggattacaggtgcccgccaccacacctggcttttttttttttttttttttgtacttttagtagagacggggtttcaccatcttggccaggctggtcttgaacttctgacctcgtgacattcctgcctcggcctcccaaagtgctgggattacaggcatgagccaccgcacctgcctggtgcaaagaaactttaaaagtgacaagggccgggtgcggtggctcatcctgtaatcccagcactttgagaggctgaggcaggcagatcacaaggtcaggagttcaagaagagcctggccaatatggtgaaaccctgtctctactaaaaatacaaaccttagctgggtgtaatggtgggtgcttgtagtctcagctacttgggaggctgaggcaggagaatcacttgaacccgggaggtggaggttgcagtgagtggagatggcaccacaacactccagcctgggtgacagagtgagacactgcctcaaaaaaaagaaagaaaaatgtggtatgaaccacagccaaactacaatcaattagagagtaagccaaagtatctcaaagtatatcatcagttataaggcaataacatgcaatttctaaaacctaacttaaatgcagcttttaaagacattttaaacatgtcagtttagtcacatttattgaataaagttagcaaatggatatctctcaaaaatgagagctccagggaattaaaaaatgtaaagttcccatttcctttctgtgttaacacagctaattatgatctttacttaacatgcataagtcaacagaacaactcagtatttcaccaaattaaaaacaagaattacgctagagaaatgaaaccctaaagagaaacggtcatataacgaacctcagtcaagtagttctggcagttatttgaggtctgagggtttgaagtaggaattcttacgggcatttggggaatatattttctgttgagtcctatactagtaagattttcaacacaaggtgactctgggcctcgccttgtaggaagagtgctgagaaaatatttcacccgctctttctccataaggagcttggtgctgatcattgctattttcttattagatctataaagatagcaaagacaaatgcttagtatttcatttttccttaaatgattcttaatgacttgtagtttttaaaaacttgccctgagagtaaaccaaattacccactaaacagtgttttcacactgaagatgtgtgagagcatacctattgtaaggaattatacttttaaaatcactctaaagaagcacctgtgtttctaaggtgatttatactgaagaagcagctcaaacaaagtagacagggaagagaaatggctaccagtgatgtatggctcaacgggtaaaacttgctgccttctaaaatggctctacctgtaagattctgaagattccacttgaaatacttgtatttaaagggtaacaacatgggaaaaggaatatgttgatttgcttgattataagaaccacttcactagaaataattatatcaaaacatcatgttgtgctccttaatgtaggttaagaaaactaaaatgaacaaaaaaaatctaggaatacttgtgtttagtaaaccagtttcaggtttcacccttgtacatttcaccaattatctaggaccaattaaacatttggtaatgaggaataattcagagcaacaactcctaggggagaactagattgtttggttgttgatcaaaaagaactaaagcatctctgaaggcaattagcccccagcactgtgaccaaggcactggaggtggggcttgttctttttgccttccacacaccccttcagactgaacaaggtgttattttttaaccgctttgtgaattacacttctttaaattcctgtgataattattccctatttcataaggatgcctttctataacatcttgaatatgttacacaggtagtctttcttgaggcaccctctagtcataatactaaagatcacaattaaagacgattgtgcccagagtagcagtaccacttgacactttgggtttaggtcgtgatctactgaaaaataaacccattaatattactatttagggaaattctgacaagtaatttaaaacaagatcactttattaattataaagcttcaaaaatacttagtaaaaaaacttacagattaactacaagagacttttcaggagaaaaaagccatacaaaagcaaaaaaaaaaaaaaaaatgagaggagagacagaaactatccttgaataacattttaaaggtaagattacttactaacattattttccaaaattacattgtcaaattagcattgacttcctactaatatcctgaagccatctcactaaaaattatgctttcaaaacaaattaatgagctgaattcattttctataagtgtatgtttggacttacttcgttaatttttttgacatggaattgttagctttcaatgctactgcaaaggcttccttgtattcttctaatttggttgtaacctcttcataagtagttttcattttggagaatttacattccacatctttaagtgtgagttccttcttatttagtgaagccgtattacccttgtttaac

SEQ ID NO: 10161 - DNA, 2352 bp, Homo sapiens
catctaccctattcctgagtgtcagagtgtgaggaagggagggacatttggcaaatgagacaccctgtgctgttgggtctcccagggcccttcccatacagccccgatctaaagacacaacacaaaggctacaggaagactaatccagaacctctgagtctcagacagggaccacctgaggactctccccagacagccagaaggccctttgctagtttcttggtacctcagtggatgtggcagcagttcttctgttggggaccagtgagtacacgctggggagggctcacctgtgcttcctcattggctccacttctgcttctaaaaaaaattactcattccagagctggggcagagaaaatacaagatgagcttagaaaatcttctgccagaaagtaaaaaagtgctgacagagtaatggagacaaatcaaagagacataaagtcaggttggaatgtctactactggcctaatcttggggaattggagcatcagaatcatgagctttccttctcccttatttattggttttatttctccatgtagaacaaagaagagaataagaaaataatcatctggcaaccatcaaagtaataattgttcaaacacaagtcatccatgaaatgctaaatctagtgggttctgaggagttaccagatatttacagagcctcaaagtatctccatacaaaatacggttgaactacaaaaagaaaatcataacattagtatggacaaacctggcaggtactccttaagtctcctaagtaataaaaactgtaaaatgcaaataagcctttgatgacctttactaacctttactaaagtatcgatgacgtggttgtttaaacagctgacatttgggcaatttgagtatgtcaaactcaataatactggttttcatttgcaagatccacttaaaacttaaggaggttaaaaaacatcatttaaaataccctataaattatcttcatacatatgatacaaaaatatcctacttcagtaaatgttgtaatgttatatattttgtgagaaacaattaaaacgtgtaaatagcctggtaataaagttttataatcctttaaatcatacaatttttccttaagactttatggttaaatattctctttgttagatatggcttaccagtggattctagagaagaaagtagatgggagcaagtgtccaacacagcaacagctggaaagaaaaataaagaattatgttctttacctaaaacacttcagttaactaagtgtgcgtttaaaaactaaagagttgagaactttatcagatttaataagaatgagaaatatgtatgtacatttacaatacaaaattactatttaataaattacacatggcattaattctaattgtgtttaaataccagagctttttcattcttcattcatgtaatcaacagccacatgctaaggtactagaaccagcactggaattgcaagatgaagatggcatggtccacctctcaacaatcatatgctataaactaaaaaaacagacaggaaggcaatgtccatatagagtcatagatactatgataggtatagagcagagcactactggaacacacagaagtgacatctacccacttttatgtcaatatcatgggctttctggtggaggagataacatagattgatacctgaaggacaaggaaaagtttcccagatagagggaagaggcgaaggcaaagagcctgaggtgaggaagagccctgcagagtccactccatccagtttggtgctaaagcaaagggcagagtgcagtaactggtgagagacaaggctgagtaacttgatgagaattactttgacatgggagtttttatttcatggtgaaaaatatggaacttttcctgagaacaagtgtaagccactgacacagtaaatgacaggagatttaaaaggccacctgtcaagtgactgcttatgaagggttattgctcagctaagtatttctgaatgagtcttaggtctgttggccttcaatctctaccaaaacctttgttttttgatgatgcctttgttttctgagaatcgtttcagtgtgctggctgacagttccatgaagatggcgaaacttaagaaagtgtagagccagtgaaaaagagatgcccagacttcttaggaattgtttaagctatggaacatgatgaatttatggtgcataagtacagtcttctctgtgaaagtttttgttttcacatctttcatttgaagtgtgtaagaaaaaaatgcttgatgtagtatctactaacccaagaatgaaaaggaatgtcatttgctatttacactttatttctaaaataaacctgaatttaattaataaa

SEQ ID NO: 10162 - DNA, 2353 bp, Homo sapiens
catctaccctattcctgagtgtcagagtgtgaggaagggagggacatttggcaaatgagacaccctgtgctgttgggtctcccagggcccttcccatacagccccgatctaaagacacaacacaaaggctacaggaagactaatccagaacctctgagtctcagacagggaccacctgaggactctccccagacagccagaaggccctttgctagtttcttggtacctcagtggatgtggcagcagttcttctgttggggaccagtgagtacacgctggggagggctcacctgtgcttcctcattggctccacttctgcttctaaaaaaaattactcattccagagctggggcagagaaaatacaagatgagcttagaaaatcttctgccagaaagtaaaaaagtgctgacagagtaatggagacaaatcaaagagacataaagtcaggttggaatgtctactactggcctaatcttggggaattggagcatcagaatcatgagctttccttctcccttatttattggttttatttctccatgtagaacaaagaagagaataagaaaataatcatctggcaaccatcaaagtaataattgttcaaacacaagtcatccatgaaatgctaaatctagtgggttctgaggagttaccagatatttacagagcctcaaagtatctccatacaaaatacggttgaactacaaaaagaaaatcataacattagtatggacaaacctggcaggtactccttaagtctcctaagtaataaaaactgtaaaatgcaaataagcctttgatgacctttactaacctttactaaagtatcgatgacgtggttgtttaaacagctgacatttgggcaatttgagtatgtcaaactcaataatactggttttcatttgcaagatccacttaaaacttaaggaggttaaaaaacatcatttaaaataccctataaattatcttcatacatatgatacaaaaatatcctacttcagtaaatgttgtaatgttatatattttgtgagaaacaattaaaacgtgtaaatagcctggtaataaagttttataatcctttaaatcatacaatttttccttaagactttatggttaaatattctctttgttagatatggcttaccagtggattctagagaagaaagtagatgggagcaagtgtccaacacagcaacagctggaaagaaaaataaagaattatgttctttacctaaaacacttcagttaactaagtgtgcgtttaaaaactaaagagttgagaactttatcagatttaataagaatgagaaatatgtatgtacatttacaatacaaaattactatttaataaattacacatggcattaattctaattgtgtttaaataccagagctttttcattcttcattcatgtaatcaacagccacatgctaaggtactagaaccagcactggaattgcaagatgaagatggcatggtccacctctcaacaatcatatgctataaactaaaaaaacagacaggaaggcaatgtccatatagagtcatagatactatgataggtatagagcagagcactactggaacacacagaagtgacatctacccacttttatgtcaatatcatgggctttctggtggaggagataacatagattgatacctgaaggacaaggaaaagtttcccagatagagggaagaggcgaaggcaaagagcctgaggtgaggaagagccctgcagagttccactccatccagtttggtgctaaagcaaagggcagagtgcagtaactggtgagagacaaggctgagtaacttgatgagaattactttgacatgggagtttttatttcatggtgaaaaatatggaacttttcctgagaacaagtgtaagccactgacacagtaaatgacaggagatttaaaaggccacctgtcaagtgactgcttatgaagggttattgctcagctaagtatttctgaatgagtcttaggtctgttggccttcaatctctaccaaaacctttgttttttgatgatgcctttgttttctgagaatcgtttcagtgtgctggctgacagttccatgaagatggcgaaacttaagaaagtgtagagccagtgaaaaagagatgcccagacttcttaggaattgtttaagctatggaacatgatgaatttatggtgcataagtacagtcttctctgtgaaagtttttgttttcacatctttcatttgaagtgtgtaagaaaaaaatgcttgatgtagtatctactaacccaagaatgaaaaggaatgtcatttgctatttacactttatttctaaaataaacctgaatttaattaataaa

SEQ ID NO: 10163 - DNA, 373 bp, Homo sapiens
tatgccaactggtcttaatcatcaaatgactccatagtaagaatcattactctgaaagattgattttgttataataatggaaatttaaatatttaaaagaaaaaacagatgccatttttttttctaaaactctacaaagcaaattgctacaagagaggcagaggaaacacaatatacacatatccaaaatataatttgcagtgaaataaaggaaagcacattacagataaacttacctgatttaaaaaactaacctgtaaatggatttcttctaatttttctactgccgtcattgccctttcatctagctccgatttatattcttgtagtttactaagttctaccatattgtcttccatatgtgtcttaagat

SEQ ID NO: 10164 - DNA, 373 bp, Homo sapiens; identical to SEQ ID NO: 10163

SEQ ID NO: 10165 - DNA, 1455 bp, Homo sapiens
ttgtctcaatatacgaaaatcaataaatgtaatccagcatataaacagagccaaagaccaaaaccacatgattatctcaatagatgcagaaaaagccattgacaaaattcaacaacgcttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatggtgttggaagttctggccagggcaattaggcaggagaaggaaataaagggtatgcaattaggaaaagaggaagtcaaattgtccctgtttgcagatgacacaattgtatatctagaaaaccccattgtctcagcccaaaatctccttaagctgataagcaacttcagcaaagtgtcaggatacaaaatcaatgtacaaaaatcacaagcattcttatacaccaacaacagacaaacagagagccaaatcatgagtgaactgccattcacaatttcttcaaagagaataaaatacctaggaatccaacttacaagggatgtgaaggacctcttcaaggataactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaacgactctaaagttcatatggaaccaaaaaagagcccatatcgccaagtcaatcctaagccaaaagaacaaagctggaggcatcacactacctgacttcaaactatactacaagtctacagtaaccaaaacagcatggtactggtaccaaaacagagatatagatcaatggaacagaactgagccctcagaaataaagccgcatatctacaactatctgatctttgacaaacctgcgaaaaacaagcaatggggaaatgattccctatttaataaatggtgctgggaaaactggctagccatatgtagaaagctgaaactggatcccttccttacaccttatacaaaaatcaattcaagatggattaaagacttaaacgtaagacctaaaaccataaaaaaatctagaagaaaccctaggcaatatcattcaggacagagccatgggcagagacttcatcactagaacacaaaaagcaatggcaacaaaagccaaaattgacaaatgggatctaactaaactaaacagtatctgcagtgcaaaagaaactattatcagagtgaacaggcaacccacagaatgggagaaaattgttgcaatctatccatctgacaaagggctaatatgcagaatctacaaagaac

SEQ ID NO: 10166 - DNA, 2351 bp, Homo sapiens
ttgtctcaatatacgaaaatcaataaatgtaatccagcatataaacagagccaaagaccaaaaccacatgattatctcaatagatgcagaaaaagccattgacaaaattcaacaacgcttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatggtgttggaagttctggccagggcaattaggcaggagaaggaaataaagggtatgcaattaggaaaagaggaagtcaaattgtccctgtttgcagatgacacaattgtatatctagaaaaccccattgtctcagcccaaaatctccttaagctgataagcaacttcagcaaagtgtcaggatacaaaatcaatgtacaaaaatcacaagcattcttatacaccaacaacagacaaacagagagccaaatcatgagtgaactgccattcacaatttcttcaaagagaataaaatacctaggaatccaacttacaagggatgtgaaggacctcttcaaggataactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaacgactttaaagttcatatggaaccaaaaaagagcccatatcgccaagtcaatcctaagccaaaagaacaaagctggaggcatcacactacctgacttcaaactatactacaagtctacagtaaccaaaacagcatggtactggtaccaaaacagagatatagatcaatggaacagaactgagccctcagaaataaagccgcatatctacaactatctgatctttgacaaacctgcgaaaaacaagcaatggggaaatgattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagcaaccctaggcattaccattcaggacataggcatgggcaaggacttcatgtcatgtcgaaaacaccaaaagcaatggcaacaaaagccaaaattgacaaatgggatctaattaaactaaagagcttctgcacagcaaaagaaactaccatcagagtgaataggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacactagttagaatggctatcattaaaaagtcaggaaacaacaggtgctggagaggatgtggagaaataggaacacttttacactgttgatgggactgtaaactagttcaaccattgtggaagtcagtgtggcgattcctcagggatctagaactggaaataccatttgacccagccatcccattactgggtatatacccgaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttatagggacatggatgaaattggaaatcatcattctcagtaaactatcacaaggacaaaaaaccaaacaccgcatgttctcactcataggtgggaattgaacaatgagaacacatggacaaaggaaggggaacatcacactctggggactgttgtggggtggggggaggggggagggatggcattgggagatatacctaatgctagatgacgagttagtgggtgcagtgcaccatcaagtcacatatatacatatgtaactaacctgcacattgtgcacatgtaccctaaaacttaaagtataataataaaaaaaagattaagtaattaaaac

SEQ ID NO: 10167 - DNA, 35959 bp, Homo sapiens
gggtgaacgtgggctgcggccctgcagaggagagggtccttctcaccgggctgcatgcggttgccgacatctactgcgagaactgcaagaccacgctcgggtggaaatacgtgagtgccacaaggggatgctcgtgccacaaggggatgtggcactaagttgccactgagccacacctccccgtgcagtgtggcccatggtaccagtcacagcactttcagaaaccccagttcctcagccgaggtgggaagtccagactccagtgaggcatggtctcaccactgccctccagcctgggtgacagtgataccccaacccaaaacaaaaaacaaaaacaccatgttttcaagccctgtttcttcctaagccaggctctctgcacccagcccgccctcggcccgctgagcagagcctggtgtgggaggaggccgaggaggctgcagggggctgcgggaggctgtgcccactgtcagggacaagtctagaagacctcagcgccagacctgctggagtcagagacagagagctgccccatgagctctttaccccaaatccctctttctcagggaccttgaattgaaggttgcaatcgccacctcctctccagccttcacctctagctcccttctctctccaccacatggctgatctggcctcctcaggccctgcaccttcctgccccgcttccctcctctacgctgccctgaagtctctcttccaggctccactctctctgaccttcgtggccgagtcctcccctcccccaggccacctgagattccatggttttgaccccctggccatctgccttctgttggatgctcccatgccttccccagttgttgttgttgtttttttgtttgttttttgagatggtctcaaactcctgacctcaagtgatccacccacctcagcctcccaaagtgctgggattacaggcgtgagccaccgcgcccggcctgcctgcctttgttgaaggaggctttcccattctggctctggtgttcttcgggtccaggccacctgctctgcctctttcctgaattcctgatcatctctggtctcccagattcctcatgagttttggaaggccacagttcacaccatggaaacgggctccacaagactagcacgcatccctagcccttcccctggtcagtcagccccatacccatctgtgggccccacttccagaaacccgtgccttccctgcatggccaccacactgcattcccctctatggctgcacccgcttcctgctggcacagtccttcctgtgtctgccacacctggggctgccgcttgggtaggcaggatccatcttggtcatctgtgtccctagcaccaggccacacactcagcaaaacaaaatgatgaggatgtgtctgtgggagagatgttaactcctccccatgaaggaccttctccagatatcctgttttttgttgttgttttttgagacagggtcttggtcgatctcagctcattgcagctttgaccttctgggctgaagcagtcctcccacctcaacctcccaagtacctgggactacaggcacaccacacccagctaagtttttgatttttgtagaagaaaatcactgtgttgcgtaggcttgtctcaaactcctggactcaagtcatcctccttccttggcctcccaaagtgctggaatgacaggtgtgcaccactgcgcccagcctccagatgtctttgacctgtttatgtcactctccctgtatttgccttcacgctagttatgcacggaattcctggagtgtagtcttttgcatctcttcaagcctcttaaattgtcccacatgtagtaaatgttcagtaaacagatctgcattcacactgtcctacaagtaatcccagcactttgggagcctgaggtggaaggatcacttgagtcctggaggtcaaggctgcagtgagctatgaccagaccattgcattccagcctgagtgacagagtgagaccttatctcaaaacaaacaaacaaatgaaaaaccttttagtatatgcgctgccgaagcgagcacatgaaaaacctttaacaacaaatgcaaagtaaacctacactgcctcaatggactcacctggaacagaccctcccagcgccggatgagtgcaccgctcagggaacatctgggtatatagttcatagtatagacttgggggggttttttgccaaaagagtgatgaaattgaaaagtgaaaccttctgtcctgaaacctttgtctcttctttttcaaggagcatgcctttgagagcagtcagaaatataaggaaggaaaattcatcattgagcttgctcatatgatcaaagacaatggctgggagtaatgtgcgaactttcccttctccttcgaatgctgttttgtgaaagaaactgtgaatgtaatggaaacgtaggagcatctggtgacagcctttcttgccctctgacctcaaaggctagctgcgcatagctcttgacactcccggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaaaagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccctccaccaggagtgggcaccccataagggtttaggccactttgcagaggatggaggtcaaaaaccactcccagataagtttggttttcaacatttagtaacttgtctcagggcagagggcaggcagggggaccgaggggcagcagataggagagcactgagcccggatagttctcagcctggcaagtggctctgaagctgccttcagacaaggctagtctaggggcaagagtgcgagctggctgacaataagaacgtggccacctgcccagcttcacacctcccccgacttcagcccttcctaaacccagacctgcggtccaggcaggcactgggctgtgcccactcgagctcactgcccacacacagcatgcctttgggtgccatctctttgcccaagcctggaagccttggcaggtgggaaatgccgctgccctggtgggcatggcactgagatgcatccactcagcaggagtgacagaggcagaagttcctttaaagcacatcttccacttaggaaaggaaggaaatctttgtactgtcttggaagcctccacatccggctatggccctgcaagctgctttatccctgcgctagtctcccccgagggtttaggctggcccagcacatcctgtcctcctgagctcgcgtgcagccacccagagcgcaggggtcactgcacgctgcagggctcttgctgccatggtctcaagcctgaagaggctccgcccacaagctggcccatgaagttagcaatgcctgtggcttcagtcaattgtcttgagactgtgaagaggctgaaagacaccttcccgggtggaagaaggagttcactgaaaacttatcttaaactgacccttccctttgagtgagtcttcattcctctcccatgtgggaacccagcctccgatgccccggggactaggggaaacagttggaggttcgtgccgtccccagcctgccacgggtgcgaggacagccaagtcctgagtgactcaagatgcttcacttacatggaagaaacttctaaaactctaccgagtggtttttgtatatactaaagttctatttagagcttttctgttttgggcaagttcgctgctccttctatttgggcactttggtttttgtactgtcttttgtgacggcattgattgaacattttttactagtagtcttatgacttttgtattttttttttttttgtaatttataccaacaacacttttatcactttttttttgttgggcttctgcaaaatacaagctcatttttaaaccaaatgaacagaccatgagctggcttcaggggaagtgctattcacaggaccatatccaccaccctcttaaattcctaaacaatatcatctaggacttctatttaagttatttaaaataaatcttccttgagagccttgggaggtgatgtcagggttataaatggcacagtgcatttgctgtaggaatgtggtttggcattgttttatacacacagtattttttataccttaatgcttattcttgatggcatctgtcagatattagaattgaaaataagaatcttcccaaaatcctttaatttacctgatgccctcatcaggtcgttaaaaattcaaatggttttaatagctaaaaaactacaaattaagctctaaaacaaacaaactacagaaatgtaaaccttcatttgccaaaggtccttggtggcctgtcccctgccctgggagcagatggccctgaagcccttccctcactgtgcaggccaccgggtgaggctggacggtcacccatggtggcttcactgcaaggagcaggactgccgagctcaagcacggggccttcagcttcccctgtcctctggccacaccgccagcccttggtccttatctgtgtgaggtttacaaataaagcttctgatgtcaaatgtttaaatcgtgccctcagtggacgaggccatgtcctgatgcagaaggctgagcccaggctctctgtggcgccgctgagagcagagggctgtcttggggtcttcgagctctggagccaaggatggcctggtcctacttctctgcccccaccaatgggggacttgaatgtggccagagaatacagtcagtcagggccagccagggtgtctgtcagggtgggcacagggtcctctccaaacctgcttctcactccctggtcaggccttcatccccaccacccgcacctgtaccctggacgctggctcagaggcctacaggtgtgtggacacctgggcagtcactgtgtcctactgtgcccctcctctgcaggcccagcttggtgtctgagcctcttacaagccagttactgccagggctgcaccaggccttgcggaggacagtgcctggcgggagggatggagggcgtcaaaagtcactctagagcccaggggcccgaccaatggtcacagacagggatgacaggctgcagagggatgggctggagaagagaaggagccagccatggcgcagttcttgttcttagcatgatgaagggccacagattggtgtgcagcagggtgacgaggggcagacatacctctagtggtcatcaggcagcctgtggcagtggatggggtgaggcagagatgcagatgaggcgccacccagcatccagggagacaaagggctcaggcctgcagcttcagcatcagtgattgatgagaaaaggaagggcagaggtacagcctgcaagttgctgacaggttcaagatttggggcaacaaaaatgagaaaaccaagaacaaggcctaagttagggcttagtgtgaagaactagaagtggggggtggcctgagggcaacagggagcccaagaggcaagtgtcaggcaaggagagtccatgacatgagaacactgaccactggcctgggctgaagacgaagaaaaagccagccaggggcacatttaacagaaaaatgggggttgagggaggggtctttctttaagggctgctgatgcagccggcccaaggccatcagagtcagtgactgacaggaggagcagagtcttggagcccagtggccgggcctgagagcagcaaggccacttcagcaggagggcggggagagggacatccacttgttctcacagcaggagacactggcctcaacccagtgtgggtcccctcaagattctcacaggggcacagagacgccaggcaggcttgagatgaagcccaggtggttcacagccagagcaggtgagcagggccctgagagctcaggcagggcacggcaggaaactcaatgctgccgtccaacaccagccttcagaagcccctgaagttttgtcaaaacagaccgagaagcccaccctgcagaggcttaggctcagtaagtctggggtctgaaaacttgtcccaggtaatggcgttggtcaggggaccacactggttgtataaataggctgtccctgagaagatgacagaagtaggggtaagaaaaccagacatatacagctggatgtagtggtgcacggctgtagtcccagctacttgcgaggctgaggcaggaggattgcttgagcccaggaggtcgaggctgcagtgagccatgatcacaccactgcactggagcctgggcaacagagcaagaccctgtcttaaagaggaaaccacaatctggagacacagtccttcctcactaacctggcctgcctactagaggagaggcctgaggcaccagcctgggtgtagggcaggccttgtgcttgaaggtcccagcagtgggctctggctgggccaggtcctggaaacagggccaaggcccttggcaacaggttaagggatgggaaggctgtgggctcccaggggccaggaaaggggatgcaggcagcaggcaagcaatttattggctggcagcagagggcaggctagaaaggctggaaatggagatgtggacatgggcccccagccctgcaaccccaccaaggtccacagcggccaacctgctgctaccaggagctgaagtccccaaaaccccgactgggcttcttcttggacatggggacagtggcactggttgagggctcttcctctgctgctcgcttcctgggaagagaagaagccgctgggagcccacaccctccctcagcccctcctgacttgtctgtgtctccatacagccctcccggtgtaggcccaacccctcccacctgctgctcccacatccccctgaatttgatctcttccacccacagaggccccggccaggccttcagaggcagtccctcggctgcagaggccacacagcacaagcccacggccgggaccagtgcccatagcttgcttgcccctctgggtctgaccctcagacctcagtcagccctaggaaacaccatgggaaacagggaggccagccccgaggcactcacgtggctgctgggttgatgtacttgcccacgccctggcggaaggtctgggggccctggctccctgcctggggctggctgctcttcactttggtctccggggctaccttgagctgtgtcttccgctcctgcgcaatctgtggcacaacagggcgctggctaaccggcagcacctcgggcaggacagatgctaggcttggggtggaaaagtgcactagcccagaccctcctaggtggtggcatcgtgccccctcacctgggcatcggcctcctcataggggtccacgaacactgtagtggcatcaatgcggatctcctcctagcagcaaagggggctcagtgcacggcaggtcctccccctgcctgcctggcccccagccgccacgccccacctccctgggcacagaccttagggcggtcagttttggggtcactctccacattctccatggctgtcagtacgtcaaagcccccaacaaccctgcagcagggagacagaggtgggtctgcgtgtgctcaaggagggcacccccacggctgagccccaaggcacgtgggaagaggggttgagagccccgaggctggcctggtggtccttgggcagcagccaggaaggcgatgagagggagtggcaagggcggggtcggctgaccatggccctgggcatatccagctgggtttttttctgtttttgttttttttttggtttcccccacccacaggaaaaataggagtcacaaaacgtggcttgtgctctccccgctggtttggtaaacagagttccacttggccagaaccacatcacctgcgtccaccctgtttcgtgctgcttccacacagctgggtgggcgtcagagaccacgtggcccacaacgctggaaagacccctggactagagggtgaagggagctgggtgtggccaggcttgcgagtggcgcgccactgggtctgagacagggcagtgtccaggccacatgggcgagtttcctcctctcctgagcccggtgggtctagagagccagacttccctggcacatggagcaccctccatcgcagctctgcatagcctcaacccccagcagtgatggccagcatggcacatgactcaggtccacgaaaaaggcagtgaggaggcctcaggtggggaaggaacccacctagcccactgaccccccaggcttcacacagccgcttcccttaccgtccaaagatggtatgcttcttgtccaggtaggcacaggagcgaaacgtgatgaagctggggaggagggctggatggttagggagagcatggcaccttctgcacctggcctgcctaagagcacaccaggagctgcccaccctctacagccagctctgggaacctgcagcttccacggacgcatgtgtgcacgtggttccctgcgctgcccaccagggcaggtcattagcccccaaggctgcccaggggaccccggaactccagctgtccccaggtcttcctgctgccccggctgctgcccactgcctgtcaggtggtccctgtgcccagaaccaggttggccatgcagctctgtgggaggtggctgggacgaggggacacctggaaaaccagagccagccccatgtcatcaagggacctgttgaaggactgaggagaaaggaggcaacaaagccagaacaggagtcaagggattaagaaacgtgggtaacataaataaacatggactaagaaaatgctcaggtcgtccaggcacagtggctcacgcctgtaatcccagcactttgggaggccaaggcaggtagatcacttgaggccaggagttggagaccagcctggccaacatggtaaaaccctgtccctattaaaaatacaaaaattagctgggcgtggtggcgtgtgcctgtagtcccaactacttaggaggccaaggcaggagaatcgctttaacctgggaggcagaggttgcagtaagctgagatcacaccactgcactccagcctgggcgacagagtctgtctcaagaaaaaagaaaaagaaaaaaggaaatggggtggaattaaaacagccaacagcactgccatgagacgaggagagagtttctgccagcctggtctgggaggaaggtagagactacctcataactttggacttttttttttttttttgagatggaatcttgctctgtcccccaggctggagtgcagtggcgcgatctcggttcactgcaagctccgcctcccaggttcatgtcatagtcctgcctcagcctcctgagtagctgggactacaggcgcccgccatcacgcccagctaatttttttgcatttttagtagagacggggtttcactgtgttagccaggatggtctcaatctcttgaccttgtgatccacctgccttggcctcccaaagtgctgggattacaggcgtgagccactgcacctggccaactttggactttaaatagatgtccttcttaaccttagaccagaagtaaaacatctaatttccaaaccagcagaaagagaagagaagcaaatgaaaataaatataaaaaatggtaactagaaagcaacaagatcatagaacgcaacagaccacctgaagaattaagtccacatttaagattgtcaggattggccgggcacagtggctcacgcctgtaatcccagcactttgggaggccaaggtgggcggatcacgaggtcaggagatcgagaccatcctcgctaacacggtgaaaccccatctctactaaaaatacaaaaaattagccaggcgtgtggcgggcgcctgtagtcccagctactagggaggctgaggcaggagaatggcatgaacctgggaggcggagcttgcagtgagccgagatcgcgccgctgcactccagcctgggggacggagcgagactccgtctcaaagaaaaaaaaaaaaaagactgtcaggatgaaggagaacacgacagaccccagctgtgagccttcaaaaagccctcagagggcagagccagagaggctgaaaagaaaacgatggaagacatggggtgggtcccggcgctggcgacacggagcactccccagggtggtgcaggcaggcacagcccacaacccggctggtgagacacaggacttaacctccactgcatcaaacatgcaccccccagccacgcagggacacgctcctgagcccaccaagtctgaccacacccgaggccaccagacaagtgtccgcagatgtgacatctgcaacggtgcagacctgagctctgacctgcaagcagttccctctcttgctgatttctaacacagtgaaggaaactagaagcagaattaaactcagataagaggaaagtaaaagaaccatcctgaggcaagctcctcctagaaaatctttttttttttttggagacggagtctcgctctgtcacccaggctggagggctggagtgcagtggcgcgatctcggctcaatgcaagctctgcctcctgggttcacgccattctcctgcctcagcctcctgagtagctgggactacaggcgcctgccaccatgcccggctagttttctgtatttttagtagagatggggtttcaccgtgttagcgaggatggtctcgatctcctgacctcgtgatccgcctgcctcggcctcccaaagtgctgggattataggcatgagccaccgcgcctggcctcctcctggaaaatctttaattacaagaatcacaaaagggaaaacaaagctgtaacaaattaaagtctaatgatctttgaatacagtaaaataggcaaacctttggcaacagttgtccaagaaagcacaaaatactactagaaataagaaaagaaggccgagtgtggtggctcatgcctgtaatctcagcactttgggaggctgaggtgggtggatcacctgaggtcaggagttggagaccagcctggccaacatggtgaaaccctgtctctactaaaagtacaaaaaattatcctggtgtggtggtgggcgtctgtaatcccaggagaaccgcttgaacccaggaggcagaggttgcagtgagccgagatcccgccattgcactccggcctgggtgacaagagtgaaactccatctcaaaaaaaaaaaaaaaaaaaaaaagagaaggtggcaactgatctgtcagcagtttcacaggctggttaagccaaagagaaataaaaaataataaaatgattccctgccctggcccctgccaaacaacaaaaacaaaccacgcacccaacctacttgaaaataaccaacagtcctaggcaatccttggctgagaagaaattgaaagggaagctaccaacaaccagcaagcagtgaagagggaacgtgcaccctcaaaatgacagacgtggctatcagaaacacacatggattaaagtgaggaaggaggaaaagcaccatgaagaagcaaagacagaaactgaaaacaattacaaacccttcaaagtgaagtgaaaacagacaaacccttcaaagaccactaagggactgaggaatggaaagtgtgattaggcatgagaaaaaaaggtcagcacagcgaggccaagagaataccagccttcatggaaacaagtgcccgttaaccctgaaatgaaagccccaaggaagtggcacgaatagctgccagctgcctttgcccagctgttaagcacagctgactcgtttgatttttttttttttttccagacagggtctcactgctgcccaggatagagtgcagtggcgcgatcctagctcactgcagctttgacttcccaggctcagattatccccccacctcaccctcccaagcagctgggactacaggcgcacgccaccatgccccgctaattttttttattttttgtagagatcgggttttgccatgttgcccaggctgctctcgaattcctgggctcaggcaatccacctacctcagcctcccaaagtgctgggattacaggtgtgagccaccacgcctggccatccctgtgattttaaccattccaggccacaaagccacagccagccctgctcgtaacatgcaggggccacacctgtcacagcaaaacctgctggagccagtccacacaaccgagaccacgtgtgacagtgagctggcagaaggccacggcgaagccacgacaggccagggttcaccccagaatgccacggagacacccatccactctggccttgtagtggccacatccacaaatcccgggaggaccagaaaaaggacagaatcatcatagtagatgctaacaaagaaacctctaaaaagtcagccaccctcctaaaaacagcccaacaacaaatgttctgagaaggcaaaacagcgatttctgtggagcacagcaagatgcccacatcctcctcccccatcaggcccacggtgacgtgacggtgacgtgactgatgtgcacaccagggaagcagagagcagaccagcttttggtgataagcgtgactatctagaaaacccaaaaaaatcttaaaaacttttgaattataagataatttgttaaagtggctagatataaaatgaacggtagtttttctctacatgagcaatgatccccaaaagttgggaaaaaaaaagtccatttacaaaagtatcataaactataaaaaatccttaagaggttgctttatcccggaagtcacaggacccatgtgaagaaaacgattgaaagactgaaacataacatcaggccactgtctggggatggaaagggcacctctgttcttccacaatacaggcatccggcccctgtgcgcatggccctgctggccccccatcccctgcctcctgccaccagactgcacactgctccccacatgcaccagggccagacctcctgtgtctctccaggcgcctctccctgtgcagcctgtgccctgcacaacccctcccacacgctgacctcccccagcactgcctggccacaggcacccacacgaatgcctggtccctgtcaagaagcccttctggacctccagtaattcccgacttctggtctctcgaggacacacccggtgcgggcagctctccctgctgactcactctggggacccccttttgaacgcaggtgcacatgcttggcctaggtgtgccgtacaccgtctgggtatgattcagaaccagcacacccttcagagagggccaagaggaagaacccgcagagagtgccggctcacctcccaggccaccccagcaagcccagctgactcacaattgagacctgttgctgttgggcccggagttggccatgctgaggatgccgcggcccgtgtgcgagaggttgggccggaactcgtctttgaagggcttcccccagtatgactccccacctggaagagaaaggcccatgggagcaggaaagcctgggccccagccgaggcagaactagaaacctcagagtcccgaggggcatcagggccttgctgagcccagcctggggcaggggcacttgatagggaggctcccagccccacgccaccaactcctgggtcccttggagcccccacgcctccaaacaggcaggctgctgcccactcaccccagccccgcctggggcctgccccgggacagggattaaagagtcaaggccaccatcatcatcactcaagctatgggaatacagaggttgggggatctggacccaagcagctgccaggctgaggggcttggagaggctgcaggagggagggctggcctcagtctgaggcagaccccaggggcccagggaagagaccacacactcttgcctcctctaccatgcaggcctcacagccacctggaaatgagaaaactgagggccaggcctgagggggcacagcactgatggctgccagtcgttccaccctggtctagcagattccatgtctgagctgtgcacaacccctgcccagctaccccctcatgccccacagagcagccaaagtgcccagagaggggcccagcaccagtacctacccgtgcctgtgcctgtggggtcgcccccttggatctgtgaaaacaaaagccagtgagcaagtcacactctgagacccaaggcccaccgcctgcctgactgaaggacacccctcctgccagatggctccacacaggggctgggctcttggtgataatgaggggccctcccagccacctccctttgtgaacccagttctggatgggctggggcctcaagggtcagtctatgggttccccaacagaggatcaccaactggactcatcctggccaccgtgggatgggccagggccctgggatggggcagggacaagcccacccagcccccgatgtcccaccaagctcatctgtgcagccagtgactctcgtcactcaccacaaagttccggatggatctgtggaagatggtgccatcgtaataatgcttcttgcaaagcctgatgaagttttcgcaggtttttggtgtctgcaacatagccccaatacttgtatgaagcagagagctgccaaaggcagctcaccacagccacaggaggcttttttttttttttttttttttgaggtggagtcttgctgttgcccaggctggagtgctgtggcgcgatcttggctcactgcaacctccgcctcctaggttcaagacattctcctgcctcagcctcccgagtagccaggactacaggcatgcgccaccatgcctggctaatttttgtagttttagtagagacgggtttccccatgttggccaggctggtctttaacatgtagcagagtcagctgcccagccacactgggcaaggatggacccacaacattaagcaacaggacccgtgcagccgcacggcccagagtacagcgcatgggagaagtgtgggcagagcagcaggtgcggcttggccccttctctgagacactggcacctgtgcgcaggccatgctgccaacgcggccccctaggaaggacacagggcactgctgcgggtcccgcctagtgacaggctgaatttcctacaacaagcacataccagtggcagccctatatttaagacatggctgtcagatgacccagagatgaccttggggcatggggagtggctggcctccacacccaccaggtcgcagtgcagctccaggttgaggtcgcccttgttggtgtgcagccgcacgtagcccttcttcttcacaaactggtagcgcagcacatcctcgtcgatggcagctacaagccaaggtcccagctcagcccctgccctcaccctggggcagccccaccatgccaggcagcaccgacctcagacacacaggcggggactaggctccagctctggggagagcaggggagctggaggccgagggtctgcttaggccacgcacaggctcaccccagcctcatggggctggcaggggttcagcagctaagagggggaggactaggggctcaggtgacagtgggagcccctgacagaccaataaagtgggagtcggggagcacacccaccccctgccacttttgggtcacatggcaggtggctacagaggccaaggtggctacctgcttcatgtgtggtctccgggaccatcgcggtggaggtgaaggaagcgctgaccttccctgtggaatagtgggcctgccaaggaaaccagggtggcacctcagcagtgccatgggaggcagttgggtggggatgtgtcgcttgcctagaagccaaccacacgccacccctgccccccaggccctgcttggtgcctctcctccaggagggcctccccaaccagcaggaggaagaagccaaggctaggccaagccagggtcccctggcctccactggatcccgactcttatgatatcaggtgaaaccctggagataaaataccacacaggactggccacctcagggttaggagtgtatggctgacttctcatttatttttattttaatttttttatgagacaaggtcttgctctgtacccaggctggagtgcagtggtgtgtgatcctggtgcactgcagcctccaactcctgggctcaagtgaccctccgacctcagcctcctgagtagctgggatgacaggcgcatgccaccacgcctggctgattttttgtagagataaggtctcactatgttgtctaacctagtcttgatctcctggcctcaagcaatcctcctgcctcagcctcccaaaatgctgggattacaggtgtgagccaccacgcctggcctcatttctttttaaaagtttcaaactttctacactaaacacattacatatttaatcaggggtcggggaaaagccccaataaatgttattttttatcatagaggaagaaaaaggggtttctcccatcagaagaaaatacaagccaggcacagtggctcacacctgtaattccagcactttcggaggccaaggcaggaggctctcacttgaagccaggaattcaagaccagcttagacaacatagcaagatcctgtttccaaaagaaaaaaaaaagtaatatatcaaagtgctaagggcagtgtgttagacggagtgacacactggacaacaagctttctttttcaaattttccagaatttgaataattctttaagaaggagaacttcagagctacctgcccatgtctctgccctccccctagctccagatccccatgctctgcctgacaggaggaagaagcaaacacgacagccccagacaggtggcaccgtgcagtcccaggcatgccatccacctcagcaccgcagcagaccatgaaacgccccaactctccctggcatggctttgggccccagtgcacatcgggccctgccctcccagccaccacagaaccacatgtgcccgctcaacgtgcctgccctggctactgagctcaggctgggaccacagcacaaggcagaccttctgtggcagggatctcccctacatgcccccacacaccccttggttcttcaacgaccagtgtggacatcagcccctccccttctgccttctcagattctatctgcctcagggcagccccagggctgtgcactcagagccatcaggggcaccacagctctgggggatcctggctgcctccctgccgtgtatcccaggcccccatgagcccctttcccaggaccactccaagaggccatgagatgggcaggaagacggggcttgggcttggccgagtgccctccgccactcacagcattcagcttgtccactttcttcttctccggggccttcatggtggctgccagaatctcgtcccctttgaactccttgtagagctcctgcagggtctctcgggtctcggcatttgtatttttcagataataagacgggtcctgtttggccttctcttcatctacaaaacagtagcatggccctgagccgccgagcccccagtagcctccccacacacgtgctggggacacagatctagaatagcccagggccgtccagccatggcgcaggcaccgtgccactgccagccacagaatgccacagtgccccgctacaggcctgaaggtctccccaggcagttcacaagggtctcaggatggacttcaggttgatttgcatattttatatttatctgtatattctaatctttttagagtatacgctttgctttttttttctttttttttttttttttttttgtggagatggagtctcgctctatcgtccaggctggagtgcagtggtgcaatctcggctcactgcaagttctgcctcccaggttcacgccattctcctgcctcagcctcctgagtagctgggactacaggcgcccgccaccacgcccggctaatttttttgtgtttttagtaaagacggggtttcaccatgttagccaggatggtctcaatcttgtaacctcgtgatccgcctgcctcagcctcccaaagtgctgggattacaggcgtgacccaccgcgcccagccttttgagacagggtctagctctgtcgccccagctagaaagcagttgcaagatctcagctcactgtagcctccacctcctgggctcaatcgattctcctgcctcagccccccaagtagctggggctacaggcgcaccaactacacccagctaatttttctattttttgtagagacagggtgtccccatgttgcccaggctggtctcgaactcttgagctcaagcaatccgcctgccttggcctcccaaagtgctggggttacaggcataagccaccacacccagttgctttgcttctgtaattttaaaggttatttttatttaaaataatagaagtgtttgggggtctttccagatgtgaaatcacccattcttgccgactcaggagggtgcctgctgcctactgggccttggacagcagcccaccctgtggagaggggccggcatccctgtgcagagagcacagacacggcccagccccaaccctgacctcaggctctcctgactcaaatcttccccagttcacgtgctcagcctacctaaaacccgttcaaacaatgctcacaaagtgcccaggccactgctctgcagcacaaggccgagtgacctctgaacatgagtcctgctggctcctccaaggctgcaggacagccaccagaggccagggaaacaggaggaccccatcaccccaccacctgcccactgacagcaccggccagtctgcagggagcaggggaacctgagcaggtgtgctggcagggcagcaagtctatcccgcccattgtttctgaggctgcagttggctcagattctctgaacactagttcagaaaatgcagggcctgtctgggctgggaccccctgacctccaggaaagcgggggctttacccagggagcactgtcccaatttcatccaaaagccccctcgcctagcccagcccctaggtgtacatacctgggtctattattttcatgttattcttcacatgatagaagttagagacattgaacttgtccaaattggtggggtcctgtggcaaaaagagaatgcccagcagagtgaacccagcctacggccaaatggcagccacatgcagcaaaggacggccagctgtcagaggtgtggaagaggccagggctacactgaggttgggggagtcaagcagggcatgagggaggaggtggtctgccccaggcagggcagcaaacaggggcaggggcagggacggggacgcagcctcgctagctgctggctgagctgtgaccttcctccaggcatatggctaacgagcattcattgctgttagggagctgtcggaccggaacgtgggcagccgtgggccgacctctggttagaatgggacaagccacagaggtgattgactcagcaggccacgctccagccagcacctgcttttctaagtcagtgtttttcattaattcacttggggttctctgacacctgcagggaccctgtgccagatacagggtctttgcagagctcatgccagctcctgccctcgaggcgctgaagcagagccaggcctgcagagtggctattcagatgcctcaggtggctttgaggacagatatgaggggccctgacgtgggggtaggggatcggggaggagatgtaagagctagactgaggaggcagccctgtagaggcctgggctggctgcaggtgctgaaggcagctggggcaggcgggcaggggacactcacctggagggtgatgatgtcctgccgggagaagggctcgtcggtcagcaggtcccggaagttcttggccttgatatttagctgttccactgcctatagccaggaggaagtggttttacgatgcctgccccaagccttggcacaggggactgcaagcagggaggcctggagctggccccgaccatggcacgatttgagaggcatgaggaatgagagagacagcagtgtacaccccactggctgaaagcagtggctcccacagaggcggagctggctgggcctcagacgatgagccagttcaccctcacagcaaccttcctgcaggaagctcttgtctgcacattgatcagcaaaaagactcagcgagtcacccacccactcgctgcaggctttgccaagctcctcccatgcacaggtatggtgccaggcccccgtgggcaggggctgtgcacacaagatgcctgcactcctgcggtgcggtctagcagagccctcactccactaacgaggactgaccatgccagtttgtgcaggcttctggcaagaagtggctcccaaggcccctggagcagcgctggccacctacaccccacaaacgtccaggtgcaggattgacaacggcgcaaaggtcggctttcccgccatgtggggcctgccccgcctcacccaagaggaggacccatgtgtgaacacggctgtctcccctctccctacacccactccctgccagaactcctccaggggacagctccctcctgggggcaagtgactccatccagatccggggcgagcactcccctcacagccctagaggcctgtcctcaaaacatgggtgccttcccagcacctgggctttgctgaagacgcagaaggacctcttggggtttaagggtccctgctgggcagccaggactgcctggattccgaaggatgcacctcccccaaccctttttttgacctgcctgaaaatggggaggctgcactgccagagctttgctagatgaccatgcctgtggctgtgactgtaaaccccacgaggacaggccgtacacgtagcacacagcccagccagtgtatactaggaacacacagcagagatctccccaccgctgtctccacgccccggagcgaggacacacctcataggcgtagacgttgccggtcgtcctcacagccacgatgtgggtgttgttggtgaacacggtaaacagcactgggcagtggtacttccctagagagaaggcacacacagggaggccagtcacctctgtgggctgtgaacatcccagtgaggaccgcagagggccagggcaggacagaactccaaagtcagcgatgggaggaggtggaaccccatgtcagctgccagagcagggaaccatggggacagctgctcaccccctcaagcccttccacaccgttaggaaactcctattcatcctgcaagacccaatcccggcatcgtcttcctcagatcctccagcccacccctgggtgatcaccatgctagcctcctcctcctactgaagttggccctcggcaggaaacaacccatgttccagccctgacagctctacctcctctcacccacatcctccgccagccccctggtcagctcttccttcagaaccgcccatccccttgcctgcctactgtctttttttgttttgctctgtttttttttttttttttttttttgagatggagtctcgctctgtcacccaggctggagtgcagtggcacaatctcggctcactgcaagctccgcctcccaggttcacgccattctcctgcctcagcctcctgagtagctgggactacaggtgcctgccatcatgcccggctaatttttctgtatttttagtagagatggggtttcaccatgttagccaggatggtctcgatctcctgacctaatgatctgcccacctcggcctcccaaagtgctgggattacaggtgtgagccactgcacccggccttgttttactctgttttgagatggagtcttgctctgtcacccaggctgaggtgcagtagcgtgatctcagctcactgcaacctccatctcctgggttccagcgattctgctgcctccgcctccggagtagctgagactacaggcatgcgtgcgtcaccatgtacgactaatttttgtatttttagtagagacagtgtttcaccaccttggccagactggtcccgaactcctgacctcaagtcatctgcctgcctcagcctctcaaagtgctggcattacaggcatgagccactgcacctggccttggttactgtctctctgcctgtaagtccccacccagtggccaggggccctgtcaaagtgcccacttctggggataaaaaagtaagtgcagtagggggactcagaaacatcaaccacatgtatttgtggggactttttctttttttttttttttgagacagagtcttgccctgttgcccaggctgcagtgcagtggcatgatctcctcggctcactgcaagctccgcctcccgggttcacgccattctcctgcctcagcctcctgagtagctgggacctacaggcgcctgccaccatgcccggctaattttttgtatttttttagtagagacggggtttcaccgtgttagccaggatggtctcgatctcctgatctcgtgatccgcccaccttggcctcccaaagtgctgggattacaggcgtgagccaccgcacctggccttgtggggactttttcttaaaaaaaatcctgatttgaggccaagttagagcctcaaattagttagagcctcaagttagaggtggctcacacctctagtcccagtgctttgggaggccaaggtgggaggattgcttgaggtcaggagtttgagaccagcctaggcgataggctgagaccccgtttttttgttttgttttgttttttgagacagggtctagctctatcacccaggctggaatgcagtggcgcaatcacagctcacgcagtctcaacttcccaagctccaataatcctcccacctcagcctcccaagtagctgggactacaggtgtgctcaaccacactggctaatttttaggtttcattttgtagagacaaggtttcattatgttgcccaggctggtcttgaactcctgggctcaagcaatcctcccaccttggcctcccaaagtgctgagattgcaggcataaaccatggtgcccagctgtttttttttggtgaggggatgctgacgcgggaggatcacttgagcccaggacttcaagaccagcctgggtgacatagggaaacctcatctctacaaaaataaaaattaaaaaagtagttggggctgggcgcggtggctcacacctgtaatcccagcactttcggaggcagaggcgggaggatcacctgaggtcgggagtttgagaccagcctgaccaacatggagaaaccccgtctctactaaaaatacaaaattagccaggtgtggtggcacatgcctgtaatcccagccactcgggaggctgagccaggagaatcgcttgaacccaagaggcggaggttgcagtgagccgagatcacgccattgcactccagcctggggaacaagagcgaaactccatctcaaaaaaaaaaaaaaaaaaattggctgggcatggtagtacatgcctgtggtcccatctacttgggagactgaggtggaaggagcacttggtcctggaaggtcgaagcaacagtgcgctctgatcatgccactacactccagcctgggcaacagggcaagaccatgtctcaaaaacaaacaaacaaacaaaaatccttctgatgtgaaaactattttttaaattggggcttcagcatcatgcaagggggtactggtgggagcaaagacagaactgcacagatgggagacagcaggggctggagttggtgatgggcacaagggaggcgtatcacacctcctcactccactttcacgcacggggaattccaattaacaaagaaacaggcggggcgcagtggctcacgcctgtaatcccagcactttgggaggctgaggcaggtggatcacttgagcccaggagttcgagaccagcctggccaacatggtgaaaccccgtctctacaaaaaacacaaaaactagctgggtgcagtggtggtgcctgtagtcccagctacttgggaggctgaggtgggaggatctcttgagcccaggaggcagaggttgcagtgagctgagactgtgccactgcattccagcctgggtgacagagacctcatttcaaaagaaaaaaggaaacacaacaaaagaagctgactgccaggtcaaagttttaaaagaaaaaaaaaggctggacctcattcctccctcagtggctctcatcttggagcggaagcccaagtcctcctgtggctcccaggccccacaggactgctctgcacaccatccccacccctgacctctgtcaccacatcccctgcttccaccgctagcacacgctgttccagccacattggactcccagctgggcacagacacccttgagcgtgcgcccacctcagggtctttgcactggctgtgccatcagcctggccctgcactcccccgatgcccacacggctctccctccctgcagcgggtcagggcggccctctcccctccccctgctgtgctctccacacacaagcagcctctggcacaccctgctgagctgctctctggtgttctcccccaccagaatgcatgctcctctcattcaggagagacacagcctgttgtgctctctgcacatggcaggcactcaataaatatttgctgtccctccctctccctctcccgctcccgctccccagggtctccctctgatgccgagccaaagctggactgtactgctgccatctcggctcactgcaacctccctgcgtgattctcctgcctcagcctgccgagtgcctgggattgcaggcgcgcgccgccacgcctgactggttttcgtattttttgggtggagacggggtttcgctgtgttggccaggctggtctccagctcctaaccgcgagtgacctgccagcctcggcctcccgaggtgccgggattgcagacggagtctcgttcactcagtgctcaatgttgcccaggctggagtgcagtggcgtgatctcggctagctacaacctccacctcccagccgcctgccttggcctcccaaagtgccgagattgcagcctctgcccggccgccaccctgtctgggatgtgaggagcgtctctgcccagccacccatcgtctgggatgtgaggagcgcctctgcctggctgcaaccccatctgggaggtgaagagtgtctctgcccggccgccccgtctgagaagtgaggagcccctccgcccggcagccgccccgtctgagaagcgaggagcccctctgcccggcagccgccctgtctaggaaatgaggagcgtctccgcctggcagccgccccgtccgggagggaggtggggggcagcccccgcccggccagccgccccgtccaagagggaggtggggggcagcccccgcctggccgccgccccgtccgggaggtaggggcgcctctgcccggccgccccttctgggaagtgaggagcccctctgcccggctgccaccccatctgggaggtgtacccaacagctcattgagaacaggccatgatgacaatggtggttttgtcgaatagaaaagggggaaatgtggggaaaagatacagaaatcagattgttgctgtgtctgtgtagaaacaagtagacataggagactccattttgttctgtactaagaaaaattcttctgccttgggatgctgttgatctatgaccttacccccaaccctgtgctctctgaaacatgtgcggtgttcactcagggttaaatggattaagggcggtgcaagatgtgctttgttaaacagatgcttgaaggcagcatgctcgttaagagtcatcaccactccctaatctcaagtacccagggacacaaacactgcagaaggccgcagggtcctctgcctaggaaaaccagagacctctgttcacttgtttatctgctgatcttccctccactattgtcctatgaccctgccaaattcccctctgcgagaaacacccaacaatgatcaataaaaaaaaaaagaggtttggagaaataaaaaataaacaataacacacacacacacacacacacacacacacacacacacacaataaataaataaatatttgctgaatgagagacacacacacacacacacacacacacacacacacactgctgatcacaggaggggaggcagcccaccctcggccaccagggtggagcgccgtgtcctccaccgacgtcaatgacgtgctgaggttcacccattcattcacctgcgaatgctgcaccgactggggaccgggctctgggctcagacaagcggggcaaaagggccttggcctcaggtgctacagcatctccctggaatgcatgcacccagtaagcaaggacaacccctaagccatagcatctccacaggcaaaagacctgggctagaacctagcacaagatcaccacctgggcaggggtgggctgcacaactcatccgggcctctggccacaagaacagcggaaggtgtgtaatgggcatgaagcaggagccgcagcactgggctgggctctatgagctgtggcaaagaaaagcctagcccaagagctactggacaaatccctccagaccacccacatcccctactcagctgccgccttggttcccagcatgagcaacttctgcctccaacaacaaacagaccacagcctcagccagagggggcccatgccctgcagatccaactgtgcccacaaaggccactagcagcttacaatggcctgatcgcctttgtgggaagttcccaacaccacaggttctgcccccaacctcccccaccttaaaactacccagacctttgagaagaaatcttgtgacaccttttttttttgagacagagtctcgctctgttgccaggctggagtgcagtggcaccatcttggctcactgcaacctctgcctcctgggttcaagtgattctcctgcctcagcctcccgagtagctgggactacaggcgcccgccaccatgcccggctaatttttgtatttttagtagaaacggggttttaccatgttggccaggatggtctcaatctcttgacctcgtgaaccatccgcctcggcctcccaaactgctgggtttacaggtgtgagccaccatgcccagccctgtgacactttttgcggaattaaaagcaggtgtctagcttggtcagaaagcaatgactgattccgtatgaaaactggtgagagctgggcccttgggtctgcaggtcaagcccagaattggctgtgatagttccactcaccctcactgttcttggaaaagttcagcttgatcagggacctcccgtccagcttctggaagaagcacagttaataattaatgataatgaataagtaactgatgcacagagatgctagggtcagagacaggcaggaaaagtctctgactaggccaaccctgtgcagctctggacaaaagggaaggccccaagaccctgcaaggacctcacgggggctgcaggatggcgtcgggcagttgtgtttatgtggcacccccaccacgctctgagaagagccgtcacgggtgaccccgagcaggaggaccaggccacagggtggtgtgtgttatacttctgcagggtttggacgtctttatggtgagcacagattacttctaaaattaaaaagtgaacatatttcttcagctagagtggtgggacacacagagtccctctctgtcaccaggctggagtgcagcggcaacatctcagctcactgcaacctcccactccctagttcaagtgattctcctgcctcagcctcccgagtagctaggactacagacacacgccaccacaccaggctaatctcctgacctcatgatctgcccacctgagcctcccaaagtgctctgtcatatgaatatttaagaaaaacaaaacattaaaagtggggagaaagtaagaaatacaccccaatgctaagaatggttgtgttgggaagatgggactctatttttctgtttctggatgttttttcttttttcttatttcccctaccccaggtggcaggtaatgttttcagtttctgtggtgtgtctgcagtacagctcttccacagcaaactttcccataaaacaaagtctggacaaccggaggtgggaactgctgggggcggggctgtggggagaccctggaagggaggcagagctatgtgctgctggggagcacctcactcagggccacaatccagcagctgctgccacctggtgtgggctgggcccagctatgcctacccaggcccaggggagacacagcgggagcctcctggggctgggccctaagctggcagcaggtccttaagctgccctccccgtcctccgtgggccctgcctgctgctggccaacccaactgaccgcatctgctcctctaaccaccttcgttccttcctttgtcattcaactacccccacctccctacatcactacaggtgtggaggagaccaccagagggccagcagggtccctattcagacacaggacctgagcagagagactccccaacacaacaggctcctcctgagcccccaaaagtcacatgggccagccagcccttggcccaggaactctcctcagaggtttggctagcaaggctctgctgacacccataggtctggccaagcaagcacacagcaaggtcccttccagagcaggccaagggagaggcgcaggcacaggataaagacgtgtagggcgctcctgcagactcaccccaacatgatgcctggaacaaagaaatggccacacctccctgatgtaagccctaacagcgtggctaactgccagatcagactttgtgggtgtgggggccagcacaatcgacaagtttgggaaccccaaagagtacctgtgaagcaaaacacccaaagtagcaaaatgcatcccagctgcaaccaaatgacagaatccactgggacagcaggggccatgagggcagccgtggacaggaaaaccccacctacccccaccttgccaccaggctgctccctgaggccgacacccagccacacagggcacaggcaggcagcagggacctctgctgagaagagcaacagagaatgacttcccagactggggcacggaccttgggggaagcccctgggatccaatgtggctcccagcagcagacatcacagaaacagtcttcaagtgacaaagaccaaggaagaagagtgccctccctaaggaggtgaggccacaagccccctacccaagcatttgaaagagaaaagccacgggctttagtcgctggtccaagaacactcaaaaaccagccccctggccaagttccccttgtactagagagcagggaagccttggaggagcaccaactccatctacaaagagtccccagaaccctgcagcccccagaacaccacaagggccagaagagctgagacagatgggctgccagcttctcctgctggcccggtagggagggtcatattgtccagggagctccctcccagcggctccagcacagggagcccaccggagtcccgaccctccgtctcgcacagtttgagctcttgccccaggccataggaaagaggtggaggaatacatgcaagtaattccaacaggaagggcaaggtcactggtaaaatacactagatctccctcggaaccaggctgcataatgtccccacaaaactgatgctcactgggaacctgtgaatgtggcctgacttggatataatcaaaggtttatatagggtctttgcagatagaatcaagttaagacgaggtcacagctatggcccaagaaaagacatgcacatatatacacgtgcacaggccggaagcatttctggaaaagaatgggtgtggggagaggaggggaagactgtccctcctcactgggccccatgaacggttctctcccatgttcctgtgttcatgaaaaccaccagaacaaaaggagaagtgagaggatagcattcactagcatcactgaaactcctgcacagccacctacctctccattgctggggttggtcccgtacttcttaagccatggaacaatgttcctgaagggaagacagaacagaaagcatcaccagggtgcttaggcgccacctggtaacaacactgtggtcttgcagggctgcttccaggttagaggcctgtgaaggggtcttgcttcactttaggagaggaagagctcctcatcttgtctcaggaagttgggggatatttgtggatacataggtttcaaaatatgttcagagttattactgtagttatgtataaacaacaaaaactacaggtgaaaatgagtaagtaaatggtttgggttttttttctttgagacaaggtttcgccttgacactcaggctggagtgcagtgtttcagtcatggctcactgcagcctccaacccctgggctcaagcgatcctcccacctcagcttccaagtagctgggactacaggtgcacaccaccatggctggctaatttttgcacttttttgtagacacaggttctcaccatgttgcccaggctggtctcaaactcctgggttcaagagatcctcctgcctcagcctcccaaagtgctgggactacagacataagccaccactccgtcataaatgttgatacatctgtataattaaatactaagctagcatcaaaaactatactttcaagccaggcatggtgatggtgtgtgcctgaaatcgcagctactcaggaggctgaggtggaaggactgcttcagcgcaggagttcaagaccagcctgggcaacatagtgagaccctgtctcaaataaaaaaaaaaagaaaagaacaaagaaaaactatactttcagagaattctgaatcacacggggaaaaaagctctcatcacaaccaagtgaataaatagatccacagagtgttacctgtcaacacttcacagtgttcacagtgttatctcaatcatgttactacaaataagttcacaaaaaattagcatatttacagtggttatcttggatagtgggactgtggtaaaattttctttttctaaaataaggctgaaatttcctaaaaattcattttcaggccaggtgcagtggctcatgcctgcacttggaggggtagggggtggtctaccccattccaggcagtgacagcagtacctgacaactagagctgcctgcccaagggtcacagcagcattgctgccatgtccccaaggccccagctgttacttctgtgtgcccaagagccctacccaagggtaccaagggtccccttccttaatgggtgttgagaatctcacatttgttagatcaaaattcaaggaaaaactcacagtaagtcaaagacgatgccatcgggagtgcagactgggtagacaaagggctgcagagagagactgaaaaaggacagtcattcctggtgagttgccacgcaccctggtcaggatgtgggctggctgagactggcatggtgacctcctgaaatgctgtcccagggagccctctctgggcagcctggccacctccctctctcaccaaccttctcctccaactacaatagtgtttgtgccacccctggtgaaggtctagagcaggatccaacaccaaggcaagctcctaacatcatgacgaggactctgcatcttctcccaacatgaactgaagggccacatcttcaaggcacacttttacgcataaccccacatccacaaggggcagattcactatcagacaggatcagagaacaattacaagggaaaggtaaactcgcaaaactcttacctgcagtggtcaaaaggtaaacgacgaaaatttgtttgtgggagatctgtttaaaaatgaaataaaaaacagaaatcttactctgtaaagtatttcatctatgtgcacctgctagcaattcagttacagcttatgaaaaagttcatgcaaatttttaagtacagcaattgctgtggattaaaaaccttttaacagataaaccaaaacacttggggtacatcaaaaaagaacttactgggaaaagtgcatactttttacttccattaaaattatgacagtgctcttgttattgtagtcttgatagttttgacagctgaaaatattatcattctttttattccttataaacttgatagagaaaaaacatttaaatgtacatgtaattttgtattttatttacttatttattttttacttagctcccagcatcggggaatattttaaattacattttacaaaaatcaccactaagatgaagcaggttcttctatcttgagtatatttctctttcatgaactgtgtcctcagcccattcgtctaccatagtttccgtgttcttgttgtctatttttacagctcactgtatcctgaagacacagttccttaataccactcccccaacggggaacagaaagactgcatgccttacctggcttcttgccaccataaaagtgagtgtattcagcacaggtaatgtacctgaagaagagaggaagataatgctaccaccaccacctttataaagaggacaaagtctttggaagtgagtaatctttgcttactcagcaaatgcttactaaatacctactatggggcgggcacggtggctaacgcctgtaatcccaacactttgggagcccgaggcaggcgaatcactagaggtcagaagtttaagacaagcctggccaacatggtgaaaccacgtctctactaaaaatacaaaaattagctgggcatgatggtgggtgcctgtaatcccagctactcgggaggcagaggtaggtcgatcactcgacgtcaggagttcgagaccggcctgaccaacatagtgaaaacctgtctctactaaaaatacaaaaattagcatgggcatggtggcaggcacctataatcccagctactggggaggctgaggtgggagaattgcttgaatgtgggaagtagaggttgcagtgagccaagacggcaccattgcactccagcctgggcgacagagcaagactccatctcaaaaaaaaaaaaaaaaaaaaatttgagatgtctttcagtcctccagtggagatattaagtaagccactaattacacaagactggggaaagcagcttatagatgactgggaaattatatcacccacagagaatgtttatggaaaagaaacgtatgagatctgagagaagggaggagggtccagaaaggagactgggaaaagaaagaccgctgaagtcgatggaaaacaaagagcatgtgaaatcccagataccaaagaagggcttcagaaggagggagtggtcaacagtgggacatactgttgagaagcccaacaaaatgaggactgaggctgcccagacgcggtggctcacgcctgtaatcccaggactttgggaggccgaggcaggtggatcacctgaggtcaggagttcgagaccagcctgaccaacatggagaaaccccttctctactaaaaatacaaaattagctgggcatggtggcgtatgcctgtaatcccagctactcgggaggctgaggcaggaaaatctcttgaagccgggaagcggaggttgcggtgagccaagatctcaccattgcactctagcttgggcaacaagagcgaaactgcgtctcaaaaaaaaaaaaaaaaaatgaggactgaggattgaatactagatttagcaacaagaagtcgctgggaacctgaaaagagaggccgctgaagtcgagagaaaacaaagagcaggtgaaatcccagataccaaaggagggcttcagaaagagggagtggtcaacggtgtgacatactgttgagaagcccaacagttctggggcagttctggggtcgaaattctgacttgagtggtttcaagagactcagaaaacagcatgaagccactagtctctcacttgttcttaagagaaacaacacggcggcagcgggaggggaacgtgggacgtggggcacggggcacgggtggatttttaaattttatttattatttttgagacagcgtctcgctctgtcgcccaggctggagtgcagtgacacgatctcggctcaccgcaacctccgcctcccgggttcaagcgattctcctgcctcagcctcccaaatagctaggattacaggcgctcgtcaccacgccccgctaatttttgtatttttagtagagacggggtttcaccgtattagccaggctggtcttgaactcctgacctcaggtgatccgcccgcctcggcctcccaaagtgctgtgattacaggtgagccactgcgcccgacctggtttgctttaaattagaaggctctgcagcacgtttgcaggctgataggcatgaaccagaacacagcgagacgtgaagtacggaagaggtagagactactcattcaagggcgaaactcgcgagcagacgggggacggtccgggcagaaccagagtaaggaaaaccgggctgcgctcgagcccgcagctgacgtcatcggagccgcggccccgggagagcgcggcggcccgagggtcattaccctgactggagacagggcggcagcttccgggaggaagtgacctttgggctgtgctctggggagtagctgagagggaaggcgagcggcgcgcagtgcgggacaggcggttcactgaggcagagtggagcgccgctcccgactgcggctcaacttacattttgtccttttggtgctgtcgcttccccatggcggagcggcggcggcgactagcgagcacgaaaaaacaacggctgacaactcagaccatggagccgcagcc

SEQ ID NO: 10168 - DNA, 295 bp, Homo sapiens
ctggagtgcagtggcgcaatcttggctcactgtagcctccacctcccgggtttaagtgattctcctattttagccacccaagtagctggggttactggtgcccgccaccacacccagctaacttttgtatttttagtagagacagggtttcaccatgttggccaggctggtctcaaactcctgacctcaggtgatctgcccacctcagccttccaaagcgctgggattacaggcgtgagccgccatactcagccatgctgtgacttttaaaacatttcagtgggaaaatatggac

SEQ ID NO: 10169 - DNA, 271 bp, Homo sapiens
ttttttttttctttttttttgacatggagttttgctcttgttgcccaggctggagtgcaatggtgtgatcttggctcactgcaacctccgcctcccaggttcaagcgattctcctgcctcagtctcccaggtagctgggattattacaggcatgcgccaccacgcctggctaattttgtatttttagtagagaaggggtttctccatgttggtcaggctggtctcgaactcccgacctcaggtgatcctcccgcctcagccctcccaaagt

SEQ ID NO: 10170 - DNA, 3484 bp, Homo sapiens
  misc_feature (406)..(406): n equals a,t,g, or c
  misc_feature (2386)..(2386): n equals a,t,g, or c
cagggagatgtggtgctgcagagtgaccacgtgattgagacgctgaccaagacagccctcagtgccaaccgcgtgaacagcatcaacatcaaccagggcaggtgaggcgcgggcggcccccggggacagggcgggggtggcgagggggctgtgtgggcacccagggacagggtgggaaaccaccttagggttggggatctgcctccatggaaaaaccctcacccaccccgttcccccagcatcacgtttgcagggggccccggcagggatggcaccattgacttcacacccggctcggagctgctcatcaccaaggccaagaacgggcacctggctgtggtgagtggggcctgctttcccgcttatggcctggctgtgatagccaagccttccttggctgtgcttngcagagcccaggcacctcaccatgggccttcatccagaggccatcataccacctcttccatcccttggcccacccatgagggccagagagagcccctcagtgcagaaagttgtaaaggtggcagcacggtggctcatgcctataatcccagcactttgggaggctgaggcgggtggatcaccagaggccaggagtttgaaaccagcctggccaacatggcaaaacccatctactaaaaaaatgcaaaaggctgggtgcagtggctcacacctttaatcccagcactttgggaggccgaggtgtgtggatcacccgagatcaggagttcgagaccagcctggccaacatcgtgaaaccccatctctactaataacacaaaaattagccgggcgtggtggtgcacgcctgtaataccagctactagtgggggctgaggcgggagaattgcttgaacccaggaggtggagattgcagtgagctgatatcatgccactgcactccaggcctggggaacagagtgagatgtcatctcaaaaaaaaaaaaaaaggccaggcacagtggctcacgcctgtaatcccagcactttgggaggcgaaggcaagtggatcacctgaggttgggagttcgaaaccagcctgaccaactggagaaaccccatctctactaaaatacaaaattagccgagtgtggtggcgcatgcctgtaatcccagctacttgggaggctgaggcaggagaatcgcttaaacccgggaggtggaggttgcggtgagccgagattgcgccattacactctaccctgggcaacaagagcaaaattccatctcagaatttgtatacaaaaaagttagcctggtgtggtggcgtatgcctgtagtcccagttgctcagaagcctgagatgagaggattgcttgagcccaggaggttgaggctgcaatgagacccaagatctcaccactgcactccagcctgggtgacaaaatgagaccctgtctcaaaaaaaaaaaaaaaaaaaaaaaggcagcacggcaatgcagggaagatacataggctgattgggggtgccaggagggaggacaggctcacaggctcacgctggccagggcggtgggcattcctatgggagtcaggtctgagtctccaggatggagaccactaggcccccaccactcctgcctgcatcgaacccatgaatctgagcgctggggctgggtgcggcggctcacgcctgtaatcccaactcttagggaagcagaggtgggaggacagcttgagcccaggagtccaagaccagcctggacaatatagcgagaccccattctccataaaaaggaaaaaacaaggacgaaaagaaaagtctgagtaccggggcccccgtctgctcccctcaccacttggccgtctctctccgcccccacaggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcnttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaatgtggtctccttatgaatattaggaaacgaagagggccccggaaggcaaccaagggcctcgtgttgcaggtttttctcgagacagtct

SEQ ID NO: 10171 - DNA, 105 bp, Homo sapiens
ccagcactttgggagactgaggcaggcggatcacttgaggtcaggagtttgagaccagcctggccaacatggtgaaaccccgtctctactaaaaaatacaaaaat

SEQ ID NO: 10172 - DNA, 331 bp, Homo sapiens
ccaggctggagtgtagtggtgtgatcttggctcactgcgacctccacctcccaggttcaagtgattctcctgcctcaacctcctgagtagctgggactacatcatgcgccaccacgcctggctaatttttgtatttttagtagagattgggtttcaccgtgttggccaggctggtctcgaactcctgaccttgggtgatgcctcccacctcggcctcccaaagtgctggggtgacaggcatgagccaccgtgcccggacacctctcgttcaaattctgttgcaagtgacaaacccagtccaaactggcttgggccaaaaaaaggatattta

SEQ ID NO: 10173 - DNA, 790 bp, Homo sapiens
ggagccataattgcaatgagaaggggagctgtggctggctctgactgccctgcttcccacattttcttttaacgagtgtccccacgtccccaccgcccctcccccccgacactcagatcccttcagttcccactggctgccattttcccttgctctgcagcctccaactccactccacttaagagaacagactggagactgctggaggccctgaagtgatttattgcttagcaggaacttcactaaacttcccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaagctcaag

SEQ ID NO: 10174 - DNA, 537 bp, Homo sapiens
cccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaagaaaaaaaacaaaacagagctc

SEQ ID NO: 10175 - DNA, 275 bp, Homo sapiens
acaccacgtacacagtcacacacacacacaccccacacatgcacacgtcacatcagcatcgatcacacaccccactcacacacaccacgtacacagtcacacacacacacaccccacacatgcacacgtcacatcagcatcgatcacacaccccactcacaccacgtacacaaacacacacacgccccacacatgcacatgtcacatcagcgtcgatcacacatcccactcacacacaccacgtacacagtcacacacacacaccccacacatgc

SEQ ID NO: 10176 - DNA, 529 bp, Homo sapiens
ggaaaagattacttctataattcatcaaggaaaatactaacttgctcccccagagagctgggggaaaacacattaatataaatataattgaggagtggaaacaaagtctaggaggagttaaagcataagtatcagcctggatgtgaattctaatataggaattagaattcctatattaaaaattgtattagaaacctttactttcttgtgatttctgttagttcagtaagtaacctttcttggaaggtctactaattcctttcaaaaaagatatttattttatatcttactataatatactaagcactgttattgctagggtgttttgaaggggcaggagatggtatttaaaactgagttgcagttctaggcagttaaataaaatccactgaccagaaaaaaatatgtaaaatgataaggcaggataagtattcactgccaaaaagtcaacaaagaaaatagtaaggatttatgttcagcaatccctgagattaaaatttaaaataaataaatagggatagtacgattt

SEQ ID NO: 10177 - DNA, 826 bp, Homo sapiens
cagaggttaaactgagaggctcgtaattccctgggtcttatcttttactttaaaatgaaatggcatgtgctattttctagtcattagcatcattctctgtattttcagacgatttaatagtcaaatgtatatgattctcccatgttttttaaaaaaaaatcttagtattatgtgaaatacaaaactagcatctcctttagttacagtattttttacttagtctaaaattattgtgattgtagtcattaattaatgtcctttgctattatgaaaatgaagctgtttgctttagtacttttacccatagaggaaatattttgtcatttataaagccgtattgctactacatatatctaaatgactttttattttttaattgttcttcattaattttagtgaatcttagtatgtgaatgtattactggaatatgaagcttaaaatggtttgttctatctcaggaatattgtaaaaaacatagttttcatactacctatgtatttctgtgatgtgtcttgtaaagtatagtcaaataaattattaataagattcatcattttagttatttctttttctcatactctacactattgacatctattttctcccataccgtcacaatttcacctttagctagttcaccaaaaagcccaatattatattttcatttgactttaagaaataaaaagaggtcgggcatggtggctcacagctctaatgccagcactttgagaggccaaggcaggagggttgtttgaggccaggagttcaagactagcctggtcaatgtagtgagacctcgtctctaccaaaaaaagaaaagaaaaa

SEQ ID NO: 10178 - DNA, 826 bp, Homo sapiens
cagaggttaaactgagaggctcgtaattccctgggtcttatcttttactttaaaatgaaatggcatgtgctattttctagtcattagcatcattctctgtattttcagactatttaatagtcaaatgtatatgattctcccatgttttttaaaaaaaaatcttagtattatgtgaaatacaaaactagcatctcctttagttacagtattttttacttagtctaaaattattgtgattgtagtcattaattaatgtcctttgctattatgaaaatgaagctgtttgctttagtacttttacccatagaggaaatattttgtcatttataaagccgtattgctactacatatatctaaatgactttttattttttaattgttcttcattaattttagtgaatcttagtatgtgaatgtattactggaatatgaagcttaaaatggtttgttctatctcaggaatattgtaaaaaacatagttttcatactacctatgtatttctgtgatgtgtcttgtaaagtatagtcaaataaattattaataagattcatcattttagttatttctttttctcatactctacactattgacatctattttctcccataccgtcacaatttcacctttagctagttcaccaaagagcccaatattatattttcatttgactttaagaaataaaaagaggtcgggcatggtggctcacagctctaatgccagcactttgagaggccaaggcaggagggttgtttgaggccaggagttcaagactagcctggtcaatgtagtgagacctcgtctctaccaaaaaaagaaaagaaaaa

SEQ ID NO: 10179 - DNA, 817 bp, Homo sapiens
tgagaggctcgtaattccctgggtcttatcttttactttaaaatgaaatggcatgtgctattttctagtcattagcatcattctctgtatttccagacgatttaatagtcaaatgtatatgaccctcccatgttaaaaaaaaaaaaatcttagttttatgtgaaatacaaaactagcatctcctttagttacagtattttttacttagtctaaaattattgggattgtagtcattaattaatgtcctttgctattatgaaaatgaagctgtttgctttagtacttttacccatagaggaaatattttgtcattaataaagccggattgctactacatatatctaaatgactttttattatttaattgctcttcattaatggtagtgaatcttagtatgtgaatgtctgactggaatatgaagcttaaaatggtttgttctatctcaggaatatagaaaaaaacatagttttcatactacctatgtatgtctgtgatgtgtcttgtaaagtatagtcaaataaattattaataagattcatcattttagttatttctttttctcatactctacactattgacatctattctctcccataccgacacaatgtcacctttagctagctcaccaaaaagcccaatattatattttcatttgactttaagaaataaaaagaggtcgggcatggtggctcacagctctaatgccagcactttgagaggccaaggcaaggagggtatgtttgaggccaggagttcaagactagcctgttcaatgtagtgagacctatgtctctaccaaaaaaagaaaagaaaaa

SEQ ID NO: 10180 - DNA, 613 bp, Homo sapiens
ttctagtatatgctctgttttgttcataactgcctttatcatcttacttggggcatctcagaaaggtgtgctttataactgtggtctaaaaggttttatataattgagtactgtaaatgtgtataatactctatagcttagagtgttatggtgtatatcatctgtgtttcctgtttgttctctggtcatttaaatgttccatgaaatactttagttccttgttaatatctttgaaacaagtttagagtaggaatttaagacactcctagatttatttggagaataaataagaagctatgattcttttttaatatttccctaaaagaattaattttggtggaacaatgttaagaaaaaataagatatttccaaagaagttgaggtgcttgggatgagaggctttaacagaatttttatacctcattctagtaaagaaagattactcatatgtcagagctgcctaacttttgtcaagccataaagggcactgtagaagctgcagtttacttaatcaaccacagtgtcctaggaaaattaaaaatgaagttgggcactgtagctcacacctatactcccagctctttgggaggctgaggcaagagggatcacttga

SEQ ID NO: 10181 - DNA, 33249 bp, Homo sapiens
gagtttggagcctcttccatcaagtggacctgattttggaggattaggagaagaagctgaatttgttgaagttgagcctgaagctaaacaggaaattcttgaaaacaaagatgtgagttttctgttgaaggtcttgatagaattgttagtggaaacattcacttccatacaccactagggagatgtaaaggaattaacctgtttccgtgcctttatcaaagaagagtttgtaaccacctacaactagaaaaactgatgactcttagaaaaacagtttctatttttaaagaagtcgctcttccttggtgatttttatgtgggaggtttagacaaacacacttttgtatttatgacaaaaaccaaaaatatatcaaggacaaactcaaactatacttaaatttatatttccattccctactcccagaaaaaagactgtgggtctcaaatgaaacttttcctaaatttattacctttgaaatttgaatatgcttttccagttcttgaagagtttactctctagcgagactgagaggtgagggccagtttgagtcagcatttattgtgccacctgaaatccctgcggggtctttagaggatgcatacagttttgttttgttttttttatttttaaaattttttttgagatgaagtctcactctgtcacccaggctggagtgcagcggcacaatcttggctcattgcaacctctgtctcttgggttcaagtgtttctcctgcctcagcctccaaagtaactgggactataggcgtgcaccaccacacctggctaatttttctgcacatagttattaagtcaggggtcatggccagcattcattcacaggccagtgctcagcatgcatgttaggaaggacagaggggttgtctgtggcctgctcgggtttagggctcacctggtcctgggtcatctggctggagaggatttgtagctcttgttcacagaaagtacataacgagcaaaggggaagtcacagtgactggttttttgaaaaaatgtgaaagatagtaaagtccagaggtaagaagtgtggattattaaacttgaagaaaaccttgacattaattaaaccttgacattgtctttagtcttgacacctaatctgtttgcctcatgtcatccctaatactgtccctgtgtgacttttaggtggttgttcaacatgttcattttgatggacttggaaggactaaagatgatatcatcatttgtgaaattggagatgttttcaaggccaaaaacctaattgaggtaggtgtggtctctacatggtgtgctttcccagtctcttctgaagaactcgtaaatgtccccatgtgaaaccacagagcaccctgcgcccggcctctgtgccggagatctgcctcctaccccacagggagccttggcacccccaagctgaaccccccgaattcctgtggtgcctcctacaaactccatgtattcgcatttgccttttcctcctgtctcttatcctggagaaagaagtgtctgtcctcttgcgttcctcataactctcccagcgccgtaatgcgagccagtggggttagtgcacagccgttcccaggcaccgcgctgagttcctgagagtgtactctcccttgccaaccccgtggggtgggcgcttatctgggacacactccctgtctcctcagggccctggctctgtctgtggagcagtctccttcctgcactgcaccccgtttctcatctccactgtgggtggtttcctctgcctttctgcccgtgggaccatattgaacatgcccagacagaggtcaccagcaacttctttgtggccgggtccagctggctcctttgtcttcatttcacttgaccttgcagcagcagcagtgtttggcactgtggaccattcccacttaaaaaaaaaaaaaaaaaagaatcttttttcaattttttttagatagggtcttgctctgttgcccaggctggagtgcagtgacacaatctcagctcactgcaacctctgcctcccaagttcaaaggattctcacacctcagcctcccaagtagctgggattacagatgtgcaccaccacacctggctaattttgttgtatttttagtagagatggggctttgtcatgttggccaggctggtcttcaactcttggcctcaagtgatccacctgcctcggcctgccaaaatgctgagattacagccatgagccaccgtgcctgcccaaatttgtatttttaaaaaattaaagtaacatgtaagcacagtaagaaggaagcatagaaaatcaaatggtacagaagggtattgaaatgaaaaggacaattttccctaccccggccaatcccagtctgctctccagaggtaacgtggctgacagtttcctagatatgttgtacgagtgtataaacatgtatgttccttaaacagtaatgccattctctacatttttttttcttttctgacataaattatggagatcttttcacatcagtacataccagtctgttggctgtgtggtacctcgttgtacacactttctaacttttttaaatttttttttctgagatagggtcttgctctggtgcaagtcctgctcaggctggagtccagtggcgtgaacacagctcactgcagcctaaacctcttgggttcaagcaatcctcccacctcagcctcctgagtagccaggactgcaggcacacatcaccatgcctagctaatttttaaagtttttctgtagagacggggttttgccatgttgtccaggctgatctggaactcctggcacaaggggtcctcccaacttggccttccaaagtgctgggattacagcatgagccacctcacctggccctctacattttattataaacagttctccattgatgggcatttaaattaattttcactcttacaaacaatgctgtactaaacatcttagtgtgtctttgtgtacattgactgtgttttaggataaattcctggaagtgggattcctgggtcaaagtgtgcgcactctgcagtgttcactgatgcagccgtattgctctgcaaagagattgcacaagtccactgtcttttttttttttgagacggagtttcgctcttgttgcccaggctggagtgcaatggcgcgatcttggctcactgcaacctccgcctcctgggttcaagtgattctcctgcttcagcctcctgagtagctgggattacaggtgcacaccaccacacccagctaattttttgtattgttagtagagatggggtttcaccatggccaggctcgatttgaactcctgacctcaggtaatccacctgcctcggcctgccagagtgctgggattacaggtgtgagccactgcacccggcccacaagtccactctcttacagcagtccatgagacggtctctttcccaaaattgggttttatcacaatttttaaattcttgccatcttgttagaagaaaaatgccatctcattgttttaaattgtatttatttaattatgaatgagatccagcatttttttttttctgtttagtgttcattcatatctctcttgtgaattaacttggtgtcttctgtcttccattgggtcatttggcttttgttgatttgcaatagctctttgcatattgaagaaatgatcgctttgtagcctcagctgaatgcacctgtcctgctttgttatttgcctttgaatgtgtctgtccctcttcttgcgcttgcctcttccctgggctttggtgaccattttcctgggttgctttttctgtctcatcacagtcattctcaggctctgttgtcagctccttttccctgtgagcatccttaagtgttgcttttccacaaggatcagtctcctgggtcatctcatccacatcccaggtttcagttacagcctgaatgcggagggctccccatgctgtctttctagccagctcctctgtgttgagctgtagccctgactatgcaactgccgactcatcgtttcctcatggcattgccacagccgtctccagctccatggggctgagacctgaagtcatcccttttccatctgtctgctctgcctgtcttcccatctctattcctgacttctctaatggtgttcagcgctagcccagtgctaagcgccgagctgcagtttcagtagcttctttcttagcctctttcttcttctcatgcactctacctaggcagtggcagtgtcctctgacccctgcctgtgaaatgtctccagggtctgtcctcccctccaataccatggcctgcactgggcctgccttcaccctagcccctgaggctgttgccagagcaccccctgcatccttcacctgcaggcttctcccatctgggcagaataccgcattcgtctgtgtgatccgttctttctcacaaggaaatgtgatcctttctgtctcctgctgacagttctacagtgactccctttcacctgcagggtggaatctcaactttccttatcacacgagggcctttccttctctgtgtcctcagcacttgctgccttaccttccttctacctgtccttccaataagaatggactccgtgcatcagaaggaactgctgttgacaacaaagaaaggacacaaagttgaacatttctaacagtggttagagatggttagaaaggccgggcgtggtggctcatgcctgtagtcccagcactttgggaggctgaggcaggtggatcacctgaggtcaggagttcgagaccagcctggccaacatggtgaaatcctatgtctgctaaacatacaaaaaaaaaattcgcttggcgtggtggtctgtgcctgcaatcccagctactcagaaggccgaggcaggagaatggcttgaacctgggaggcagaggttgcagtgagctgagattgcaccgttgcactccagcctgggcagcagagcgaaactctgtctcaaaaaaaaaaaaaaaaaaaaagaaaaaagaaaaaaagaaaaaaaaagaaagtaaagaaatgaatagaaaattgaaacaccacaagaagatgtgcatttcttcctcaaagggagagctgaaaaaaaaaatgaaaaggtgtgcagacacacgtgtctttcttttgccagacataaccactgttcacgattgtgatctcttccagcacaacgttctagactgtgtgttaggtttgtgtatctgcgttagtcttgttgtttatacgaaggggattatatgttgcacactcttgatgccaaggcttggttttgcacttgtgaatgggcatttttgttgcccctgtggtgcttttcccttctgtcatgtggctggtcttggtagtgctctctgctcagtgatctgacttagcaccgaatggtaaactaccagcctcgccgtgtggctgccatttgctgtttctgtatcgtagaagaatatattccttgtttttcttcccccattttataggtaatgcggaaatctcatgaagcccgtgaaaaattgctccgtcttggaatttttagacaagtggatgttttgattgacacatgtcaaggtacatattgtggtgtagtatctttataattccctttctgtccatcagagaaaagctgtttttatggccagatgcagatctgggcagcagagcactgctccctgctgtgtagaacctgaaagttgatcaaacaggtagtccttgagttagcagtctcagggaagggattggattttttgtttgtttttggagaggggtcttgctgtattgcccaggctggtctggaactcctgtgctcaagcgatctacctgcctcagcctcctgagtagctgggcttacagttgcgggcctggatttttgtatgaggccggggaggagtggtgaactttgaagatactgttgtgtgaagccctggactccacgggggcctgagagtgactctgaaggagggggccaggcttcgttcacatagcccagcccagcactgtgcagacccccatctcagtgtatgctttaaaaagaggagggaatccaatttccattttagtttttgcccattttcttgttgctgtgtgatactgggcacgtctctgaacatttattctttggctagtgagcacctgcttcgaggccagccctgtgcaggccccagagggagacacagggcgtggtctcctcctgatgggcttcggtcatagcagcacacagggcgtggtctcctcctgaaggggcttcggtcagtggggctgggttgggggcagaccagtaagtgatggcagcacagtcgctatgttgtgctgtaagaggctgagggaggagacagttcacctggccagggcatgagaaggggatcagagagggtgtccctgaaggggcgatgtctgagctgagacctagaagatgcatctgagcgagtatggggagaagggctggtagtgaggtggggtgaagaatgttctggggacagagatagcacttatcaggcccacgccaggggagagtggctcgctgggtggaccgcaagtgtaggaagagctggagtgcaggttgggggaatggagtgctggaagacaaggaagaaaagccgtcaggagcccagaccgtggtgggcctaacatggcgcggtagagttcccactttagtcagaattcagcagacaccattgaaaaataaaatttggaatgaatctgtgaatgagtaactcttcagaattgaatggggggtaattttgagaaggcctagataagacaatataggaaaatgcttgcaaaaaataaggtgctagataaactaaggacattttcattatttggagtatagtttcagccaacactaacagacctaaaagaacagtggcttagacaagagagaagtctccatctctccacacagctgggagactgccaagggctggtgtggtgctgcgttccctgaggtcaccttgggctggcgtggtttcctgtggttccctggggtcaccttgggctagtgtggtgccttgttctctgaagtcaccttgggctagtgtggtttcctgaggtcaccttgggctggtgtggtgcttcgttccctgaagtcaccctgggctggtgtagtttccccccgtggtgtcttgttgctttgtcatccctagggtccctgagtccctctgatggctgagcaccgtgtcctcattccagtattggaggagcacaggagattgagagggcttacccctccctttaagcacctgtcctaggtgttgtacacggcactgctctcatcccattggccaggacttaatcacttggccacacctaggtgcaggggaggctgggaagtcactggacttgagttaataattggtgtatgggtttatcagttgtgacaaatgtaccacacatgcgaggtgttagtaagtgtgtgtcggggtaaggagaggttcatggaaactctttgtacttttgtagtttgtacaaaaactttgtactttctgctttatcttttttttttacccgcaacccactgttgctggcttcaattctttatctttctgtgcgcctaaagctgctctaagaaataaagtccactaaataaaaaataaagtaaaataaaaaataaaaaaagaaaaagaaagaaaagatggtgccaggcggggtggctcacgcctgtaatcccagcactttgggaagccagggcggctggatcatgaggtcaggagttcgagaccagcctggtcaacatggtgaaaccccgtctctactaaaaatacaaaaaatattggcagagtgtggcggcgggtgcctgtcatcccagctactcggaaggctgaggcaggagaattgcttgaacccgggaggtggaggttgtggtgagctgagatcatccgactgcactccagcctgggtgacagaatgaggctccatctcagaaaaaaagaaaagacagtactgaggctccaccctagaactgttggacctgagttcctagagcggtgcctgagcatcagcatattttgacagttgcccagatgcgtctagatgtccagccagggctgagcacccctgtgtacaaggcaggagtcgcctttccttcctgtgagaggccactcattcctacagagcccagcccgctctgcacaaggcaccccagggccatggtgggtcacgaggtggctgcttccagctcagacccaaatcatacctggtgcgggggaggacagacatgcctcttacacacagtaacacagtaaacaatctcacacttatcttcgagggttactgacacccctattgtcatgtgagttccccattttcatgtcggttgaattgagaacccaaatattttcaaggacctctctaataggagaacagattcctttagcaaatattgtttgcttaagtttgcttaagtgaataatgctgcttatagttatctccttgtagcaaaggtagattgtttttgttttttggtttttggttttttttttagagacagggtcttgctctgtcgtccgggctggaatgcagtggcacagtcatagctcactgcagcctccaactgctgggctcaagtgatcttctcacctcagcctcccgaatagttgagactataggtgctcgccaccacatctggctaatttttaaaatttttgtagctatgttgctggggctggtcttgaactcttggcctgaaagtgatcctcccaccttgtcctcccaaagcactgtgattacaggcctgagtcactgtgctcagccctgtttattgatatattctaccagagaaactagaaacattattttttggtgtagaggtgtgcaatattttgattttgtgtgggagtgttcttaaacgtttctcatgattatattattttctaaaggagattgtaaaatagaatgaaccttcagattgctttttgtcttttttagcaatgggaacccaaagtaaaataacatcctggctgtcttattgtttaatatttttttatttaggtgatgacgcacttccaaatgggttagacgttacctttgaagtaactgaattgaggagattaacgggcagttataacaccatggttggaaacaatgaaggcagtatggtatgctacaggctttttactttcttatattggaacttagagttgggaacttttacactatgactgcattctaaaagctgatgatagtttcaaaattcggtcatttcatttaccttaatctgttgttatttgtggtttctctttaatcaccgtagaattggtgataatatgttttgggttgtttgataacaatgttaacgttagtaattaggaatgatttggagaatgttcatattaatagtctcttgttcaaattcctttaaactctaaatctgtaacattcttgagcctcacgggtggcaaggttagcttgtcccttgcattaatcaggtttgaatgcaggatgtgagcactcagcagcggcatgttttaaagaatgaaagtgattacaaatgaaagactagatctgtagttagcatcttccttctgtttttatgaaagtcccttagctagcatagtctttatccaatccaaagttctcattccttcaatgtagaccactgctattttttttttttcccctcctaggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaagtaggaagcccaacagatcattgagtacactggcctgatagaaaagttaaaataggtggcttatttgtgaaaagaaccatgacagaatcagctgccacttctgcagtgaccacatgctgtagatttcctcttgaagatgagccctacgggcgtagtgttaagtctgttgatttaaatgtgtgcaagttctaatcactgtttcagcttttaaagctctatcccattgtctcctagtttctctgtaaacttatataaagttactggacagttcccttggagctcactgcgggagacggacagaggaatgtcagctgagtacagtgtgagtagcatttcagtccttccctctgggcttgggggaaaacagggtggctttttcactgattcccaaaggcagcaagagggcagcgtggaaagcacaggccctctgccctccgcaccaggtacctcctggccaggtgcctcttctctagccgagtacaggctacagggacccgagagtggctgatgcccatgttagcagctccttaacctggtcctgactacccgaggcaccattggttgtccctccccatatgtgtggagactgacagtttctcatagtcagcagagttggtcagatcactggaaggtttcttttttgttgttgttgagacagaggtttgctcttgtcgcccaggctggagtacaatggcacgatctcggctcactgcaacctccgcctccccggttcaagtgattctcctgcctcagcctccgtcaccgtgcccagctaatttttgttatttttagtagagatggcggtttccttatgttggccaggctggtctcgaactcccgacctcaagtgatctgcccgtctcagcctcccaaagtgctgggattacaggtgtgagccactgcacctggtccggaaggtttcatttttggttcacacctaagtttacacctagaagggtgtgattaaatgccaccattggaattcgtatcatttggcctttttggggctttatgataacctgctttttttttttctccttcctttcgccactgttcctgactcctcttgttctgggctttagttcttgcggagagccctgagatagaatactatgtaagagtcgttccccacatgtggtcttcagaccagcagcatcgacctcagctgtgggcttgttagaaatgcacattcgcgggctccaccttgagctgccaagtccgactcacagagagtggggcccaggaagctttaagtgtgctctccctccaagaacccagcagaagccctggaggcgaccacctgggcttgactcccccgtctcccttagggctgtgcgacctcaggcaaatgactcatctgtgaaatgaaggacaggagcgcggggtctcccagggccgttgtgagggttggatgagaggcgtggtaaagctcctgatgcggcgcgtggcgcagtttaggtgcttgaggtgcgttagtgccccaggcctctggtccttgcagaccaaggccatgagaactcagagcacacagagctgggccaggtagactccaggttcaagatggagataggagaatccaggcacatttgcactttcatttccttttctccaaattttcttgtctggaagggagcagccctgagacacctttctgctttgaaaccgtcctcggatgccctctggtggggccgtggaggggaaacctgggccacatgctgctctctccagcctgctgtcctccagcaggtctccaggtgcctgtgtgcacccacagtggtcgggctcccgggagcttagccacccttctccccagtgtcatgcttcatttctttctaagcctttttaaagagcagatttttaggagagtagaaataccttattttttcacaaggaatagcagagatgaaagacaccaaagtgtagactcggccctcgggtgggtgcaggtagaggggaggaggaaaggggagggcagacaccttgtcgccggcagccctgaagctgagctcctagaggaacggaccagatcatactcagtggtatccttggggcccatgtcaggccttctaaggaatgaagaaatgatttaggaagctctacacctcccgtaggaatttgggaaagtgcctgaatcccaggtggccctaagtgtagagatggtggctgtgcaggctgcccctcctgtaccatctccccagtgcctggcatggtgccctgtgggtgctgaggtgggtgcctctcaccatgaaggcgggatggagtgttctgggcctgctggtgacccacttaccccatggcctggagttcaattgcaagcctgagggctagagagggcccagcatgggacaccccctggggagtatggggtgacgtggcttccttgtgagagttaaatcactgtcctaccacttctcaaagccaccaaacatcgttcactgttcagaaaacatttctctgagatagaaatctaagatgagctgtcctggcagcaggaaagagagcgtcaggctgggaagcaggtgccacctgcttggaccccagaattcacccggctcaggcctctgctgcaggaaggatccctcgcctcccacataactctcgtctctgccaccttctctctgggccggtgcaagtcgctgggttgccaggcctggcttcagacagggtcgggtggaccaggtggggtttgcgccatcagatcatcttaggtgtcttacccattacaaagaagtgggaaagagatagcacctgtcgatgatagagctgcctgcagccctcagaccagccctgtccctcacctggggtgcagtcctgctacttagagcagtactgcctttgattcccttcacagctttccccctttcttcctttgtccttcttccctctggttttctcttccccttcttctcttcttccccttctccctctctctcatcattaaaaaaaattagatatttagttcattgtttcatgatgcttcattccaaaaaatgatttgcaacaagttcctaagtatgtgtggtccggaaagatgtctgatctccatgttgcagtttcccatatggaagaccagccacactgtcaagtgggaaggcgtatggcgagaactgggctgcctctcaaggacggcgtcatttgctgttcgaaaagaaagcggacattcactgaaatcatctctttcggtaacggtttctcttagttggagtaaataattttgttgatggaaccatgctatgcattgggaaaacagtctttgccaatatcagggctgactgagaagcgtcacccagatggggtgtccacagtggcggcccccactccccgagggcttgtggtgtcctgcctcgcgtggtcctttccgaataatgtcagtggtaacaggaagaggtgtgcttcagagctgactgtggaatttcagctttcaaaaagaaggaggaaccaggctgagccgactgaggccagggcgtcgagctccttgagagaacgaacccggtggtgggtgttcaactcccacgtagtgagcaggaatcgtttattcagttgaagctcaagtctcagtgtggacgtctcagtgtcctcctatgtaagatagggacagtcaccctcacttcctccaagggctctgtgaacacgaaatgacatgatagttgtagagtgctagcgtggtgtggcccacgtgctgtgagtgctcatggttatctaatagaacttcttaaagtgaaaatatccccattcaaatttctttcagcacgccatggtcatcgattctcggaattcttccatcttaccaaggagaggtgctttgctgaaagttaaccaggtagtgttgtttcacctgtgacccctgcagggtgaggggagccaaactttggacagtagataaagtcccggtgggctgggtgggcctgggggtgggcagtcccacagagtaatcgcacatgcagtatcgcttttgaaggtcgccagctccactctcagggcttccagcccggaaattgctccctaccccctgcagttcagtcttgtgccttcacagaacccaaggtgggggtaaggctgtggcatccttgatgagggcctgtaataggccaggaggagggctgtgacttggtgttacctgggagagagtgtccgaaggcaggggtcacccctcaatggctgcagggcaggtgcatcgtggcagcaggaggtgctggaggaaggtcttcaccaccttagaggagcgtgcttctctgctggtgttggaggcgggctgttagtctgtctttgggttgccctcttgttggaggcagggggatagttctttactgtaaggtacctacaaggtgcaggcacagtgaggagcccaccttggtggcttgagagtgagggcagcaggggctgcactgaaccttgaggcttccccgagcagctaccctcgctctggccggtggtacttaggtgttgtcaagcagggcaaaagcccgggggtgcctgaccttcagtgtcagaggagcaattagaaatcaggtttttatacaaaatagcccacattgtgaaaggtcagctgagtttttccccaaatgccgatgaagccaacgagccaagccgtctgtgctgagctctgtgttcagacactcaggctgccagtgctccctgcacacagccagagggcagcctctgcacctcttggatctgctgatcctccatcccagtccgtccactgttgctgtccgcaacaattaggatgtggcttctaggagacagaattttctgtagcctttaaaaaaatacaaaacggcaaaattaaatcctgatgcaaaaacatgattctgtagcccctgtaataagtctgtttgctccctttgacctgagtgctccttccctgcaggaactggcaggctacactggcggggatgtgagcttcatcaaagaagattttgaacttcagttgaacaagcaactcatatttgattcagtgagtatctaacggatgctggcacctgcactgtcagcccttactttggggatcttaccacagaatcttagctcctgaatatctaaagcacagagtggaagcctgggcggtaatgcttaacctttgatgtttccagtttagccagatttgcaggtagtctggggagaagccataaatattttcttttaaaagtaacctctgatggccgggcgcagtggttcacgcctgtaatcccagcactttgggaggctgaggtgggtggatcacaaggtcaggagatcgagaccatcctggctaacacggtgaaaccctgtctactaaaaaaaattagccgggcgtggtggtgggcgcctgaagtcccagctactcgggaggctgagacaggagaatggcatgaactccggaggcagagcttgcagtgagccaagatcacaccactgcactccagcctgggtgacagagagactccttctcaaaaaaaaaaaaaaaaaaaaagtaacctctgctaatcgttacacataggaccatgagagagcccctccccgtttatcatctcagggccttggaggaggggtggctggaggacagaggggtgtctcctgcccttgaaatgctgttccgtggaccttctgagtcttcactttgctgggtctacagggctctgggtgctttcagaaatttttttttttttttaatctttagtcctgttgggtcagtttctcctgattcactcaggagtgaggagaaagtgactggattctggtctcgccagaggagccccaggctgggagggcacctggcatatttctcacgtcttcccagcacccagtggctgggggcagctctgccctgcctttgctgcctaggtccttatctaccttaaaacctgggggcaaggattgagtgtaatgaaatggtgcatgcgactgtttctagagagctcattttaaaataatttgttactgcccctattcagcccttgactctgcactttgaacttggttcctgccttcctctgcccctgccaccacaggcctccttgttgtccggcacgtgagcccatcctgatcccttctgcagcactggatgttgtcgcctgctcgcctgttctcactttatctctcttgttttcttgactcatcattgctgcgctcttccactcctcagttttctcttctcagggccctttctgcctcataggcatggcttgcccctagatctctgttgccatctccccaccctgcttctctctgggacagtctcctacagccctgtggctgcagctgctgcctgtgtgtagcaactctggttctcctgcctccttcctgggcccagattcaagtgctcctggctgtctcagcccctaccttacagacacctcatatcaacagagctcattgccttccccacaaatctgtacccacgcctgggctccccatccactgacctgcacagtgcacccggctgcccttgaacttaactccctggctgctctcagtcctcccctcagccacctgccacccactgggcgctgcccttcctcctctcagcactgctcatccgcactgaaccaatgtcgcgttctgagtcgtctctgctcctctcctactccctgccttccccttcccccctctacactatggacatattagtctttttgagtcgtctttactccccttccactccctgccttccccttccccttctccacactgcagatgtgttagtgtttctgaaacacaagccttaccatatcactttcctacacaaactgcttgtgctgttagggtgcctgtagcccttgatccttcatcactgtgcctgtctcatgcttcggctctgtggaaatactttttgtttcccagaaggcattggctcaccctgactttcaggcactcgtattcactctgtctgccgctggctgtaactccctttttttcagttgtttccttggcctcccactccctgcctttaagactttggtataggtgtgtctcctgcaagccttcttcaacctcctagatggaagtgggggctcctccactgtgcccgtagctcctgtgcttatcctgtggtagtgcccatccatctacccacccatttacccatccatccatccatccgtccgtccatccatccacccatccacccatccacccacccacctacccacccacacatccatccatccatccatccatccattcacccacccacccacccacccatccatccaccagtctaacacatgtatgctggctgccaggcactgtccaggcactaagaatatatcagtgaacaaagcccaattcctgctctcaaggaacttccattcttgaggagggaaacctataagctagtatctttatatatcattgaggaggcggtgacaagtgttgtgaagaaaaataaagcagaattaaggggtagaaagtgaccagaaggggatgccatctagttaggatggtcagggagggtggctagtaaggcaacccccgagcacagcccagagcacggtgagggagcaagggtaggacagcgggacacctcgggcgggagcatgaattccaagagcagtagtggcaggagggccttggaggccggatgtgggctcttgcttccactctacatgagagggaagccctggagccttctgagcagagtccggacacctggctgagaagaaaatgccagctgctgtggggacagaagcttgtccttcctacagaagcttctgagaaagccatttctgagcagcttggagggacataggcatttgcaaggcagagaacgtgtgaggctcggccagccgcccgaaaacatggggtgcaggggagcaggagagcctctacctggttgaggacattgttgagaaggttttgtggcatgaagatgggctcactgagccaagactggctactgcctcctgccctgtaagagacaaggctctgtccttgagagtggggttgggagtgcgtctctgcattgggggagccttgcagccggtaccttctttcagcctaaaatgcgtgtgccctgaatccttccacattttgaggccgcggcaaagaggcctgagcaggtgcagggggcctggctccctcctctgtgaggccttggctcctgctgctgggcgtcacttcccgttgcagagcaggggcctgccctgtgtccgaatggaagccgggccctgctcgccttcggtgtgtcttgatttggactttggaattgcgtgttttaatagaatccacgtggcccttcgaagggtagctctgcaacgggacaagccaggcattctcctgcggcccttgcaccccatcgcggagctctgcacgccacgggcattcagtgtgtggccagttgctagttgctgatgttcctggagtgaaaggaatgctgggagaaaacaaccatttgtttctatttgaacaggttttttcagcgtctttctggggcggaatgttggtacccattggtgataagccgtcaagcattgctgataggtaagtactaatcaatgaatggataatttgcacatattttcctttggatcttttcagttgttttttataagatattttagagaagtttatttaggagagcatagtatttcaaatattcctttagtatttatgtttaagctaatttctaaatatcgggtatacctcacacttaatattttttgcttttgttggggaagttactttattatatttaaaatgtattgttcccttttgattatgaaggaatatagttcatactcattgcagaaatgcaaaaatggagaaacacttaaagaaattagagaaagcactcactaagtcatgagaaattctttataagcagcattgtagtggcatatgtttcattatttgcatataccataactttttagcctaccgtgtattttttgatatttcattggtttctaatttgtgatttttgtaaataacattgtaaataataacttttaagataacttgttgtttattttattttctgtggtattactctctcaaagtaaaactcatagtattgctgggtgctgcttttaggaagcttacagcaatttatacccctaccagcagggtatgaacttgtacttgttgcttcgaaatactaatcattgtcctctagggcaaaaaaacttttttttcaaccctgcattagttaaaatatactggtacagcttttttggatggtggtttggaagtagaacaattttaggtttataaactctggatcctaacagtttcacaaaactccatgaatctaatttacaaaagtacttttctaagtgtgtaaagatttatgtgtagaaggatgtccattgtagcattgctgatgaatagcaaagaatttgaaactgccttatgtaagttccgcagtagggaaatggtgaaattctagcacaaccattccagatctatgtaattattaaaaataaggagatatgtgttcataagttaacattttgcacatgaatatgtttagtggatccctttccagcgtgcatgcaggtgtagcaccgagggcctgggaagccagccaccaaaacagtgacggtgggcaccccagagcctgggatgcagcaggcagaaccatttcactcgttatgttatatgcatcctggatcatttgaattcaaatgtgtgatttatcgtttcttttttattttatttatgtatgttttttgagacagagtcttactctgtcacccaggctggagtgcagtggcacgatctcgacttactacaacctctacctcccgggttcaagctattctcctgccccagcctcccaagtagctgggactacaggcacccggcaccacgcccagctaatttttgtatttttagtagaggcgaggttttaccatgttggctaggctggtctctaactcctgacctcaggtgatgcgcccacctcagcctcccaaaatgctgggattacaggcgcgagctaccgcacgtggcctgattgatcatttctttaaaaacgaagcttgctgtttttgcaattcatgttaatggggtattcagaaaagccttgcttagaaatcccaagtagtaaaaacatatttataggttttaaaactcaaattaaaatgaaaaaattcataaaggcttttatttggtaggaaaaccagaaaaagccgcgccctgttccctttgtgctgttgcagacctgcagggtgttcttagcctcccgcggcctcaaaggtcagagggctctgagggcacctgccggggttgtgtccttggctgcctcttggctggaaagattacacagaatttctcttgtcatttaaattcattttttagtaattatcataatctaaaatcgggttctaatatgctgttcaatttttcagaaagtggatgggtttttatgtaattaatttttaattcacgcttttcatattattcagatatggttggtgagagtgtgacaatccagttcattagggaacaagaggagctcatatttaaaaattataaacctaacaagaattcttttttggtctgtttctagtattatagcccccctttttgtaatattgggattatactattaaataatttgtatcctgctcttcttcccctaatatcgcactgtgagccagtaggaggcccgccatgaaaaggaactgcgtcatgaattctcacagacagctgatagttcctttgtgacagacagtttgccctgcccctctctcctagtgtgtttcttggcatcttgtgtctcacctgcatctccaaagtttgcagtgtctccttagatgttgagatttttatgaaattcccctgtagtgtgcaccctcttggtctttctcaaaggttttgccttgtaaaaatgctgtcgataatctagtatcgaatgtgagtctgacatgtgtttcctacgcgttccgtgtgtcatgtcgtttctcacctcctgactttcctctgacctgtgtgctgttttgtcctaggttttaccttgggggacccacaagcatccgcggattcagcatgcacagcatcgggccacagagcgaaggtctgtcctttcccctcacggcgccaagtctagaaggctcgcgtctcactttggaaaccatgtacctgttattagcttacagcgataatagacattcctctttcacggtggtggaattagcacctaacacagaacttaccatgtagcaggtgtagaacatttattgagagaattgtaggaaaatgagaaaatatatctgagcaaaaactctgtgaaaatgacccgcagtcctacccagagagaacatgtgtaaacgtgttgttgtctgttccctgcaggtttgacatgtgcttcctactcttcctttgtttacatattattattttttttgagatggagtctcgccctgttgcctaggctggagtgcaatggcgcgatctcggctcaccgcaacctccgcctcctgggttcaaatgattctcctgcctcagcctcccaagtagctgggattacaggcacccgccaccatgcctagctaatttttgtatttttagtagagatggggttttaccatgttggccaggctggtctcaaactcctgacctcgtgatccgcctgcctcagcctcccaaagtgctgggattacaggtgtgagccactgggcccgacccctatgtattattattaatattatcattattattttgagacagagtctcgctctgtcgcccaggctggagtgcagtggcacgatctcggctcactgcaacctccgcctcccgggttcacacgattctcctgcctcagccccctgagtagctgggattacaggcacacaccaccacgcctggctaactttttgtgtatttttagtagagacggggtttcattatgttggccagactggtcttgaactcctgacctcgtgatccaccggccttggccttctaaagtgctgggattacagatgtgagccactgcgcctggcccctacgtattatttttaaacccatttctctcatcacctcccataaaaatgtaacagtatatttttatgcgagtaaatgccatttttaacaggtacatatttcatattattgacatcctatattttagttaataggcttaatttgttagagcagttttaggtttacagaaaagttgggcaaaaagtacagtgttcccgtataacccccatagcttccttattattagcaccttgtgttaggatgcttcattggttaggattggtgaagcaatatgataaccttattaactcaaggccatagtttacatgagggttcactcttagtgttgtaccttctgtgggctttgacaaatgcatgatgtcctgcattcaccattccaggatcacacaaagtggcttcactgcgctaaaaatgctgggctcccttcatccctcccaccagaccactggaaacgacaggtctttgaactatccatggagttttgccttttccagacagtttgggagttgggatcatacagtttgtagccttttcaagttgtcttcttttccgtagtaatatgcacttaaggtccctccatgtctttctgggacccaataacttgtttcttcttattgctgaataatattcctttgtctggaagtaccacagtttgtttgtccattcagctgccgaaggacagcttggttgcttctagtgtttggcagtgatgagtaaagcttctatcaacattcacgcgcaggttgttgtggacagcttctgggacataagttgtcacatctgctgagtcagtgccggggagcgcagttgtttggtcacgtgttaagagcacgcctcccctttgtaaggagctgccaggcgagcttccggggtggccgcgtccttttgcatttccccagtgaggaatgagagagagaaagtttatcatcttaatggctgcgtgttttgtcttatgacacactattatctttttaaagaccaaatcccaagctttggacattgagtttgtgtttttttttttcttttatgattataaaacaatgtattcaccttcgaactgaatgttggtactcatctgtaagttttatttatttatttattttttctttctttctttttttttttttttttgagatggagtcttgctctgttgcccagactggagtgcattggcgcaatctcagctcactgcaacctccacctcccaggttcaagtgattctcctgcctcatcctcctgagtagcatgattacaggtgcccgccaccatgcccggctaatttttctatttttattagagacggggtttctccatgttggccaggctgatctcaaactcctgacctcgtgatttgcccgccttggcctcccaaagtgctgggattacaggtgtgagccagcacgcctggccaagttttactttaatatgaaattctagatgtgaaatcgccagatcttttagggctttatcgtactttctgggaaggttgtctcatttatactcctagaaccgtctctgacatgcaacatccgtcagaggtatctccacatgctatggaactttaaaacatcatttaagtggatgcatattattccattattaaacattctcccctgattttcttactttttttttttttgagacggagtctcgctctgttgcccaggctggagtgcagtggcgtgatctcagctgactgcaacctctgcctcccaggttcaagcgattccccctgcctcaacctcctgaatagctgggattacaggtgcccgccatcacgcccagctaatttttgtattttttaatagagatggggtttcgccgtgttggccaggctggtcttgaactcctgacttcaggtgatctgcccgccttggccccccaaagtgctcatattacaggcgtgagtcactgcacccaggatttcttaaaatcttcagcacctttgttgcttccatttttatgtcattataagcaacaactacactctgcataaatttttgtcgaaagtatagattatttcttttcactcgtatttagagtgcttcattacagtgtaatttttaagaaaagtaacttaagtttttgatggttttatttcatctgtttattataagcaagtgtgatatgccgagtctatgagagctgagcctttacctacctgagaagtaaggcatgctggtgttccactcaccacctccgtgcggttggccagactctgtgggcaagaatgtaaattgctataatttttttgtgaaagtggtttgatgtatcaagagccttaaaatgtgtatgttcaagaattgttaataatactattaatgatagccccaagctggaaactggaaaccgaaatgcccatcaacagtaggaaatggtcagataattatggtatcttctactgtaatgaggaagaacaagttacagccactggctgaatgatggcatgagtaaatctcagaaacatgtcgggaggaaaagctagacccagaggaatgcctcctggaagatcccatttataaagcttggaagcaggtgaagtggcctgtgctgtgagagggtggggcagtggctgcatgtggtatgggcaccaggtggtggttagaagggaaggcaaggtctgatgtggggtgtgcttggtttcttggtcctggtgctctctgggcagatgtgtttcagatatagaaattcattgagctgtacacttaggatgtgtatactttcctatgggtatgcacaataaaagcttaaaaaaatacatgtttgtgccaggaaactcatcataggttaatgtccatgataaaggacttagaaaccagtatgacaatagaagagaaatagatcattaaatattggtccacctatgttgtttttcaggcataaaaaccccattttcaaggaagataaagcgttaggagaaagtgtttacaatatattaaaactgaaaaaaagtaggactggaaactgtgtatatatatatatatacacacacagagagagagagagcaagcaagcaccacattttattggcttgcttatttggttttacatttacattataatccactggaagaaaggacatcaggatgttagctgtttatttctgaatggtagaaattaaaatattttcatttttttctctttatgttgatcagatgttctacaatgagtatatttaacttttatgttcagaataaaatcagttatttaagaagagagaggaggagtggtttctgggaaacaaaaaacaaggttgttctcctgcaatttgttcattctctgttcccatcagagctctcgtgttgaaagggattaaggagatgttggtgtcttttttttccttcctctggattgtgaggaactgaagtctttaaatgaatcagcagttcattccttgaagttagtcttgaagacatcagtattttcccatttcatggtctgtcattttgtattagaggagagtaagacactgtataaatggtattttgcaacaaagtataaacctttgggttgtatgttttctgttgctttatagtttaaaatggaatggacaggaacgtttttagaaatatgcaaatacatgctctcagtggataggcttacactttggcaaaagtaacctaaatccaagcggtcatgaaccgttgagaattgtctcttctctggagacactgagctggaacctggtctcgctgtgcagtgggtggcaggcagcctctgccttttgattaatcatgtgcagctgtctccacacactgcagagacgctttctgcattttgtctctattgcgctctcgaaaatttggcaaaataatgcatttcatttgcaggtggaagtgagttggtcatctacatttgtggataaagttattgtcatgagactcatttcttcaaagcatttcacagatacgatgaatgacagagtgcattccttcctcaacgacattggctttgtttgcctcctcagttaaatcaaggtgtgaaacaaaccaggagaaaaagaaagattatttaaaatgaggccatcagtatcaggaatgagaagaacagctgcttgcaaactccagcactgtgtggcgttgtttacaggacagaaatcttgcttctgtaagttgtggaaagttaacgtgatgttaaccttgtcggaccttgtttttgttctgcacccctcctttgcttaggagactacctaggtggagaagcgtactgggccggcggcctgcacctctacaccccattacctttccggccaggccagggtggctttggagaacttttccgaacacacttctttctcaacgcaggaaacctctgcaacctcaactatggtaaaacttgcgctattcaagaaaccattgtagtacagttgttttcatgtttaaaagcacagtacacaaagaggtgtctgtcttttttttttttttttgagatggagtctcgctctattgccaggctggagtgcagtggcgcaatctcggctcactgcaacctccaccttctgggttcaagtgactctcttgcctcagcctcccgagtagctgggactacaggcgcgtgccatcacgcccggctaattttttgtatttttagtagagacgagatttcaccatgttggccaggatggtctcgatctcttgacctcgtgatccacaccccccttggattcccaaagtgctgggattacaggtgtgagccaccgtgccaggccatgtctgtctttttagattacatagtcattaaagttagagactgtgccttacttgaaaaaaattcttacaacagctaacataatgcccagcattaagtggttggttgagcgaatgaagcatacaagaaaaataatcatctaatgcccttacgaagaaaaatctgtttgtctatttaataaacaagtcatgatggccacagagctgagtaggattgggtgccttcctcagggagttcaggtccagaagagactcccagcagatgcctgggtgctaggggtgcctggaaagcttcctagaaggcatggaagtctccaagctgagactcagagtggggcttcccaggtggtcaggggatggggaaaagtcattctaagcagagggaacagaatatgccaggcccaaagaattgagaaggcgtggctcattctggatgtgagtaagtgtggctccaagtcctctcttgacctgggtcctaatctcacttcatgcatcctccctaatctctaggcctggctttaaaaacaactgcagggcccagccagggggagccagggcttgtctgggagagctgggagagcttggaaggacgggcacgcactgttgctcacaggtctttctcttttcaggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggtacgtgttgggaattattttccacaatcacatcccactctccagtaattttattttgttttggacgtggttaatttcattagtggcttttaagcttgaagattttaagagaattaaatagttgcaaaataatgaaaacacatgtattttcctcctttgcgtttttctccatctagctgggaggagcaggtgtgaagcgttcccaccccctccctcaggtgctttgtgcttattgttcccagggtagtgggagcccctgccagggtctggctggaggaattgacaggtgatttggttcctgtgtgctgaaaacagaaggcagtgttttgagcagttgactttgcaggccagggtctctaggaaagttggggtgagtgaagctttgttcctgaccacagaggacacgatcttgagaacccctctctctacagcagaggaacccaccttcttggcttttcttcaccccttattttattgaggaaagattccctaaatgttacatgggtgaatatggtatagggctagttacacagttatataaacaaattctatttcttacatgcattgtgtaaaattttttttttttttgagacagactctcattctgtcgcccaggctggtgtgcaatagcacgatcttggctcactgcaacctctgcctcccaggttcaagagattctcctgcctcagcctcctgagtagttgggattacaggcatgcgtcaccacacccggctaattttttgtatatttagtagagacagggtttcaccatgttggtcagggtggtgtcaaactcctgacctcgtgatctgcctgcctcagcctcccaaagtgctgggattataggcatgagccaccacgcccggcatttttttttttttttttttttgagactcggtctttctctgtcacccagctggagtacaatggcctgaccatggctcactgcagccttgacctcctgggctcaagtgatccccctgcctcagcctcccaagtagctgggactacacaccaggctaatttttgtattttttgtagagacagggttttaccacattgcccacccaggctggtcttgaattcctgggctcaagccatctgcccgcattggcctcccaaagtactgggattacaggtatgagccaccgcacccagctgcgttgtgtaaattttaagagattcagacgtgttttcattatagtgtatctcggtcagctcaggctgccatcacaaaataccatggagtatttaagagtgacttaaacaacagatgttcatactctgccagttctggaggttggaaagtccaagatcagggtgctggcagatttggttgctgttgggttctcttcttggctcgcagatggcagccttgccactgtgtcctcacttggaggaggaagagtgcaggccagtgccccgatgcctcttcttatgcggcccctaattccatcacgagggccccatcttcgttacctcgtctgcacctcagcacctcccaaaggcctgcctccaggtatcaacaccatcctgtcagggttagggcttcagcatgtgaatcttgtggggacatgaatgttcagtccacaacagtgttcatactgtctcttatttttgtatatgcattcacagcaccccagcctgttttttctcttcatttttgtgtctacctttatgttgccaccaaatggtggtgctgttggaggcttaacccggtttcaaataggttgtagtttgtgccagttgaaggaaatgctgtatcatttttactctctccgtcttccgcatcagcatgtaggggatggtgctttgtaaaggggagccgcattcgcaagtgtttctgagcatcgcctctcaggtgcagtctgcgtctgtcattcaggtcctttacggttattgcttcagcggaatctgctccttacactcttgccagaaggcccttcagcatctgctccgcgtctggggacacggcaggggctgccaggctgctgcggctccctactgatgacagggccttcagagatggcggcggctgctcccacaaccgccagctcccattcccctccacgcctctcctgttctccacacaaagcccaagctggaaagggtgtagtcacgcaggctgcatgcatgtgtgcctgggggcccagctacccgggcttggggcccagcttggccactctgtgtgactgtgtggcccggggtgagtcacaaaacctctctgggtgtccattttcatgcccagaggatggacgatcatgatggtgactgttgcagtttggagaactcagtgagttactgcatgcagagcccttggcgcaccgcctggcctggggttgggaagtggttatttttcctgggctgctctgctgctgatacacccggcgtggccagcccctcacacaagggaacaggttcctgtgggaggtgttgcccctccccctccacatcatctcagctaacagtttgtgacaagccatagatgggatgatgcatcctgattttggagataataaagtgaaaaagtgggcacctttttccagagcgagactgcatcagataactccacgccgttactgtcttcagcagaccaggctggttttgcaagtttctttctatgaagcccttattccctctgcagttgggagtgttgggctccctggcctaacagccaggttctcatttgaatccttgcaggtagccccagaggcgctgtgacgctgctgcaccaacacctagcttaagtgggtggttttgagtggttgactgcaggcccggggctggaggggcgttggagcgagggaagctttagataccgctctctgacacagtccctgctgctctgggacccgccactgtgcacgtctcgggcagggagggtctgggcagcccacgctgccatcaccaccattgcagtgctctttgtagccactgggtgtcagtgtgccctgagaagtcaacgcggcttttaggagctctgttgaattgaccctttctgaaataattttcatatgaagtggttacatttacctttcagctttacttccgtctcttcaggttaaatctaaaaaacacgtttcagagattaatttcaaaatatggtttattccgggaggaagcagcatcctaagcacgtgacatttaaagaccaggctataaggaagtgcctctgcccccaggccaggtggcagctgttcagatgtttattatggacagtgagctctgaacggggtcagcctggcaccccgagtgtggaagacattttcgctcagtgtgaggccttgtttgaggttggtcatcaatattggaatttcgtgaagttggagtgaggttgccagatttaatcttcatttctaaaatttggtagctggcaggatggggtatcgtgtgtgtagaaattatccacaggtttcccccataactgaggcaggcacactgtaaataggacttcagacattcacaaagaaggaaacagttttgagatgtttgcttactgttatgtcgcaagtgatttgtggcaccactgtctctgggatctaacagcattctgtcagtttgtgtcttaggagtccggtctctggagacacagggctgaatcaggcaggctcgcttgggagagcagctcacagttagcagcaggaagacaagaaagtggatcatcttggttgttggggagggtgctgagagggccccctggagcaggtccctgagctgaatcttcctagaggacagacagccaggtgcttgcagaagacacgcagggacagtggtcctggctaacaaaggcaggagcaaagctgtgcaggtgtgcgctgtcggcgggcaccgggcagaaccgcgtcctacaggaacagaagggggagtggggaggtccaggccctgagctcccacgcctttgccttccagccccgctgacctttttccccttgggtatatgccagggtctttgagctcaggacttcatctgccttgttcaccgctgaggtccccatgactacaactgcacctggtgttggaagtgagagccaggtggagaggctcctggcgtgtggtgggaggtggggtgcaaggcgccaagggtgctgttggcatgaccttcctaaagcaccccatgctgggtgcttcctggcctccagcctcagagtccaagttcgtcagaagcctttgaacatcagactccaagaccctgtgccggcagtggcagtgctgggtgagaagaaggtgggagatgaccaggagccctgcaccaagacagcggccgtgagggagggagagagcgtggggtgcacagcagaaggtggatgtttggggctgtctggaggatgccaaggctggcttgcccctggtctggtggaacttcgcagcgctgctttgaatgtttgcagtgggtattttgttctgtgacatgtttatgtggtctctgagcataaacctatgcttgtgaagttgtttaatctgtttgtttgtacttagagtgacaggcctttattagaatgcttgcttgttttctgaattacatatgccaagagcttgacttcctttttagctcctagcttatgttcaggcatttttctaagtagcgaatgtaggtatagactagtttgaaggagctgagagtgtacaatctaaaaacagatctgaacacaactaaatggtacaaatgcagcccgggttttgatgtggattctggtgttttaaggccatggatgtggcttactgtaatcttgaaggggctgcagtcctggcttctggtgagaggactgcagtgccggggctggttaataagcacccttcatcctgcaggaggccggcgcagcatttgtgagtatctgtgttgaatctcttcgtggatcagatattgtgtcttcttgctcagagtcaggttggaaaaggaaaacttgccgccggtgtgcatgtgctccaaatcctcagcttgggcaagggcacgggcgtcgtgaataaaggagccattcttgctggccttttctagaaattgcccacagcttgcaaaaaggctgtgttccctggccccggctgcggctgtgtaggagtctgaatatcattttccccagaagttgaggtccctaggttaggcccaccttgtcccaaatgggcagcattggccttgccccatgcacaggctccaggcggacagagctgctgcaggcatgctgtcagggggacaggctgccccccagctgtgcatggcagtgtgtcggaaagaacaaggcctgtgggtgcccctgagccgggtctggagtcctgtcctgccacttctcagccgtgtgactggagcctctttgctcctctctgaaaatgggtctggtggtttgttcccaggttcttaaccactgtgtggagtcacacctgcagaaggtcagctcataacagatatggcaaccaatgtgacctttgcatccttccttcctggggtcaggagcaggtctaagaggtggtcaggctaaacccctgtagggctgtgggtactgctggtttcctaagccccgggaccttctgggggccgggcggaccttaagttctgtccacctgcctctcctccatcctcactacccaccttgtccttccggctccttccctccctgctccgcctctcatcggccctctgtcctctccgtccggagaggggaacgtgaaggaggtgaggagggagtagtgcaggaggatttgggtctctccttctttcccttttccattctccgagggcttaaccagctggtgaaggttcttaaccagcaaaggaggaagcagccggggccggtgagggtgaggccggcagccaggcaggaaggcagcaggaggaggaggaagcggaggcggcaccttctgagaggcgcatgctcagtgagtcgtgaagatggcagggctggcggagcggccgccgcatctgatctctcccctttttttaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactccgag

SEQ ID NO: 10182 - DNA, 240 bp, Homo sapiens
ggagaaatacccaaaccgtgtaacattagggacactgaagcaaagacggagcctggtgtctacagacgaatggcagcatgaatgagtgtgcgttttctggggctgctctaagtcaccacaaacgtgggggcttaaaacaacacacattaatcctcttgtagtctggagatcagagtccagaatgggtcttgctgggctgcgtcctcctggaggcgctaaggggaaatccccctcctttgc

SEQ ID NO: 10183 - DNA, 250 bp, Homo sapiens
acgaggtcaggagatcgagaccatcctggctaacaaggtgaaaccccgtctctactaaaaatacaaaaaaaaattagccgggcgcggtggcaggcgcctgtagtcccagctactcgggaggctgaggcaggagaatggcgtgaacccgggaagcagagcttgcagtgagccaagattgcgccactgcagtccgcagtccggcctgggcgacagagcgagactccgtctcaaaaaaaaaaaaaaaaaagac

SEQ ID NO: 10184 - DNA, 326 bp, Homo sapiens
atgaaataggccgggcgcggtggctcacgcctgtaatcccagcactttgggaggccgaggcgggtggatcatgaggtcaggagatcgagaccatcctggctaacaaggagaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcaccactgcagtccgcagtcgggcctgggcgacagagcgagactccgtctcaaaaaaaaaaaaaaaaaaagaatgaaataa

SEQ ID NO: 10185 - DNA, 321 bp, Homo sapiens
gccgggtgcggtggctcacgtcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaggaaaaaataca

SEQ ID NO: 10186 - DNA, 318 bp, Homo sapiens; identical to SEQ ID NO: 6723

SEQ ID NO: 10187 - DNA, 270 bp, Homo sapiens
ggaggccgaggcgggtggatcatgaggtcaggagatcgagaccatcctggctaacaaggtgaaaccccgtctctactaaaaatacaaaaaattaaccgggcccggtggcgggcgcctgtagtcccagctactcgggaggctgaggcaggagaatggcgtgaacccaggaggcggagcttgcagtgagccgagattgcgccactgcagtccgcagtctggcctgggcgacagagcgagactccgtctctaaaaaaaaaaaaaaaaaaaaga

SEQ ID NO: 10188 - DNA, 248 bp, Homo sapiens
ggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaatagatcagc

SEQ ID NO: 10189 - DNA, 284 bp, Homo sapiens
cagcactttgggaggccgaggcgggtggatcatgacgtcaggagatcgagaccaccctggctaacaaggtgaaaccccatctctactaaaaatacaaaaaattagccgggcgcggtggtgggcgcctgtagtcccagctactcgggaggctgaggcaggagaatggcgtgaacccgggaagcggagcttgcagtgagccgagattgcgccactgtggtccgcagtccggcctgggcgacagagcaagactccgtctcaaaaaaaaaaaaaaaaaaaaaagtcta

SEQ ID NO: 10190 - DNA, 5125 bp, Homo sapiens
tcccagcactttgggaggccgaggcgggtggatcatgaggtcaggagatcgagaccatcctggctaacaaggtgaaaccccgtctctactaaaaatacaaaaaattagccgggcgcggtggcggacgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaagaaagtgtggagttgaggccttgctgctggcttatctctcttaaggctacaagcgcaatcaatgctggcagtgttgctgggacccaagcctctatgccccagatggcaggccccattccatcctggatggtgtgacggtgggcactgcagatcgagcagggagccctggagaagtgctagggctggggaaaggggaggaggcagcctgagccatggaagaaaccatcctggtcactgcatgcttgggtactcagcctacttccttggttccatctaacagtccccagagccctaggacctggatctgggccttgctcaccctccctgttctcaaaatccttcttgctgatccaactcctttccagcctcagggtctttgcatgtgtgactctctgccaaaaaccctctttcctcaacactgtttctggtggtttttccccggttgataaggcctcagcaaaatgtcacctcctgggaggcttcccttgcctctctattcagctatttatagcagcctcctgtcattctttcacactgtttgctacaatttgtgctttaatagtcatttgttcctttattggttcaagggtcagtgttggtgtggtcactgctgagtccactgtgcccagaagacagggtccacagcaggcactccataaatacatgttgcaggactgccctcactggctcactctgtggagtgagggacctaatgggccccatttacctattgcctctgaaagttaaagggcaggaacaaggtggagggccactgccctctggcctggcatggcccagaggcagcttggggttagctcaaggcagctaagcaggtccagcccaagaactaagtcaagtgggccgaggaggctctgagagtggccggggccggcgtacattccctggcatgggtgagaactgcggctgttctggacgcacattcatctcatgcgaggtgctggggcccaagttcatgtaggttgctggcagctgcacataatggtccccaagcagtgcagacactatctgctccacctcccccactagtactccgaaggtgggtcgcactgctgggtctgcctcccagcattgctgcatcacttggtacctgttgggggaaagggatgtcaggttaaggcaatttccacccaaggattctgggccacccacttgctgttaaacctctggcaggccacacagggatgaggatagatgacaggacctagtacctagcactacccaatcaggggcagctcttctcatccctatgattactgttccagtcctgccttcccaccctggcagaggtcgaactacctcaggtgttaagagcttgggctcctgtgccctgtggcctgggctatgtgatcttggataagttccttaacttctctgtgcctctgggtcctcctctgatcacagagaagtaggcatataggctgatgcctgtgaagtgctaggcacaaggcccagctcacgaggtacaatggtcatcatcacagttcttccaggaaggaagcctgggtccagcaaagcaggaattaaaaatcctgaagtggccgggggcagtggctcatgcctgtaatcccagcactttgggaggctgaggtgggcaggtcacgaggtcaggagttcgagaccagcctggccaacatagtgaaaccccatctctactaaaaatacaaaaattaactgggcaaagctgggcgtggtggctcacgcctgtaatcccagcactttgggaggccaaggtgggtggatcacgaggtcaggagatcgagaccatcctggctaacacagtgaaaccccgtctctactaaaaacacaaaatattagccgggcgtcgtggcaggcgcctgtagtcccagctactcgggaggctgaggcaggagaatggcgtgaacccgggaggcggagcttgcagtgagccgagattgcaccactgcactccagcctgggcaacagagcgagactccatctcaaaaaaaaaaaaaaaaaattactgggcgtggtggcacacgcctgtagtcccagttactcaggaggctgaggtaggagaatcacttgaacctgggaggcagaggttgcagtgagccaacattgcgccaccgcactccagcctgggcatcagagtgagactctgtctcaaaaaaaaaaaaaaaaattctgaagcaagagcatttggggcagcaccagtggcaccctggtcctgaagcagaggttccccaggtttacctgctgggtcctagtgcctgccccattatcttggggatgtcattcctgcctgaaataatactctaccctacacacaatatctcatataattctcagactctcggaaggtggtactgttgtctccactttacagatgaggaaattgaggcccagagaggagaagggctggactgctgaagtggaccctatggtgtgccacccagatacccctttactttcccagtggctaggagtgttgcctgctgatggttcttgactgaggctctctctaggaattgccctaggcagaagagaactgcctctgccaagctcacatcccctcaccagggacagcctgtgactagtaactgattaatgcctggtacaaagacctggcctgttggtctcaatttcagaaaactgtggtgggtcatcccagttcaagcagtccctgtgggatgggctgcagtttctgtgacatttctcctgcccagtccttcttcccttgcccccaacctctcagtaaatccccgtacataaatctccagctgagtctgtttccaggagcccaatctggatatgggtaggcagtgaattaaagaagtgaatagtaagagcaaacccaaggcaggtaggactgtgaggaagggctactcgcatccttcttggagcacagcctgagacaggaggcgttaactacttttacctatgtcctggttctctctgttctaacccagcagacctagccacagctcaggcacacctgctacgtatgaagctgaacctcagcaccgaacccaccccgtaggcactgaggacaatgcagctgccgccatccctccaggaatggggaatctgaaaccacatacagtgaaaaaacctgacctggagatccagagggggttgctgtgggggttatggaatctttcctcgagattaaatgagaggaaaaggtggaaagcagaccccgttagtgggagtcgggtaggaggagcactgggaaaatcaaaccacgggcctcaaccccaactctgagctcagaatgctgttaccatggcaactgtgaggtcctcccagggtcctactctgcatgagggtgggaccagttcacagatgaggaaattgaggcccagcgagagtccctttcctagtcaaccagaagttcagtcaggaagccaggcaggagctctgtctcctgtctcttccatgtctctggggcccagttccctccccactaccacctccacatactcacagagaatcagggcaatactcaggctggggcaggcgccgaccctgggccaggaagtgggtaaggtcaaaagggtcaatgtggcggtatggtggggcaccccgtgtcagcagttcccacagcagcacaccaaatgaccactgtggaaagggggaggtgaggggactcaactcaccccaaatttgggggcaggtgggtcccccaggggcttctacctcccagagtccttcagctggaaatggaagaccctaccctccactgagagctcattcctcaatacatcacctgtgtctttcctctgtctcctcccactacctcatcctacccagagttggggctgggcaggccctggattatctgtgaggagccagtgagttcccagcctcctctagccctggcaggtgtcagattccatcttacatctgcccaagaggtgagcagatgggctgtgggggtcatctaccctggggactccctgggctcagatcattcagagctgaatgggtgaggcccagtgttcttgggtgccaaagccatgtggactgtagggcaggtggggcctcaccacatcagacttggtggtaaatctataggtctgcaggctctccagcgccatccacttcacaggtaggcgagcgtggcgatgctgttgaacactatagtactccctgtccaggatgtcgcgggccaaaccaaagtcagccaccttgactgtgaatgactcgtccagccttaggggtagggagaggatcacacttaggactggcccttaccaggccctgaacccacctgttctaggcccttacagaattttttttttttttgagacggagtctcgctctgtcacccaggctggagtgcagtggcgcgatctccgctcactgcaagctctgcctcctggggtcacgccattctcccgcctcagcctcctgagtagctgggactacaggggcccgccaccacgcctggctaatctttttgtatttttagtagagacggggtttcaccgtgttagccaggatggtctcgatctcctgacctcatgatccgccttcctcagcctcccaaagtgctgggattacagacgtgagccaccgcgcctggccaaatttcaaagccacagtgtccagtccaagtctgcactgggcagacaaaaaaagtaaggtgcagagaggggaggacaaggctggagtgggcccttccctgaggcggccttgagcaccgcacaccctcatgccctgtccttttgcttcaccccagctactctggactctcacatgcagttccgcgcagccaggtccctgtgcacaaacttctgctctgccaggtactccatgccgcgggctacctgcaggccaaagctgatgaggtccttcacggtggggt

SEQ ID NO: 10191 - DNA, 296 bp, Homo sapiens; identical to SEQ ID NO: 6750

SEQ ID NO: 10192 - DNA, 295 bp, Homo sapiens
aatcccaaaactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgaaactccgtctcaaaaaaaaaaaaataaaaaataaaaaaaataca

SEQ ID NO: 10193 - DNA, 785 bp, Homo sapiens
tttgttcattctttcatgcattcacctcttattcagctaagacttcagctgctgttatgtaccaaagggtataggaacccttcccagtcttcctgagctgctcctagtccttatttagttcgttttttataccaatatagctcttcttcctccttgtcctcttcgtccatcaccacttcgtgtttttaggcttactgcaaatcccaactttcttgttcttgttttggtattgcaagcttgccggctggctccattggctcactcattatcctctccatcacattcttttcttcacttactactgagtgatgcatatgtctgtgtttgtctgtctctcctaattttagattttgattaacctgtatccccagtgccctggcatatagtatttgttaagtaaattaatggataaattcagaattgatcccttttttgccttctgtgctttattctccattatgttattcccaccttgtgctattgaaaaaaggaaacttcaggtcaggtgcagtaactcatgcctgtaatcccagcactttgggaggctgaggtgactggatcccttgagcccaggagtttgagatcagcctgggcaacatggcgaaaccccatctctacaaaaaatacaaggattagctgggcatggtggcatgtgtctgcggtctcagctgaggcaggaggatttctccagcccaggaggtcaaggctgcaataagctatggttgcgccactgccctccagcctgggcaacagagcgagaccctatctcaaaagcaaaaagaaaa

SEQ ID NO: 10194 - DNA, 785 bp, Homo sapiens; identical to SEQ ID NO: 10193

SEQ ID NO: 10195 - DNA, 386 bp, Homo sapiens
tgatgtgatgtatttaagtgtttgtccccttttctcacctgtagggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggttagtacccaaggctgaaaatattggtaccttcaaccagggactgcaaactcaggtgccagttttcaccacatgataacgtgagcccattcacccaatctcttgattttcatagaggagccagaatcatgaggtttcgtatcaaatgccctgctttctaagtattgtctaataattataattaaaaacgggaaaaaaaa

SEQ ID NO: 10196 - DNA, 386 bp, Homo sapiens; identical to SEQ ID NO: 10195

SEQ ID NO: 10197 - DNA, 1296 bp, Homo sapiens
agttccacctaaagatttctccatacataatgaactctaacttaccggcatgtaaacagacctgacctactcttgtgccaatctctgagtttcagccaatcacaggcagccaactgtttaatccctgttcaaataaggtaaatgccaagctgtaaccaacccagctgtttctgtacctcacttccattttctgtacatcattttcctttttatgtccataaatcttgtctatgtggcagctccagagaatctctggacctattttgattcaggggctgctcaacttatgaatcactgttcaattaaactccatcgatttaatttgtctaaagttgttcttttaacaccagaataatgtatatcataatctccctcactctaatcatgtggagattcagattttttcagctaatgaggctccaaccctgtctttgtttaaaaaaaatgaaaaaacaaaacaaaaccatgtcctagttttactgctaacagtatttctctgacttttctggatttcagttttgtacaatttctataataagaggttaacagacattatatgctagcctcacatgaatattacctcctgatacctataataatatgaataatatagagttatgggtaaggaacagacaacttattttacattcttgtcttttcctctccttttccttttcaatcttgccagcaaatcttgccatttaaaattttatatttaaaatgacgtatgcatttttctccatagggaatattagtggtctataaactagtcagtatttcttccctacaataaagcaaaagcagtagaggtcttttgctgtatcctatcaaaccagtaataatccctctgccaaaatcatcatctgttctgagtgtctactttttcatttgtctgatagctcctcttggcatatagtactctcttttgaaccttctgccaaacaagcacaaaataggacaggaaataaaaactctgaggccaaggtctccatggcccacatccccatctgtgagagcacaagagctattgctctcctcactaaagattgcctgatctatttgttggtctccaacaatttcctgagtgtatctgaatgaatgcaagttatttggaatgagtggttgctttttagtctcaatactggctttatactctacctctcgtcttttcctgttccatctcctatcatcctttttttaaagggagcatgtggaagtgaaaggacacggcggagccagaacaagagtgactgagttttgtctccactgcttacttgataagtgaccttggacaag

SEQ ID NO: 10198 - DNA, 2698 bp, Homo sapiens
gttcccctctatgtgtccctgtgttgtcatcatttggctcccacttataagtgagaacatgcagtatttggttttctgttcctgtgtaagtttgctaagggtaatggcctccagctccatccacgtccctacaaaggacatgatctcgttatttcttgtggctgctactgacatagcatctatcttgaaattcatttcattcatgcaaagttgtccagcgcttacacagaacacagagagcagagttgggccaaaggaccttagcttttatcatgtctcccttttttttgactgtgctaaagcattattttgcttttctgtttgttaccaaatcctttatcttcaatggttaattttttgtttatatatttggttaaacaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaa

SEQ ID NO: 10199 - DNA, 17947 bp, Homo sapiens
aggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtaaatatagaattattacagtagctacttttaatttggacacagcttcattattttaaacatcaacagtgtcttaaaatagtgaaatgtgaatactcccacttgaggaagatcagtttacaacaaataaaaccaagaatgactttttgctcttaaaaacaggtacaaggccaggcgcggtggctcacgcctgtaatcccagcactttgggaggccgaggcaagcagatcaccgggtcaggagatcgagaccatcctggccaacatggtgaaaccccatctctactaaaaaatacaaaaattagccaggtgtggtagtgggcaactgtagtcccagctactcaggaggctgaggcaggagaatcacttgaactcgggaggcggagattgcagtaagccgagatcgcgccactgcactccagcctggtgacaaagcaagactccgcctcaaaaacaaaaaacaaacaaaaagcaacaacaaaaaaaacacaggtacaagatgacatggaatgatttacaaaagatccaccagaagatacctttaatcatgtcatattttaaatgctctcaaatgcatgtagaatatgctgtaattttttaaactttacctctttgcaagtcagaagtactcatagaattaagcatttctaattcacccatgttttctgaaattctccgcaaagtttatgaaataagatttgctttaaaattcttaacttgaacttctttatgattgtgatatgttacctttaaaattagaaaataaaatgacagacttgtacaaagtataactatagtatctatgatgggaagtctgttaattggtaaaataatttcaccagctttgcagattattatatatattatccacactgagaaatataacaatacatactttattttttacaatagtatgctttttgaaaaatcggtcaattaaaaaaaaaacctttagaataataccattatttgcgtgcttctgatgtcttactcttaaattaacaatcttttatgtttgtaaaattcacatcctatatttaattattttggatctataattatcacttatcaagataacaattggtaaagtttaaattttctctgtagaactatttccattaaatttcaagaggtctttatttattgagctgaattctcaaattcttgaattagatgaatgaattccatgttttctttacctatgccttggtggcacagatctcttggtgacagctatatcatgataaattatcgtgtgtgcattgttttgcatttcaaggtggaagaatcaacagccgtgatgtctggatttataactcacagttaaatatttggatcagagttgcctctctcaataaaggcagatggcgtcacaaaatggctgtcctccttggtaaagtaagagaaaccactttttattactattgctggtacctttccaaagtaaataccacagctgaatctttcattttactcaccctctgggtattttggattcaaattgtatttccttccatttctaacctcaatagataaaccaaagatataaacaatatgacactgtacttttgaatggatattttgttctcctaatttggaattcatggcagtgtagcacatttctcttctcatgcatcactgaagtccaaatgcctaagaagcattggaaaataaaggagttacatcaaatacagacaggccaatgtctaacccacgcagtttgttttctttttactaactttgcaagtcaggcagagatatatttgtccaaagtcatgtattttatcttttttattttaaataaatattaagataaactcactaacaggccaggcacgttggctcacgcctgtaatcccagcactttgggaggctgaggcgggcagatcatgaggtcaggagatcgagaccatcctggccaatgtggtgaaaccccatctctactaaaaatacaaaaaataagctggggttggtggcgggtgcctgtagtcccagccactcaggagggtgaggcaggagaatcgcttgaacccgggaggcggaggttgcagtgagccaagatcgcaccactgcactccagcctggcaacagagcgagactccatctcaaaaaaataaaaataaaaataaaaaaactcacattcttaaagaaaacctatttttgactgcagctaatgattattataaacaatacattatttgggttctaaaccatctactgtctgtaggaacctgagaatcaaacttttttttttttttgagacaaggtctcttactctattgcccaagctggagtacagtggcattatctagctcactgcaacttctgcctccccagtgcaagtgattctcctgcctcagacacctgagtagctgggattacaggtgttcgccaccacacctggctaatttttatatttttagtagaggcagggtttcgccatgttggccaggctggtctccaactcctgagctcgtgatcctcccacctcggcctcccagagggctgggattatagttatgagccaccgcacctagccagtttccaaactttttaaaagcaactacaggtggagtttccaaaatgcttgggaccagaagtgtttctgattttggatattttttttttcttttgtttttagacaggttctcactctgttgcccaggctggagtacagtggtgccatcactgctcactacagccttgacctcctggacccaaactatcccttctacgtcagcctcccaagtagccaaggccacaggtgtacaccacaatgcctagctaattttgtattttttgtagagattgggtttctccacattgcccaggctggtgttgaactcctgggctcaaatgatctgcctgcctcagcctcccaaagtgctgggattacaggcatgagccactgcactgggccaaatattttggatttttttcatattttggaatattttcattatattcattgagcatcccaaatcaaaaaatccaagatctgaaatgttccaatgagcatttcctttgagcattaatgtcatcactcataaagtttcagatctggaacattttggatttcagattttttaagatttggaaagttcaacctgtatattgtcttttaaaaagtcatatctaatacaaaaatttattacataacagatgaaaatacaacagttgtaccaaggattaccttggagtctttagcttctccctgcccccatctccatctgcttgtccaaaaccacctcaaattaatgaacaactaaaagcagcacacttgctttcgcatatgtctttgactgatctcctagcacccctttctaagaagattgctgtctcataggccctcctatggagacagttaagtaccaccaataaaaaaacaaagctctagctgaaacagaaatggtgaccaggaacccttcttggtcagcctcttactagtcctccttcctctctttccccacaggggtttcttaaaacttctatactaggccagtcgtggtggctcacacctgtaatcccagcactttgggaggccaaggtaggtggatcacgaggtcaagagatcgagaccatcctggccaacatggtgaaaccctgtctactaaaaatacacaaattagccgggcatggtggtccgcaccggtagtcccagctactcgggaggctgaggcagaagaatcgcttctggcggagtttgcagtgagccaagattttgccactgcagtcagcgttctgttaggaatctaattgcacagcagtaggtgagcagccactgagcgagctttaccgcctcaactccacctcctgtcagatcagcgcacattaggttctcataggagcatggacagcacatatgagggatatctaggttgtggctgcttatgagaatctaatgcctgatgatctgaggtggaacagttacatccccaaaccatcccatccccgaccagtcccccaccagccccccacccagacctgtgggaaaattgtcttccattaaaccgctccctggtgccaaaaaggttggggactgctgcgtagaatactagagcttctcaaaacagtttatatatttttattttttgagatagggtcttgctgtgttgctgaggctgtagtgcagcagcacagtcatggctcactgcagcctggacatcctgggctcaagtgatccttctacctcagcctccctagtagctaagactgcaggcacacaccatcacacctaattttggtattttttgtggagataatgttttatcctgttgcctgggctggtttcaaactcctgggttcaagccatcctcttgcttcagcctcccgaagtgctgagattacaggcatgagccaccatgcccagctcaaaacacagtttaaaagctgttaattcctaacgacctggatctagtgtgctgctgctgtctacaaggccaatgaaataatgaggaccttgagacagatttactggaaataaaatattaatagaatcttttctaaaaccatttggtttgttagtacttactatattatatatagtgtttgaggctgtgcctcaagaaggacaaaatattactggaaaagaggggctaaaataatccaggggttggaaggagatgctgatacaaaggcaaatgaaaagtactgatgtctcaaaaaccatgtatgtattggtaaactcaaatttatttgacaaaatagtgtacttgacttgaagatacccaaagcttagaagcactaaatcaataaagaaaaggaatcattcctaccttacacagcaagtactcaattcatggaagtcattttgctaaaattacaatatagatttaattcaagcttataaaacatacttaaatttataaatactctgtttaaggaaacctgggatggtttagaatatagaatcttaggggagcactccccagtgtaacttagaagtgtgtcttaggctgcaatcctcaagaaaaaataaaaaattaccgggtgcggtggctcacgcctgtaatcccagcactttgggaggccgaggcaggcaaatcacaaggtcaggagttcaagaccagcctggccaacatggtgaaaccctgtctctacaaaaatacaaaaaattagctgggcatagtggcggacacctgtaatcccggctacttgggaggctgaggcaggagaatcacttgagcctgagaggcagaggctgcagtgagctgcctgctgcactccagcccggtgacagagtgagactctgtcaaaaaaaagaaaaggaaaaaaatcttagagtaggaagggatgatggaataatggagaatatttaatataacttggtcatcttataaataaccccaaagagatcaagtcacttcccaagattacacaaaaaatgataaagcagaggcaaaagctcagacttttcttaatctagaggccttttgtcttgatgctcatggcatgtattatattttaatttacacatgtaggaatacgtattaaagtttaatcctcaaaattatgccatgtgatagatactatgattgtctacattttaaaattgaggaaatatagccaagcatggtggcgggcacctgtaatcccagctactcaggaggctgaggcaggagaatcccttgaagccaggaggcagacattgcagtgagctgagatcacgccattgcactccagcctgggcaacaagagcgaaactccgcctcaaaaaaaaaattataaaattgaggaaataaatttgagtctccaaaagggtagataaattgcccttacattggatggcagagctggtgatcaaagcctgtgcccttaattgctacatcgtgccacaggttccatactccatatagctgtgtggacttttgtaagttacttaacctgtctgagctgcatagtgttggggacacaaactcaccaacagattattttaacataatgtgagaaatgcatgatagaagtggcattgagtactgtggaaatttgggggtgcacagaaagataaattgtggacaaatttgaaggacaagttatgaaatgtggccttgacccttagacattcattgttgaaatattaagaggaactgataaagtattttaggaagaataatctgtggtttagagagaacaagagtggaggccaggaggttatttgagaggaatgaaatgttgtggaccctcaagtgggtgatggcagcgggaaacgtaaaggaaggggtatatgtgaaagatgctgtggaagaagactcagtgggacttaatagttaattagctatggagggaagagttaatgatgacagtccattaagagaaatgtgagctgggcgtgatggctcacgcctgtaatcccaacactttgggaggctgaggcaggaggatggcttgagagtgggagaatggcttgaggccgagagttagagaccagcctgggcaacagagggagaccctgtctctgtgaaaaataaaaataaattagtagggtgtggtgatacacacctgtggtttcagctacttgggaggctgaggtgagaggattacttgaacctcggaggttgaggctgtagtgagctgtgatcatgccactgcactccagcctgagcaacagaatgagacccatctccaaaaaaagaaaaagagagagagagaaacgtggatgttaagctgctggagagctttgttaggttgaaagttccctatataaaccatggattttttgcatataagccatttaataaatatcttactgattggttcacctgtcatataaagatactaatttgccctacctttctcttatttgtgaaaagaaaatgtacataaaagctctgtgaactttaaagttcattttgtgtcaagtacttttctaggtattgtacggactaaaagaaaggcctgaccagcactctcatagtctagtaattctttcctaatattttagtttcacagctctaatactttataataatcaaatatttcattacccataagtgtgaatatttaagctaaattgtaccattctcagtgtgagcagtattacccccaagggggcaaagattgtttcttagaagatgaaaaaaaatgtaccctttcttgtgtaaagaacagatatacatacattaaggtaaatagatacacaatttctctgtggtattacaattttattgagggaagactattaggaagaaaatacctaaaaaggctccgtggattgtgatggtggtaggggatgatgattttttaaaaggttcagaaactctgagctaaatatattgcaattatatttatttagcaagggcattttaaagagaagagatcccttaattctttagccaactacttcaaaattcagacttttgataattaagatttttccatgtattttacatataggtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggtaagccatgcacttttaaagaaattaccaatattaagtacaagaagggaaatacagaaggcttatcaagtaggtagccaggtcacatagtgtgaggggtcttttaaaaattttctggtactatatgcttttggagaaaaacattgaattctgggttgctaaagtgagactctagtatatctaacaatttgctctaacaaatgtgatccaatctttttgaaatgagactatctgtgtagaagttttctactaaataaattgttctgagcctttgctgtcatctacaaaatctaaaaactatttatacaaaacacagttgagaagtgaattagcaaagggtaagacatagtaactaaatatgctgcttccaactgggtcattttctacatacttttgaagtatttttcagaaaaaaggaaaggaaacctccttagtgtaaatagaggatggctcaaagttgttccggttcagtaaacttctgggacgaaagaatatgtgctatcctgacatctcaggaaatgtttattctggaaaaaagcatctaatgcctagctggtttagcactgttaactgaattttgtcagtctattaattctttttctaaattcagtttaaaataatgtgatcaaatgttacttatttagaatttgttatttcagaatttgtgataattcagagcatactgattgaattgaggtttacttgttttcttttgaagaaaggactccctaaaagcattaagaagttatattcagatgtgaggcatagttatcctacataacacaattgtgaaaagatttagactgttaattttagtggacaaacctggtggccattcattctagaaacaatctgtgtgtttggtactctattctgcttgatagtaataaatttgcattttatttgagaatgttcgtaattcagacatttcactatcaggctaacctctcttaattctctgaattaataggattttattttaaataatgtttgtaggtattggtagattctttattaagtacatttccatttttgtttagaaattttaattatatatttttatatgttattaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggtaataacataaagcagtacaaaagaaaaataaatctaagagggaccaagtacataatcattattaatacactggaatttcaattttaaaatatttcaggctgggcgtggtggctcacgcctgtaatcccagcactttgggaggccgaggtggatagatcacttgaggtcaggagttcaagaccagcctggctaatatggtgaaaccccgtctctactaaaaaattatggccaggcgtggtggttcatgcctgtaatcccagcactttgggaggctgaggcaggccaatcacctgaggtcgggagttcgagaccagcctgaccaacatggagaaaccccgtctctgctaaaaatacaaaattagctgggcgtggtggcgcattgcctgtaatcccagctactagggaggctgcggcaggagaattgcttgaacccgggaggtggaggtcgcggtgagccgagatcgagccattgcactccagcctggacagcaagagcgaaactccgtctcaaaaataaataaataaataaaaataaaataaaataaaataaaacaaaataaaataaaaaattagctgggtttggtggcacacgcctgtaatcccagctgctcaggaggttgaggcgggagaatcacttgaatctgggaggcagaggttgcagtgagccgagatcatgccacttgcactccagcctgggcaacagagtgagactccgtctcaaaaaagtaaataaataagtaaaataaaatatttcatgtttgcttgaattattttatatatttttcaaaactccacataaagcatatggcaacctgttttgaactccttccaaggggtcattttattgaaataacttcctttttaccatcccatggagaagtatctgttacacttgggctgttcttttttttttctcttgacttttttcacaatcctactccagtatttatcccctctctttcatatttcagaagagaggaatgttcccaaacttgttgtttctttggttagaggctgggaaatctgttatttctgttgtaaaggaaatggctgtgctcacctttctttcatccatgtattctaaccggagccctactccctacccacactgccacctcccaaaaggccttttccccaccttttgattcatggctccttttccttccacccccaaaatgcttgatggttctgatgctgaaaatctggctctacacataccactctagagatgtactctcaaaggtcactgctaataatctcctcactcttgttcatactctcttgtttttctacccagtccttaaatatgttccttgagcctgtcctctgtcctcttcccagtttatactctttcctgaatcatctcatttactgctcagcactgatgtcttccaagtctgtatcgccatcaaagcctctctcctgtgttccaaactcaaatttctaactgcctatttgatattttatttgatattttacatgggtatttcaagattttaaatttcaaatagaactcaccttcttccccaaacctgttttttctatatttccaattaacctagaaacttaatttattagattatctttttcttctcttaaattgaattaatctagcctatcagttctcctattttttccattcctattgtttctatttttgttcaagttcttaccaagttttacctaaacaaacaaaaatactctaattagtcttcctttctctaatagcttgtcttgctagctcatttagcatcaattttctttctttctttctttctttctttctttctttctttctttctttctttctttctttcctttcttccttccttccttcccttctttccttcttttctttccttccttccttcctttctttctttctttttttgagacggagtttcactcttgtcacccaggctgaagtgcaatggcgcgatctccacacactgcaaactccgcctcctgggttcaagtgattctcctgcctcagcctcccgagtagctggaattacaggcgcccaccaccaagcccagctaattttttgtacttttagtagaaacggggtttcactatgttgaccaggctggtctcaaactcctgaccttgtgatccacctgcctcagcctcccaaagtgctgggattacaggcatgagccaccatgcccagcctattatttttcaataaatctacttattgtctcttctttgattggaaacctattaaataaaatccaaaacttttaccacttcattctagaccttctattgcctgaccttcatttgacctttcagcttcacattctataactttacctcaggtaccttaagtatctgtcatttgtagtctctaaacagatcataaatgttcttgccctggttcatgctgtcttcttatcctgtaatgcctgttttaccttctctacttgtaattctacttatctttcaaggaccacttcagtacaacagagtttaactggggcagaatggatctattttgctttctgatctgttaaagcactcatacctcttatggcaattgtatattcccttatgggtataaatgtttatttcctatactagaatttagtcttcttgaggacactatttcttctaactcatcttgtatgtatcttgcatttatttctgcatagtaaatatatatatattgaataagtaaacaaatgaggaagtaccagagggacttaattttaagataatcttatttgcaagatacattagagatacagcatagattataaggatagtgaatagggtttgaatataaaaccacttttctaaagttgttgacattgaggtatagtctccaattagtaatatatatgcagtaacattgccccagttaatgaaagggacataataggcacttcagctccatggtacagaatgagtattacgttttctccctctcatatcacatgtaagtaaaaataaatcacatttctccagctcagggacctcccctggaaaaccattctccagccctacagaagcgacagtgtaccctacttgcatgagaatcctcatgtggtcaagtattgagacttatttctaatttttaaaaaatctaagctgctttttattggtttatttcagtgaagattgtaaagaatgatgcatttttattaagaattactgctcaagctgggtgcagtggctcatgcatataatcccagcaccttgggaagctgaggcaggaggatcacctgaggccaagagttagggaccagcctgggtgacacagtgagaccctgtctcaaaaaaaatttaaaaaaaaaagaaagaaaaaagaaaaagaattaccatttattcggaactttgctatattgtataaaacgataacagtttaggaagataattgccagtatgtagcatattgcagggcatacatgaatattttttaactaggttattgagataaaactgagaaaaaaattaataataggacacacatggcacattttctctaattaaacaacattcattgactttagaaatttaaagaaaataaacatttggatcagaagtatattaagtctaacaaagacaaataattgaagttcaaatctagtactgggatttaggtgattattttctctcctctgtttattgttaccaccaatgctactaaatacatctatgcacacattgatctcggctcactgcaacctccgcctcccgggttcaagtgattctcctgcctcagtctcccaagtagctgggattacaggcgcatgccaccacacccagctaatttttgtatttttagtggagacagggttttgccatgttggtcaggctggtcttgaactcttgaccttaggtgatccgcctgcctcggcctcccaaagtgctgggattacaggcatgagccacggcacctggccttatgcacatgttattgataggtaatttttgagccgtgtgtgattgtttacccttttaatgccaaccgatgaaaaaggataaatcaaactaatttcattgtatacagttaaatgaacccaatactgttgctttttaaaatgcttagaatattaaatgcaaaaaagagctgaaaaaaatgaggtctttattttttatagtcctaatggaccctgcctatttctctgtttgtccttcaccatttccacgcctcttctgactttgcataattcctaaaaacacagcttattattcaaaacatattttgctttttaacctgtgtcaggaacatcctttaaaaaaaattgtgggattttttaaaaagtcagtgatgaagactttttttctctctcttcagtagaccaggtatttaaaataccattaaagattagaataattaaatgaaatctgattctttttgtctattgttgacagtttaacattttaagcatacaaaaataacgagagggttttttggttttttttttttttctttgcaatgttaggatcatgtttcgtttcagtctttaaaaataacattaaaactttatatattgataaattattgttcctactagctgcccttactcctgaatgaagagtaagtttttcatacagtataaacaaacagagtaaatggtattttactagcatgaaataagctattatatcggatagaggtaatttcctgatatgaatacttggtttcaaggttctttgctttatttaactctgagcattattatctgaaatggtattaattaccagaccatgtaattatatattgttttagaatcatcctcaaaataactagaggttcaatagtgggaactagcttgtacctgaaaactaaggtttttgtttgtttttattatattcagaacttgaagaatttatagaaagcgcttattgtgctttaaatgaaaaatattagagtttgttccataattggtgcaattcatgggggtgtggtattctgaattaaagtgtctttcactatatgataataggctaagtcattctgggtgtctataaattctaatataggcatttttaagtactcacaaattctttcagacctaaagatagtatccttctattatataaagccaccaagatttaatttcttctataagagcaaaatttatataaagcaaatttggtcaagtaaaaatgcttattgaactcattggtagaaactatttcattgttggttatgtggaaccaggataataaggtgcaataactctctgaattaaagtgaaactttaattggaaatggaagaatatctggcctgcagtataaccagatgcatgtaatagtgaatcagttgttaatgtagggttttttgtttgtttgtttgtttattttttttgagacggagtttcgctcttatcacccagactggagtgcagtggcacaacctcagctccctgcaacctccgcctcccgggttcaagcaattctcctgcctcagcctcccgagtagtagggattacaagcaccccccaccacgtccagctaattttttgtatttttagtagagatggtgtttcactgtgttgaccagactggtctcgaactcttgatctcaagtgatccacctgcctcggcctcccaaagtgctgggattacaggcatgagccaccatgcccagccaggttttgtttttgaagaatcactctcatccttgcaagaatatttgttttatatagtaactgtgttattgacagagaataataaaatttagcttagaatcccattgtgtgggaagttaactgtaagatgttatttgagacatttctatggcccagccaaggctcctaataacagtgttttgttaacttagttataaattttttcctcattcattcattcaatttttgggtaatcccatataatgaatattgttcctactccttggtcatgtaaccgccactttctataataaccttcctgtaataggagaagcaagccaggctctttaaagatgcttttgcttaactaccattaagttaaaacccttttatcagtccacatcctacctcccacatcttggccccaattactaacatataatcttttttttttttaacttttattttaagttcaggggcacaagtgcaggtttgttacataggtacactgtgtcatgggggtttgttgtacagattgtttcatcattcagttcttaagccctagtacccattaattttcctgatcctcttcctcccccaactctgcaccttctgaaaggcccgtgtgtgtgttgttcccctctatgtgtccctgtgttgtcatcatttggctcccacttataagtgagaacatgcagtatttggttttctgttcctgtgtaagtttgctaagggtaatggcctccagctccatccacgtccctacaaaggacatgatctcgttatttcttgtggctgctactgacatagcatctatcttgaaattcatttcattcatgcaaagttgtccagcgcttacacagaacacagagagcagagttgggccaaaggaccttagcttttatcatgtctcccttttttttgactgtgctaaagcattattttgcttttctgtttgttaccaaatcctttatcttcaatggttaattttttgtttatatatttggttaaacaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaa

SEQ ID NO: 10200 - DNA, 2698 bp, Homo sapiens; identical to SEQ ID NO: 10198

SEQ ID NO: 10201 - DNA, 432 bp, Homo sapiens
tgttatacatttattttaatatccatgtgtttattatagtaaatttgaaatgaaatcctgaaaaacagaatttttttaaacacagacctcacaccaatattaattttttctctacataatttaaaactacataaattaagtacttaaaatttatattgaaggccaccaagaacttaggttgaatcttagaaaatttaaataactatttttaaagttacccaacttaatattttaattttttaatatttatcttcctttactaattcttgataaataatagcattagacttgataaaataaaaaagaattttagagtagaattaatatatcaaaaggggtatatcaaccaaattggtgtcagattgtattcattctctcatcacataaagatttttcttttgataggtgatgctcatatgaacctttggttta

SEQ ID NO: 10202 - DNA, 432 bp, Homo sapiens; identical to SEQ ID NO: 10201

SEQ ID NO: 10203 - DNA, 23825 bp, Homo sapiens
aggttattgcttacaactcagaaggtaaaagtaatccaagtgaagtagtagaatttactacttgccctgataaaccaggcatacctgtaaagccttcagtgaaaggaaagatacattcacacagttttaaaataacctggggtaagatattatgcatgtttatacattattacttttgcgtttgattaaaataatttgaatatgaagataatttttaagatatttgagtaaatttgttatctcaagccagtccaaaaagaaatgtgagagtcattcattgggtatgttttttgtggaaaaccttatactctcatacatgctaggttaagatatgataaaaaggaacttgcgatccactgtaagataatgagcaggggtagcactgtgaaatgaaggattactgaacttgcagctaaagtcacctgggtcatctggctctcgtaagaaatgaaaaccattcatttaaaacaaacatttatcgagcacctacctacatacctaatggaaaaacaaagatcccataaacttgacccttgcctgaaaaattcagaccaataaaaatgcttcagtgatatttataatattcaaaaatttcaaacaaccttaacatctaaagtaaatggaggctgggcatggtggcttacgcctgtaatcccaacactttgggaggcccaggcgggcagatcacatgaggtcaggagttcgagaccagcctggccaacatggtgaaaccccgtctctactaaaactacaaaaattagctgggcatggtggcacatgcctgtagtcccagctactcaggaggctgaagcaggagaatcgcttgaacccaggaggcagaggttgcagtgagtcgagattgtaccattgcattccagcctgggcaacagagtgagactccatctaaaaaaaataaataaaaataagtaaatggaatatcatgcagccattaaaaattgttatagagagccatattttaaatatggtaaattaagtgaaaagcagatgacaacagcatggagtaattgggtactggtattaagtcattgcaggtgattttttttttttaaacctagtttggtattctgtttattaggttttttttatcatttttatgttgttttgtaccttgcctaatactactttgcttctttggatagatccaccaaaagacaatggcggagcaaccatcaataaatatgtagtggagatggcagaaggttctaacggtatgaatggatattaaacactgatagatttattccagccagtctctttctattctttatggctttacattttatgtcatatcttttctttcttcttgcttttcataaggtacaccataaaaagatgttcacttcactttgggttgtcctggattttttttttttaatgtcataagtttattgacaaacatatctagtatgccatatgagttcaagtttgatccacttccagaggctgtacctcttaaaatgctcttcatatctgttaatggatgaactgaaacatccttatgttttaagtagttgttgtcttactacaagaaagggtgtagcaaatgcagatccaaagtacaaacacatcttagctagtaacgaccacttgttttccactgaaaatggcaaattcttcccagggccctcctcacagtggctcctacggaccacagaggttgtgaacctccggatgctctggcccaacgtagcgctgctggaagctctgcgaaaggcacagaaaccgaggacggatgaaatggcggcacctcaccaagaccttttttttttcctggattttttttttctttgtttgtagcagttaggattttgcctgttatgatccactttaaattgtgatttccagaaatacagtgaatcaaatgtaagagtgctgaacaactgtatcgttgcatttacatgttctttttgttctcatttatttacattgctcagcctctatacacctagaccaagtcattagatactatgaatcttctgaaggttagtttattcagttagatttatatacagatatatcagagaaggattaacttctaaaatttaactcacatcatactagttttagtagtaagttttatgactagtgaactttattcttgaatcacacatttagcagtgtttatttctatgaaatgacctatttcctgccaaaaagaaaaaaaagatgtcttttaattaggactagacttcctctgatactggttttttgtactctttgtatgctataacgttattactggaccagtaaacacatttaaaatgcttaattaaaagtaaattatcaatctaggccaaagtctgtacagagttacagagatatttcacttccacaaagccatgcagacttgtctaggaagctgcacacataaagaaaattagatcatttccaggaaaccgaaacaaacctaaattgtttctgacaaattacacaaatacttactttgtgaagctaggatacctgatgtgtccatgataccagaacgttaaacattacctagtatctgattgaacacaattcctcaccttacaggaaacaaatgggaaatgatatacagtggtgctaccagggaacatctttgtgatcgactgaatccaggctgtttctatcgtttacgagtttactgcatcagtgatggaggacagagtgcggtaatacttatatgtagattcttttgtgttgttattaagtttggccaaatggggtaggatcaccaggtgccacttcaaatattgaaacatatccacaaatggagaaaagtaacttctgtaacctgttgggttaatttgatagtgaccaaaatattctaatgtggtacttagctcacagtaagtattcagtgtgtgtctgttgtctggttggtattcagctttggaaaaacaaatacatgaaaacattggagaaaattttataaagataaatttgagaatgatgctcaataaccatactaagcagagatagaaataaaataattatagaccgatttactgctccataaattatgtgtgtgaggacacatcataaaatagtatctgctgtttaatctactttctaatatttacttacttcaaaaaagttggccattattttattattagagactcaataaccaaaatgaacttaaaatgtaccattgatataaagacataatgttctagggatgtatgtttattaatgagtgattttttttttttttgggaaacagtctcactctgtcgcccaggctggagtgcagtggcacgattggggctcactgcaacctctgcctcctgggttctgcaacctctgcctcctgggttcaagaattctcctgcttcagcctccctagtagctgggactacaggcgccccccaccacaactggctaatttttgtatttttagtagagacggggttttaccatgttggccaggctggcctcgaactcctgacttcgtgatccaccggcctcagcctcccacagtgctgggattacaggcatgagccaccgcacccggccaagtgattttttttttttaaatgaattaaaccaagaatggtttcttggatcattcataattgctgggttttttttttgaaatgaaatttaatgcaatgaaagtattcttttttaaaaatgaaatataggcattttgttgaaaatgaaactaatgtgcaactgagtgtgagtcctgcccaactggcttgtgctccagttgcttcattttatccagtaagaaaatctccctggatttcagaaaagcaacaacacatagacatgcacaaaatcctgttctactatagcattttacagcatttttacatagatagctttctgataaaaagatgaccaaatattttgtgtttaaaaagaatgttaagtatgaaccttaatatgttgcaagtaagtaatatgccactgagtttgtggcattgttttttttgagacagagtctcactctgttgcccaggctggagtgcagtggcacgatctcggctcactgccagctctgcctcttgggttcacaccattctcctgcctcagccttccaagtagctgggactacaggtgcctgccaccatgcccggctacttttttgtatttttagtagagactgggtttcaccatgttaaccaggatggtctcgatcttctgaccctgtgatccacccgcctcagcctcccaaagcgctgggattacaggtgtgagccaccgcgcccggcccagtgtggcattgtttttaacagagtgtctttaaaaataaaggctttttaaaatataaatatagcatagaaactaaaagcagtatcaaatacctagaaagatgccaagtaactggaaaagcttacctgattttagaattatttttaggtggaaaggatgaaggaaagataatcttttaatgtataagttaagcttggtgcagtgacaaatgtgtatagtctcagctactctggacgtgggaggattgcttgagcctaagaatttgaggctgtaatcatacctgtgaatagcaactgcattccatcctgggcaacataccaagaccccatctctaaaaataaataaataaatcagtgtttaggttaaaaatacagtctacagtagtaaagtagccaaaatattctaaacctccttacaacaatacaaacagcatatacagtattttaaaacatccctccttagaagagatttatggatccttttggagaagatcaaaaatattgcccattaaattgtgttggaagttgtttttttctttagttatggaaagaaaaggaaaggaagggttcattgaagttctttttcagtaacttgctttgtatatagtagttgcacagtacatgtctttctttgtctatgaaaattttgagtttttatttaattgggttttcattttttttcagaactttattccttttttgttgacaatcaagtacaatttcaaattatcagtgcaatatttgtgtttatattatttttccttaccaaaagcaatctgattatttggttttggggcatttttgttttctttttgcttttgttttggcaggtctctgaatctttacttgtgcagactccagctgtgcctcctggcccatgcctccctcccagattacagggtagacccaaagcaaaagaaatacagttacgatggggtaatttccattttggtaataaattataattaagctagaacaggaagtattcgtcttgttaaattgcattaatctttccatcttttaggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatgggggtaagaagactgtgctggtagaattataatcacaatggtgatatatgtttcattttaacatatatcatcatatccattatttggccatttggctttaacatatgactccaaattttacaatttttaacaagcctacattgataaatacaagagaagtcggtatattccataacttaatttttatgaaatctcagtatttttagatcccacttacagtttgtgacactttggacttcagctgggctagagtttaccttttaggcagtgttaatagagtttacttaatcaatttaagagtagaaataaaatcataagtactgaagttttttgaggctgattgaagtttttgaggtttttgaggctgattgaagttttttgaggctaaagtagcatttactttcagttggcaactaattatgattcattttttttgcccaaatgaaaaaaaacttatgcttgaaactattctggttttgtatgtattttttgaaatattatctatgtatttaatatataactccaaaaagtggacaaagtaggtgatatctccatttcacaactaaggaaacgggttcaggaaagctaaatattttgcccacagtcatacaaactaataagtgatagaggtaagctacaaaccttagtttgtcagactccagagccaaagctctttccactcagctatgacacctctcatctctctgcaataaagcaggttccctaaggacaaagcagtaatttcctatctcagctaaataacaatttctttcaactattgtataattaaaatttttatagaattaaactgacagttctctcctacccattattttggtgaactatactatatttcaaatcctgttttccaacagggttctgtatttacatctgtaaacttatttttcaatttatttctgtttgattttttgaaacagggtctcaccctgtcacccagggtggaatgcagtggtgtgatcttggctctctgcaacctccgcctcctgggctcaggtgacccttctacctcagcctcccaagtagctgggaccacaggtgtacatcaccacacctggataattttttcatatttttagtagagagagggttttgtcatgttgcccaggttagtctcaaactcctgggctcaagagatctacccacctcggcctcccaaagtagtgggattacaggcaagagccactatgcccggcctaaatttcttatatgtcaaatttatatacttaggctgctcttacacaagtcattcctttctgtaagaagccatcttgtcagcctcacaaggctgcagtacactaggatcgcatctttaatacttacgtcttaatttatattttcaggtttgtgataatttgtcaaaatcaccttaagtaaatatttactttccgtatttccagagaacatacattttagacctttctaaagctattccagattttaagataaaatttatgcctaccagagagcagtactgataaataatgtactataagtacactatttacagttttattttaaataaaatccattcagcatgctagaatggtgaagctttgtcattattttgttgttgtcgacatgaattaaccttgttcaaaaaaggggggcaaaaaaatgacatttgtcatggaaaactttttttaatccctataggacttgaggaacagaatccttacttcagttcttataaatagttgtgctaaacctcaagtttctatcatttagtggccctttccatgctctccatgaactaaactgaattatctgtgtgactgatatgttttcttaggttgccttataacatgtataacagtactctttatttgtagatacctttgtatgtatgtgtgtgtatagacagatagacagactttttttttgagacagggtatctgtcacccaggctggagagcaggggtatgatcatggctcactgcaacctcaacctcccaggcttaagcgatcctcctgcctcagcctcctgagtagcagggactataggtgcacaccaccataccaggctgattttttacttttttatagagatgggggtccccttatgtttcccaggttggtctcaaactctcgggctcaagtgattcccccaccttagcctcccaaagaggtgggattacaggcatgagcctctgcacctgaccttttatatatacttattattgtaaatcatttgctgccactagcagtctgtaagtctatactattaaatgacatattggccaggcatggtggtaaatgcatgtaatcccagcactttgggaggccaaggtgggtgggtcacttgaggtcaggagttcgagaccagcctgaccgacatggtgaaaccccttctctgctaaaaatgcaaaacttagctgggcatagtggcgtgtgcctgtaatcccagctgctctggaggctgaggcaggaaaatcacttgaacctgggaggcggaggttacagtgagctgaaatcatgccactacatccagcctgggcgacagagtgagactctgtctcaaaaaaaaaagcaattaaaaacaaaaaactattaaatgacagatttatatttggaattttggctaggcacagtagctcacacctgtaatcccaatacttggggaggccgaggctggcagatcacttcaggccaggagttcgggaccagcctggccaacatcgggaaaccccatatctactaaaaatacaaaaattagctgggcttggtggtacccacacctgtagtcccagctactcaggaggctgaggcacaagaatcgcttgaacccaggaggtggaggttgcagtgagctgagattgtgccactgaactccagcctgggcaacaggctttttctcaaaaaaataataacatatttggaattttaaaattgattgggttttcaaatttattgttttaaattaggaacttttgaactactaataaaactatctgccatagttcattgatttttacatgaaatatttattttcaagatggtttcaagattacttttcacaaagcaggcgcattatatcaccattttgctctgccttgtaaacttgccatctgggatttttgggtggtattcatgtgagagtaaagcatattctctagcagtttcctatagctacaggtttgtttgttttttttcattgcttctaacaggatatagttactatgagtccatgaaatataatggaaatgtgaataaggagtttactgaagactttaaacatttgatttttttttaatcgtgaatatgatagaaactggtagtgttgagcagtgcaaatatttgaagtggtgatttgtgaaatagcccagcattgccttaaacaaaatcacagtctacttcttgttttatacatatgatagtataaaaggtttcttttttttcccattttctgagatttatagattggtatatagctttaaactatataaagttttatggaaagattttttaaacttattaatataaattttaaagttgatataattaaagtgagcctatcttctgtttataaaatgcaagattccttaacatttataattatacagatgaaatagtttctataaggaagttggagttttgattttgccctttatagatgttagattgtgcagatttgtctgtattttctcaccatatcaaataatacttttattataagattggttttcaagagccgtattagttgttataattgattagtatatagtttaactttattcatcatatttatactgtagatttatggccagaggttgaggttatttcaggagagttgatgaccttcatttaaagtctagctaaaatcagtgctgtaaacaaaaggaaacatttacgtttgtttctgtttgccatatatagtagccttgattttttacttttttataaaacagttacgttcacaatattagcctgaggtattaatgacattgtgatgatacaaaatggtgtatattccctgtgcaatcggatttggaggaaaaatgaaggacttaacattatctgaagtcactgatactctgaataagtatggtcaaggagtgaactattttcttttggaaaaactttttaaaattttatttttaaagtattatactgttatttttagggcctaatggttacattgaatagttggtttcaccttcttaaggttttttaccaatattcatgaaacttgatatttttaaaatccctaccctttggtaagtcgttatttattaacatttttattggtgattaatacatgttttttcctaaattaaaaataaataacttggaataattttaatattaaatatttgttaacaactgaatgtttccatagaattttctgagaagttgagtttcttagagttttcgtagctggctgggcccagtggctcatgcctgtaatcccagcactttggctcaagcagtcctccctctgagacaggaggaccacttgtgcccaggagtctgagaccagcctgggcaacatggtgaaaccctgtctctgtaaaaagtagaaaaattagcccagcatggtagtgcacacccgtagtcccagctactcaggaggctgaggtgggaggatggcttgagcccaggaagtcgagggtgcagtgagccatgtttgcaccactgcactcctgcagtctaggtgatggagccagccagaccttgtctcaaaaaaaaaaaaaaaaaaaaaaaaagaagttgagctagctcttaaagatgggcatttggcaaaactgcctgatacagtgcagtaacaagtaggtttacttctgaccattataatgatgcgccactgttaagtgaaaataccagtgtattggggcttttcttttgctaatgagctttgaaaaattgatgacaagaaatttctgtaattgttctcctatgtgtcggggaaggaatttgccaatactgaataaaattttttatattccgggtaatgtatgttaaaagtaattatgagaaagtgagctttttagcatggaacagaaaaatcaaattctgttacaaaataaacaaatttatagaacagaatgttggtaaaatttgatatggaatatgcctaagaaagattcgtgaagtattaaaaaattaaaaataataatttacacctaccatctcccgtacctttaattagtatcaatttcttcactccttatatttctcctgaattattccaccgacctcattccctaatgtcctgcccttcttacaaaaaccatttcctgaagaaataaggggcagaagaaagtataggtaaatgaaactttaaaatttctcacacctttactttcatgatttttaagtctttttagttaatgtgaatacttatagaattatgaccaaattaatcttgaaacacagggaaaagactttattaatgaatctttaaatatgcagttctgtgcaatcagtggacatttaagggtgaaaaataaaaacactagttacatttgtttttctagtttggaccattttcagaaaaatgtgatattactacagcccctgggccaccagatcagtgcaagccccctcaagtgacatgtagatctgcaacttgtgcacaagtgaattgggaggtattgtaatttccattgacttgtatctactttcttaagtgaatagaatagtttatataaaagaataaagatactgttcatttttaccgcctatattatacagagtaagccctagtttaattcacatgaaaaacagtgacttctttttcctctttgaagaatttgagtaaggtatatttgcattacaaatatttagattcctgttcattatgtgctttgtatttttatgaatggctttgtctcagtactgagatatttcagccactgtaagtttaatgttcagaatagacatacacaggaattagtaaattctatttctcttatatttatccagtacacatctccagtgtacttattgtggatagtaataatcagtgatgataattattatattttcagttccctttgaaatttaacaaaatgtgtgtatgcttttaacatttcatattaatagaattatcttgaaacatatttaccttaaaacactctttctaaagtgacttagtcatatttctacttctaattcaaaacagttatatatttgaccaatcttaaattcagataatcttaatgaataaaaaatgtaaaattgaacagttttgattgtgcttaaaagttttaaagaaactcaaaagcaatctagttttacatgtgctcaggtaaagagcatttttggccaaaagctatttaatcaacatcaagactaagacctttatccttttcttaatttaaaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggtaaagatgatcagtaccttgtcacttaactctatccagagttttatatttcattggcattttcatggtcatgactttgttaactcggaggctctgttaatttgtaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacaggtatactctaaaaattatgttgatttttgcctagaccagagagacgctttaaataaaacaatcataaccaaactttttttcttatgtggcacttagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtaggtttttttaattgcttctttatatagtttcttaggtcttaagtatatacatttctgtaactattagaagtaggccaggtgtggtggctgacacctgtaatctcagcactttgggaggctgaggcaggcgaattgcttgagcccaggagtgcaagaccagcctgggcaagacagtgagaccttgtctctaaaaaaaatttattttaatgaagtaagttttcaaaaacgaagtcaagattgtcatacaaaagtgtgctgtttttaaaacgttagaaaacacaatgtacatttcctgtttataatttgtgagtggaataccaagagaaaaaaataagtgggctactgtttggttgttttctgtaatccatttactgttttcatgatagtaaaagacacctaatcttagatacaaaataaactcttcagtgtttatttctagcaggacacaattttttttttttaagacaaggtcttgctctgtcacccaggctggcctccagtggcactatcttggctcattgcaacctctgcctccagggctggagccatcctcccacctcagctccccaagtatctgtgaccacaggcgtgggccactacacctggctaatttttgtatttttagtagagatggggtttcaccatgtcgctcacactggtctcgaactcctgggctcaagtggtcctccccgctcagcctcactgagtgctgagattacaactcatgagccactgtgcctgaccgaaacaattttttttttttttttttttgagacggagtctcactctcaccaggctggagtgcagtgacgcgatctcggctcactgcaatctccgcctctcaggttcaaacaattcccctgcctcagcctcccaagtagctgggactacaggtgcgcaccaccacgcccggctaattttttgtattttagtagaggcggagtttcaccatgttggccaggatggtctccatctcctgacctcccgatccacctgcctcgacctcccaaagtgctgggattacaggcgtgagccactgcacccggccctgaaacaattttatagtaaatgattatgatcgttcctggcctctgagatccttgagggcagagattatgtttcagtcttttccagattcctgacacagggcctgcacgctaaatgaatacagttcagtttttcactgtgtgatctcagttagattctgtgattaattatctagtccctttgctaatcactgttgctaatctttgctaatctttgaattagaaagaacctaatttcattcaggttctttctgtgcctctttcacatcttcatgtacatgttgtactattcctatataatgtgccatatactgccacactaaatcatgtattttaattacagtgttaactctgaatatttgtaacagtcattctaatgccaactagggctatttattcacattatattccatataagcaatgccacatacctcccacagctgttaatcctttaatattttaagaattttgaattttgcttttctacttttcactgaatatattagaaacaatttccaaatctgatggactcagaatactagtaacagtttttcccaagatttacttttctgtgttgtttgtatcttagccaggtattcaacaatgaaatattcatggtgcttgtacataaccactctctatcagaaatacttatacatttaaaataacatatggaataattttgtatactagtatatcaccagtaagaacattacacagaacaaacgtgatcatttcctaaaatctgtatcgatgaatgttagcctttgttcttggcagaattttatgtaatctttgtagccttatctctacaaagagattatttgccttgtacaggtttttggtatagccatttatctttaatatatgttattattactggacaaattaattgtttaaatttttttcctcccctttctagcatacatttggggtagtgcaagaaggcttactggaaacaggtctaattagtgtttggttgaaagataatagaataaagattctattagatataaattctattatagaacttccaacttaatattcagctagcatctagagaattgttatggggtatgaatatggctcatggcctttggttgtggaaaataaagaaattaaaaccttttatgatactgttaagtttaatgcacacatttaataaattaaatcaatttaatatctttgattactttcattccctttgattttcacaactatatacacttgctgtgggatggtatcataatgatactttagttgttccctgatccagattttgtcattgttcagcttttttaaacagtggtattaccactatttttttttcctgtcattaaaaaaaaatttagaggttgaaaaggcaaggcttatccaattactgcttattggaagtactgtttcttcctgtcattaaatatttctttatttttaacttggctacaattttcagactgttagcattgaataagcattcattattcattctctaatttccaaaaattttagaaacatccaatcaaaaataatgggatgcattcaacttatagataacatattaggagaaatatgtatgatattcaacttcattgaacagttcaagtgggtaatgtattggaaattttatattatcatactgcttttgtaaatctctaaaaaaacgtcaccaagtcaactaaaaatctgcctgggaattgagaattctcttttttccagataaagacaaggaagattaaaatagaaacttaatctcatagctcaggtctctatgccatacttggcaaattttatcaatatgactttagttagaaataatttgtaatgaaaattgtgatgttctgagcatcttttaaaatgtacattaacaaaacagtattcagaaacaaagctaaaccggaagcctgagaagaaacagttatggtcggacatgaaatttagtaacagacttttggtaaatcatgtcaaattgggaaatttaccaaatatcctatttttcttaatctgatgaaaaacagatttattttaagtgacatagagttcctggcatcaaacttttggggtaacttatcactcctaaataatgttcataactgtgtttttatactagtttgtaaaacactttaataaggtatcataaggtagtataaggtttatctaatagttatttccattttaggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaaggtaagttatacatcctgaacttattttctttataataaattactttttaatgtattttcataaatgctttgtttactgatattaaaatttagcatccagtatatgtccaccagttatacaaaatcgtataggcaagcccaactctactgagagttccactcaataataaaagctgttttatctggcacgctcatattcagacaagtactggcttttgtcactgatgtttttaataatgtagcataaaaatactaaattgaataggaaggctggttttctaatgaggtcatttgcttaaagaaaaaaatcacaaactctggttgtttaaacgttttgagttattgatattacattcatttggatttcagaaggaaagcttggtcatctgttaagcaaaacaaattcttcattaatgtgggtttttcaattagttttacacacacatgtacacatatttacacacatttgtatatacatttatcttttaattttagaggggttcttattttaaagtgactctggcaagggctacactctatttttagctgaaaagtctataaagttaattgctctgaagactaatcacagagacttctagaaccatatcctagatcatgtacttaaacctatcatttgttaaacagcagaactcttcttgactagtctttctaataatattgagtttcactgagtcatttttctgtttgctcatcaagtttagtgtctcttagctttaagaagagtgctgactataagcagggcacagtggctcacacctataagcccagtgctttgggagactgaagtgggaggctcacttaaggccaggagtattgagaccaacgtgggcaacatactgagacctgcctctctacaaaagaaattttgaatcagctgggcatggcagcatatgcctgtgtgtgtagctgcacaggaggctgaggctgcattgagctatgatcgcaccactgttgtccaggctgggtgacagagtgagatcccatatcttagaatacaagagtgctgattttaacctctttggatgcaaatttcaaaaattcactgatacttatttcaagtttataagtggattttaaatatttgttgatttttattaagacaagtgtctgcatgatgtaccaaattaaaaatcaagtggaacagatattatttatatttgtttcctacagcccccaaaatagagaaagtaaatgatcacatttgtgaaattacatgggagtgtttacagccaatgaaaggtgatccagttatttacagtcttcaagttatgttgggaaaagattcagaattcaaacaggtatgtaccaagatattaatgtgtggatgcatatttttacccttttttaatttttatgtattttcagtgtaagatttggccatctttaccttttaattcataaatatttattcagtatatattatgttccagagatctcaagattccaaatcttttcagtatgaactacacttgaacagattattcatttatctgataagtattcattgaattctgtgccaggcactcaggatatagcactgaacaaaaagtcccttgcctccatggagcttacttacattctggtggaaaagaagacactataagcaagtaaacatgacaatatattgtcagatataagtgtaatggagaaaaaacaaaattggataaaagaaatagggagtggagggggagggcactgagtgttatttcatttggggcactcagctgacatttcagcatggcccagaggagatgactatggagagaagagtgttccaagaagatacgctgaggcaggaacatgcctattaaatctgatgaacataaaggagccaatatgactggatggagagagcaaagggaagagttgataaggtcggatagttaatcctaaggggcctataggtggtatggagtgacgtaaggcataataggccatactgtggcttttactccacgtgaaatgagaagacagtggaggattttgaccagggtattcacgtgatcagacacaacgttgttttgactatagtgttgaaactacagtaggacaagggcagaactagaaagactaataaggaggcttttacaataatagtattaataatagtcataatgcagtgctgtaaatatgacattaggcatgaagttataatggaaacctagaggaattgtcaccttcctagccaagaggtttcaaagatagctttctgataaagcaagaatagcagtgagatagagtggagtgttgccaatgtttgttacaacttttaaaaagaataagcttttataccactccaaagactaattaaatacctatacatttcacctgattttccctttttcctgtaaccttaattttgagggcttttaagctgggttgttttcattgtgtcttatattttcctcttccactaaaaaaaagatccttcatttgttttattccagtattgtgctattgtaaccactctatgtaatatcttaactgaaattacaaaagatccaaagagtcagattaaatctggcatgcaattgtttttctttattaagccatctgcaaattgacaggataattagatttgaaatgtaatttacagataagtaggtttccttctaaggaggaagcaaaattaatattaaagaaaatataattgtattacacgtttaaaggaaatagggattccacatttgagtagtatatgaataaccttaaggcttgtttgaatgacttttcttgggtgtataaaccttctgaaattagcttgagcaggttaatctgttttcttcagtcctgtatttacagttacctgtgtctcttcctgcttagaggtcttcccacatctgaaatacaaaattgaaaacttgatcccatcatcttccctcccagtatctcctctccaacatctttacttcatcagtgtcatagacaccaatatcatcttggtctccaagctttaaattcttagatgaatttttttttcctatcaactcttaatcagaatttgtttctaaatccataaaactacatcagggcctcatcactttttacatgtacatcaagagtccctgtcctactcagctcccttcagtccttcacacagcctcacgattaggattccataaacactgttttaatgtcacacacctacagtggtcccttttgaattaacctaaatttccaactagtgtaattaatgtattcttcctctttgtaccagatctcttatcaccctcatgccatttgttgaggtttttctttcttaacctaatactgccaggctcatggaatggtatatgaagacacatggaaagtataaagacaaaaatcatctattatatccataagacaaatacatatttttaatttttactcaatttacttcagtgttatgtatacaattttacactactttatcatacaacattctgttttaagtgaatccttttacaggttgaagcatcccaaataaagtccaaaattcaaaatgttccacccaaaatctgaaactttttgaggatcgatatgacactcaaaggaaatgctcattggagcatttccaatttcagatttttgggtttggaatgctcaactagtaaatatgcaactattccaaaatcaaaaaaattgaaatgcttctggttccaagcatttcttataagggatacccaacctgtaccatctcccaaacatggatcatttctacattctattccctgaaacattatgcatccttagaactaatgtatagtcaccattttctttcagatttatcttaaagcttctttcagtaagttcctttatatattgttatcagcatccacatttttatttattgccaataattcactaatttaatgtccttttattaagtacctactatatgctagattctggagacagaaaaatgagacagagatcttactttactttgagagcaaagcaatatgtaaaaatttagatttacatcacaggtacaattgaggcagctaaaagtacttgaaagcccccatgtgttggttcttctgacttgtagcccaccaactaactggagaaactcaactgacaagtcatttaaccctatgaaccttggttttctcaattacagaatgagtggtgggaggttgctcattattggaaatgatagctcctacagattgagcagtgactgcatgctgagcactgcgctaagtgctttaacaagcattagttcatttcatcctcataattatcatacatgttaactactagtatgtctgttatactaaggtagttggtctaaaatcacatctggagtgtgaagtggtagagcagaccttggatgccaggggtgaacagttctagtatatagcttcttatttatgcctagtgttccattattggaacactaagcttgtggtagttatttatatctcactgatcaaggttattgccaaggtctgatttttcacaaaaaaaaaatttgcaacctctggcataaatgggttaattactagcacattcctctgaaaatccgtggaatttcattctttttatttcccttgtgaggcatggcagaggaggtcctattttctgattctaagtgatctcccctctctggtttatacagtgatttgccataggcacctatagaaagctccccttattcattttccatttcattgtacagatatgtttgaaattatatggaaatttatcagttatacaaagacataatgggggaagcaaaagtagacactatcccttctttgatggaatgattgcattgaaaaatgacttcttacatttgagaaaagcaagaaaatgcttgaggaccgattttgcttgttctctagctgccctggggcacatctgcactccttaattcatctgtgaaccgtataagggtagatcctcgcttttgaaatttctcttgcccctatgcaacaaacagataagtactttaatggacaggtatttttaacatgtcatttaaaagataaaatcaatggcattcactggctttcacatgaaaaacaattctaacactagccagttttaacacattttctgtccagccttcacacgtaattcttccttctaatattttattaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatcctagtgactt

SEQ ID NO: 10204 - DNA, 23823 bp, Homo sapiens
aggttattgcttacaactcagaaggtaaaagtaatccaagtgaagtagtagaatttactacttgccctgataaaccaggcatacctgtaaagccttcagtgaaaggaaagatacattcacacagttttaaaataacctggggtaagatattatgcatgtttatacattattacttttgcgtttgattaaaataatttgaatatgaagataatttttaagatatttgagtaaatttgttatctcaagccagtccaaaaagaaatgtgagagtcattcattgggtatgttttttgtggaaaaccttatactctcatacatgctaggttaagatatgataaaaaggaacttgcgatccactgtaagataatgagcaggggtagcactgtgaaatgaaggattactgaacttgcagctaaagtcacctgggtcatctggctctcgtaagaaatgaaaaccattcatttaaaacaaacatttatcgagcacctacctacatacctaatggaaaaacaaagatcccataaacttgacccttgcctgaaaaattcagaccaataaaaatgcttcagtgatatttataatattcaaaaatttcaaacaaccttaacatctaaagtaaatggaggctgggcatggtggcttacgcctgtaatcccaacactttgggaggcccaggcgggcagatcacatgaggtcaggagttcgagaccagcctggccaacatggtgaaaccccgtctctactaaaactacaaaaattagctgggcatggtggcacatgcctgtagtcccagctactcaggaggctgaagcaggagaatcgcttgaacccaggaggcagaggttgcagtgagtcgagattgtaccattgcattccagcctgggcaacagagtgagactccatctaaaaaaaataaataaaaataagtaaatggaatatcatgcagccattaaaaattgttatagagagccatattttaaatatggtaaattaagtgaaaagcagatgacaacagcatggagtaattgggtactggtattaagtcattgcaggtgattttttttttttaaacctagtttggtattctgtttattaggttttttttatcatttttatgttggtttgtaccttgcctaatactactttgcttctttggatagatccaccaaaagacaatggcggagcaaccatcaataaatatgtagtggagatggcagaaggttctaacggtatgaatggatattaaacactgatagatttattccagccagtctctttctattctttatggctttacattttatgtcatatcttttctttcttcttgcttttcataaggtacaccataaaaagatgttcacttcactttgggttgtcctggattttttttttttaatgtcataagtttattgacaaacatatctagtatgccatatgagttcaagtttgatccacttccagaggctgtacctcttaaaatgctcttcatatctgttaatggatgaactgaaacatccttatgttttaagtagttgttgtcttactacaagaaagggtgtagcaaatgcagatccaaagtacaaacacatcttagctagtaacgaccacttgttttccactgaaaatggcaaattcttcccagggccctcctcacagtggctcctacggaccacagaggttgtgaacctccggatgctctggcccaacgtagcgctgctggaagctctgcgaaaggcacagaaaccgaggacggatgaaatggcggcacctcaccaagaccttttttttttcctggattttttttttctttgtttgtagcagttaggattttgcctgttatgatccactttaaattgtgatttccagaaatacagtgaatcaaatgtaagagtgctgaacaactgtatcgttgcatttacatgttctttttgttctcatttatttacattgctcagcctctatacacctagaccaagtcattagatactatgaatcttctgaaggttagtttattcagttagatttatatacagatatatcagagaaggattaacttctaaaatttaactcacatcatactagttttagtagtaagttttatgactagtgaactttattcttgaatcacacatttagcagtgtttatttctatgaaatgacctatttcctgccaaaaagaaaaaaaagatgtcttttaattaggactagacttcctctgatactggttttttgtactctttgtatgctataacgttattactggaccagtaaacacatttaaaatgcttaattaaaagtaaattatcaatctaggccaaagtctgtacagagttacagagatatttcacttccacaaagccatgcagacttgtctaggaagctgcacacataaagaaaattagatcatttccaggaaaccgaaacaaacctaaattgtttctgacaaattacacaaatacttactttgtgaagctaggatacctgatgtgtccatgataccagaacgttaaacattacctagtatctgattgaacacaattcctcaccttacaggaaacaaatgggaaatgatatacagtggtgctaccagggaacatctttgtgatcgactgaatccaggctgtttctatcgtttacgagtttactgcatcagtgatggaggacagagtgcggtaatacttatatgtagattcttttgtgttgttattaagtttggccaaatggggtaggatcaccaggtgccacttcaaatattgaaacatatccacaaatggagaaaagtaacttctgtaacctgttgggttaatttgatagtgaccaaaatattctaatgtggtacttagctcacagtaagtattcagtgtgtgtctgttgtctggttggtattcagctttggaaaaacaaatacatgaaaacattggagaaaattttataaagataaatttgagaatgatgctcaataaccatactaagcagagatagaaataaaataattatagaccgatttactgctccataaattatgtgtgtgaggacacatcataaaatagtatctgctgtttaatctactttctaatatttacttacttcaaaaaagttggccattattttattattagagactcaataaccaaaatgaacttaaaatgtaccattgatataaagacataatgttctagggatgtatgtttattaatgagtgattttttttttttttgggaaacagtctcactctgtcgcccaggctggagtgcagtggcacgattggggctcactgcaacctctgcctcctgggttctgcaacctctgcctcctgggttcaagaattctcctgcttcagcctccctagtagctgggactacaggcgccccccaccacaactggctaatttttgtatttttagtagagacggggttttaccatgttggccaggctggcctcgaactcctgacttcgtgatccaccggcctcagcctcccacagtgctgggattacaggcatgagccaccgcacccggccaagtgattttttttttttaaatgaattaaaccaagaatggtttcttggatcattcataattgctgggttttttttttgaaatgaaatttaatgcaatgaaagtattcttttttaaaaatgaaatataggcattttgttgaaaatgaaactaatgtgcaactgagtgtgagtcctgcccaactggcttgtgctccagttgcttcattttatccagtaagaaaatctccctggatttcagaaaagcaacaacacatagacatgcacaaaatcctgttctactatagcattttacagcatttttacatagatagctttctgataaaaagatgaccaaatattttgtgtttaaaaagaatgttaagtatgaaccttaatatgttgcaagtaagtaatatgccactgagtttgtggcattgttttttttgagacagagtctcactctgttgcccaggctggagtgcagtggcacgatctcggctcactgccagctctgcctcttgggttcacaccattctcctgcctcagccttccaagtagctgggactacaggtgcctgccaccatgcccggctacttttttgtatttttagtagagactgggtttcaccatgttaaccaggatggtctcgatcttctgaccctgtgatccacccgcctcagcctcccaaagcgctgggattacaggtgtgagccaccgcgcccggcccagtgtggcattgtttttaacagagtgtctttaaaaataaaggctttttaaaatataaatatagcatagaaactaaaagcagtatcaaatacctagaaagatgccaagtaactggaaaagcttacctgattttagaattatttttaggtggaaaggatgaaggaaagataatcttttaatgtataagttaagcttggtgcagtgacaaatgtgtatagtctcagctactctggacgtgggaggattgcttgagcctaagaatttgaggctgtaatcatacctgtgaatagcaactgcattccatcctgggcaacataccaagaccccatctctaaaaataaataaataaatcagtgtttaggttaaaaatacagtctacagtagtaaagtagccaaaatattctaaacctccttacaacaatacaaacagcatatacagtattttaaaacatccctccttagaagagatttatggatccttttggagaagatcaaaaatattgcccattaaattgtgttggaagttgtttttttctttagttatggaaagaaaaggaaaggaagggttcattgaagttctttttcagtaacttgctttgtatatagtagttgcacagtacatgtctttctttgtctatgaaaattttgagtttttatttaattgggttttcattttttttcagaactttattccttttttgttgacaatcaagtacaatttcaaattatcagtgcaatatttgtgtttatattatttttccttaccaaaagcaatctgattatttggttttggggcatttttgttttctttttgcttttgttttggcaggtctctgaatctttacttgtgcagactccagctgtgcctcctggcccatgcctccctcccagattacagggtagacccaaagcaaaagaaatacagttacgatggggtaatttccattttggtaataaattataattaagctagaacaggaagtattcgtcttgttaaattgcattaatctttccatcttttaggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatgggggtaagaagactgtgctggtagaattataatcacaatggtgatatatgtttcattttaacatatatcatcatatccattatttggccatttggctttaacatatgactccaaattttacaatttttaacaagcctacattgataaatacaagagaagtcggtatattccataacttaatttttatgaaatctcagtatttttagatcccacttacagtttgtgacactttggacttcagctgggctagagtttaccttttaggcagtgttaatagagtttacttaatcaatttaagagtagaaataaaatcataagtactgaagttttttgaggctgattgaagtttttgaggtttttgaggctgattgaagttttttgaggctaaagtagcatttactttcagttggcaactaattatgattcattttttttgcccaaatgaaaaaaaacttatgcttgaaactattctggttttgtatgtattttttgaaatattatctatgtatttaatatataactccaaaaagtggacaaagtaggtgatatctccatttcacaactaaggaaacgggttcaggaaagctaaatattttgcccacagtcatacaaactaataagtgatagaggtaagctacaaaccttagtttgtcagactccagagccaaagctctttccactcagctatgacacctctcatctctctgcaataaagcaggttccctaaggacaaagcagtaatttcctatctcagctaaataacaatttctttcaactattgtataattaaaatttttatagaattaaactgacagttctctcctacccattattttggtgaactatactatatttcaaatcctgttttccaacagggttctgtatttacatctgtaaacttatttttcaatttatttctgtttgattttttgaaacagggtctcaccctgtcacccagggtggaatgcagtggtgtgatcttggctctctgcaacctccgcctcctgggctcaggtgacccttctacctcagcctcccaagtagctgggaccacaggtgtacatcaccacacctggataattttttcatatttttagtagagagagggttttgtcatgttgcccaggttagtctcaaactcctgggctcaagagatctacccacctcggcctcccaaagtagtgggattacaggcaagagccactatgcccggcctaaatttcttatatgtcaaatttatatacttaggctgctcttacacaagtcattcctttctgtaagaagccatcttgtcagcctcacaaggctgcagtacactaggatcgcatctttaatacttacgtcttaatttatattttcaggtttgtgataatttgtcaaaatcaccttaagtaaatatttactttccgtatttccagagaacatacattttagacctttctaaagctattccagattttaagataaaatttatgcctaccagagagcagtactgataaataatgtactataagtacactatttacagttttattttaaataaaatccattcagcatgctagaatggtgaagctttgtcattattttgttgttgtcgacatgaattaaccttgttcaaaaaaggggggcaaaaaaatgacatttgtcatggaaaactttttttaatccctataggacttgaggaacagaatccttacttcagttcttataaatagttgtgctaaacctcaagtttctatcatttagtggccctttccatgctctccatgaactaaactgaattatctgtgtgactgatatgttttcttaggttgccttataacatgtataacagtactctttatttgtagatacctttgtatgtatgtgtgtgtatagacagatagacagactttttttttgagacagggtatctgtcacccaggctggagagcaggggtatgatcatggctcactgcaacctcaacctcccaggcttaagcgatcctcctgcctcagcctcctgagtagcagggactataggtgcacaccaccataccaggctgattttttacttttttatagagatgggggtccccttatgtttcccaggttggtctcaaactctcgggctcaagtgattcccccaccttagcctcccaaagaggtgggattacaggcatgagcctctgcacctgaccttttatatatacttattattgtaaatcatttgctgccactagcagtctgtaagtctatactattaaatgacatattggccaggcatggtggtaaatgcatgtaatcccagcactttgggaggccaaggtgggtgggtcacttgaggtcaggagttcgagaccagcctgaccgacatggtgaaaccccttctctgctaaaaatgcaaaacttagctgggcatagtggcgtgtgcctgtaatcccagctgctctggaggctgaggcaggaaaatcacttgaacctgggaggcggaggttacagtgagctgaaatcatgccactacatccagcctgggcgacagagtgagactctgtctcaaaaaaaaaagcaattaaaaacaaaaaactattaaatgacagatttatatttggaattttggctaggcacagtagctcacacctgtaatcccaatactggggaggccgaggctggcagatcacttcaggccaggagttcgggaccagcctggccaacatcgggaaaccccatatctactaaaaatacaaaaattagctgggcttggtggtacccacacctgtagtcccagctactcaggaggctgaggcacaagaatcgcttgaacccaggaggtggaggttgcagtgagctgagattgtgccactgaactccagcctgggcaacaggctttttctcaaaaaaataataacatatttggaattttaaaattgattgggttttcaaatttattgttttaaattaggaacttttgaactactaataaaactatctgccatagttcattgatttttacatgaaatatttattttcaagatggtttcaagattacttttcacaaagcaggcgcattatatcaccattttgctctgccttgtaaacttgccatctgggatttttgggtggtattcatgtgagagtaaagcatattctctagcagtttcctatagctacaggtttgtttgttttttttcattgcttctaacaggatatagttactatgagtccatgaaatataatggaaatgtgaataaggagtttactgaagactttaaacatttgatttttttttaatcgtgaatatgatagaaactggtagtgttgagcagtgcaaatatttgaagtggtgatttgtgaaatagcccagcattgccttaaacaaaatcacagtctacttcttgttttatacatatgatagtataaaaggtttcttttttttcccattttctgagatttatagattggtatatagctttaaactatataaagttttatggaaagattttttaaacttattaatataaattttaaagttgatataattaaagtgagcctatcttctgtttataaaatgcaagattccttaacatttataattatacagatgaaatagtttctataaggaagttggagttttgattttgccctttatagatgttagattgtgcagatttgtctgtattttctcaccatatcaaataatacttttattataagattggttttcaagagccgtattagttgttataattgattagtatatagtttaactttattcatcatatttatactgtagatttatggccagaggttgaggttatttcaggagagttgatgaccttcatttaaagtctagctaaaatcagtgctgtaaacaaaaggaaacatttacgtttgtttctgtttgccatatatagtagccttgattttttacttttttataaaacagttacgttcacaatattagcctgaggtattaatgacattgtgatgatacaaaatggtgtatattccctgtgcaatcggatttggaggaaaaatgaaggacttaacattatctgaagtcactgatactctgaataagtatggtcaaggagtgaactattttcttttggaaaaactttttaaaattttatttttaaagtattatactgttatttttagggcctaatggttacattgaatagttggtttcaccttcttaaggttttttaccaatattcatgaaacttgatatttttaaaatccctaccctttggtaagtcgttatttattaacatttttattggtgattaatacatgttttttcctaaattaaaaataaataacttggaataattttaatattaaatatttgttaacaactgaatgtttccatagaattttctgagaagttgagtttcttagagttttcgtagctggctgggcccagtggctcatgcctgtaatcccagcactttggctcaagcagtcctccctctgagacaggaggaccacttgtgcccaggagtctgagaccagcctgggcaacatggtgaaaccctgtctctgtaaaaagtagaaaaattagcccagcatggtagtgcacacccgtagtcccagctactcaggaggctgaggtgggaggatggcttgagcccaggaagtcgagggtgcagtgagccatgtttgcaccactgcactcctgcagtctaggtgatggagccagccagaccttgtctcaaaaaaaaaaaaaaaaaaaaaaaaagaagttgagctagctcttaaagatgggcatttggcaaaactgcctgatacagtgcagtaacaagtaggtttacttctgaccattataatgatgcgccactgttaagtgaaaataccagtgtattggggcttttcttttgctaatgagctttgaaaaattgatgacaagaaatttctgtaattgttctcctatgtgtcggggaaggaatttgccaatactgaataaaattttttatattccgggtaatgtatgttaaaagtaattatgagaaagtgagctttttagcatggaacagaaaaatcaaattctgttacaaaataaacaaatttatagaacagaatgttggtaaaatttgatatggaatatgcctaagaaagattcgtgaagtattaaaaaattaaaaataataatttacacctaccatctcccgtacctttaattagtatcaatttcttcactccttatatttctcctgaattattccaccgacctcattccctaatgtcctgcccttcttacaaaaaccatttcctgaagaaataaggggcagaagaaagtataggtaaatgaaactttaaaatttctcacacctttactttcatgatttttaagtctttttagttaatgtgaatacttatagaattatgaccaaattaatcttgaaacacagggaaaagactttattaatgaatctttaaatatgcagttctgtgcaatcagtggacatttaagggtgaaaaataaaaacactagttacatttgtttttctagtttggaccattttcagaaaaatgtgatattactacagcccctgggccaccagatcagtgcaagccccctcaagtgacatgtagatctgcaacttgtgcacaagtgaattgggaggtattgtaatttccattgacttgtatctactttcttaagtgaatagaatagtttatataaaagaataaagatactgttcatttttaccgcctatattatacagagtaagccctagtttaattcacatgaaaaacagtgacttctttttcctctttgaagaatttgagtaaggtatatttgcattacaaatatttagattcctgttcattatgtgctttgtatttttatgaatggctttgtctcagtactgagatatttcagccactgtaagtttaatgttcagaatagacatacacaggaattagtaaattctatttctcttatatttatccagtacacatctccagtgtacttattgtggatagtaataatcagtgatgataattattatattttcagttccctttgaaatttaacaaaatgtgtgtatgcttttaacatttcatattaatagaattatcttgaaacatatttaccttaaaacactctttctaaagtgacttagtcatatttctacttctaattcaaaacagttatatatttgaccaatcttaaattcagataatcttaatgaataaaaaatgtaaaattgaacagttttgattgtgcttaaaagttttaaagaaactcaaaagcaatctagttttacatgtgctcaggtaaagagcatttttggccaaaagctatttaatcaacatcaagactaagacctttatccttttcttaatttaaaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggtaaagatgatcagtaccttgtcacttaactctatccagagttttatatttcattggcattttcatggtcatgactttgttaactcggaggctctgttaatttgtaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacaggtatactctaaaaattatgttgatttttgcctagaccagagagacgctttaaataaaacaatcataaccaaactttttttcttatgtggcacttagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtaggtttttttaattgcttctttatatagtttcttaggtcttaagtatatacatttctgtaactattagaagtaggccaggtgtggtggctgacacctgtaatctcagcactttgggaggctgaggcaggcgaattgcttgagcccaggagtgcaagaccagcctgggcaagacagtgagaccttgtctctaaaaaaaatttattttaatgaagtaagttttcaaaaacgaagtcaagattgtcatacaaaagtgtgctgtttttaaaacgttagaaaacacaatgtacatttcctgtttataatttgtgagtggaataccaagagaaaaaaataagtgggctactgtttggttgttttctgtaatccatttactgttttcatgatagtaaaagacacctaatcttagatacaaaataaactcttcagtgtttatttctagcaggacacaattttttttttttaagacaaggtcttgctctgtcacccaggctggcctccagtggcactatcttggctcattgcaacctctgcctccagggctggagccatcctcccacctcagctccccaagtatctgtgaccacaggcgtgggccactacacctggctaatttttgtatttttagtagagatggggtttcaccatgtcgctcacactggtctcgaactcctgggctcaagtggtcctccccgctcagcctcactgagtgctgagattacaactcatgagccactgtgcctgaccgaaacaattttttttttttttttttttgagacggagtctcactctcaccaggctggagtgcagtgacgcgatctcggctcactgcaatctccgcctctcaggttcaaacaattcccctgcctcagcctcccaagtagctgggactacaggtgcgcaccaccacgcccggctaattttttgtattttagtagaggcggagtttcaccatgttggccaggatggtctccatctcctgacctcccgatccacctgcctcgacctcccaaagtgctgggattacaggcgtgagccactgcacccggccctgaaacaattttatagtaaatgattatgatcgttcctggcctctgagatccttgagggcagagattatgtttcagtcttttccagattcctgacacagggcctgcacgctaaatgaatacagttcagtttttcactgtgtgatctcagttagattctgtgattaattatctagtccctttgctaatcactgttgctaatctttgctaatctttgaattagaaagaacctaatttcattcaggttctttctgtgcctctttcacatcttcatgtacatgttgtactattcctatataatgtgccatatactgccacactaaatcatgtattttaattacagtgttaactctgaatatttgtaacagtcattctaatgccaactagggctatttattcacattatattccatataagcaatgccacatacctcccacagctgttaatcctttaatattttaagaattttgaattttgcttttctacttttcactgaatatattagaaacaatttccaaatctgatggactcagaatactagtaacagtttttcccaagatttacttttctgtgttgtttgtatcttagccaggtattcaacaatgaaatattcatggtgcttgtacataaccactctctatcagaaatacttatacatttaaaataacatatggaataattttgtatactagtatatcaccagtaagaacattacacagaacaaacgtgatcatttcctaaaatctgtatcgatgaatgttagcctttgttcttggcagaattttatgtaatctttgtagccttatctctacaaagagattatttgccttgtacaggtttttggtatagccatttatctttaatatatgttattattactggacaaattaattgtttaaatttttttcctcccctttctagcatacatttggggtagtgcaagaaggcttactggaaacaggtctaattagtgtttggttgaaagataatagaataaagattctattagatataaattctattatagaacttccaacttaatattcagctagcatctagagaattgttatggggtatgaatatggctcatggcctttggttgtggaaaataaagaaattaaaaccttttatgatactgttaagtttaatgcacacatttaataaattaaatcaatttaatatctttgattactttcattccctttgattttcacaactatatacacttgctgtgggatggtatcataatgatactttagttgttccctgatccagattttgtcattgttcagcttttttaaacagtggtattaccactatttttttttcctgtcattaaaaaaaaatttagaggttgaaaaggcaaggcttatccaattactgcttattggaagtactgtttcttcctgtcattaaatatttctttatttttaacttggctacaattttcagactgttagcattgaataagcattcattattcattctctaatttccaaaaattttagaaacatccaatcaaaaataatgggatgcattcaacttatagataacatattaggagaaatatgtatgatattcaacttcattgaacagttcaagtgggtaatgtattggaaattttatattatcatactgcttttgtaaatctctaaaaaaacgtcaccaagtcaactaaaaatctgcctgggaattgagaattctcttttttccagataaagacaaggaagattaaaatagaaacttaatctcatagctcaggtctctatgccatacttggcaaattttatcaatatgactttagttagaaataatttgtaatgaaaattgtgatgttctgagcatcttttaaaatgtacattaacaaaacagtattcagaaacaaagctaaaccggaagcctgagaagaaacagttatggtcggacatgaaatttagtaacagacttttggtaaatcatgtcaaattgggaaatttaccaaatatcctatttttcttaatctgatgaaaaacagatttattttaagtgacatagagttcctggcatcaaacttttggggtaacttatcactcctaaataatgttcataactgtgtttttatactagtttgtaaaacactttaataaggtatcataaggtagtataaggtttatctaatagttatttccattttaggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaaggtaagttatacatcctgaacttattttctttataataaattactttttaatgtattttcataaatgctttgtttactgatattaaaatttagcatccagtatatgtccaccagttatacaaaatcgtataggcaagcccaactctactgagagttccactcaataataaaagctgttttatctggcacgctcatattcagacaagtactggcttttgtcactgatgtttttaataatgtagcataaaaatactaaattgaataggaaggctggttttctaatgaggtcatttgcttaaagaaaaaaatcacaaactctggttgtttaaacgttttgagttattgatattacattcatttggatttcagaaggaaagcttggtcatctgttaagcaaaacaaattcttcattaatgtgggtttttcaattagttttacacacacatgtacacatatttacacacatttgtatatacatttatcttttaattttagaggggttcttattttaaagtgactctggcaagggctacactctatttttagctgaaaagtctataaagttaattgctctgaagactaatcacagagacttctagaaccatatcctagatcatgtacttaaacctatcatttgttaaacagcagaactcttcttgactagtctttctaataatattgagtttcactgagtcatttttctgtttgctcatcaagtttagtgtctcttagctttaagaagagtgctgactataagcagggcacagtggctcacacctataagcccagtgctttgggagactgaagtgggaggctcacttaaggccaggagtattgagaccaacgtgggcaacatactgagacctgcctctctacaaaagaaattttgaatcagctgggcatggcagcatatgcctgtgtgtgtagctgcacaggaggctgaggctgcattgagctatgatcgcaccactgttgtccaggctgggtgacagagtgagatcccatatcttagaatacaagagtgctgattttaacctctttggatgcaaatttcaaaaattcactgatacttatttcaagtttataagtggattttaaatatttgttgatttttattaagacaagtgtctgcatgatgtaccaaattaaaaatcaagtggaacagatattatttatatttgtttcctacagcccccaaaatagagaaagtaaatgatcacatttgtgaaattacatgggagtgtttacagccaatgaaaggtgatccagttatttacagtcttcaagttatgttgggaaaagattcagaattcaaacaggtatgtaccaagatattaatgtgtggatgcatatttttacccttttttaatttttatgtattttcagtgtaagatttggccatctttaccttttaattcataaatatttattcagtatatattatgttccagagatctcaagattccaaatcttttcagtatgaactacacttgaacagattattcatttatctgataagtattcattgaattctgtgccaggcactcaggatatagcactgaacaaaaagtcccttgcctccatggagcttacttacattctggtggaaaagaagacactataagcaagtaaacatgacaatatattgtcagatataagtgtaatggagaaaaaacaaaattggataaaagaaatagggagtggagggggagggcactgagtgttatttcatttggggcactcagctgacatttcagcatggcccagaggagatgactatggagagaagagtgttccaagaagatacgctgaggcaggaacatgcctattaaatctgatgaacataaaggagccaatatgactggatggagagagcaaagggaagagttgataaggtcggatagttaatcctaaggggcctataggtggtatggagtgacgtaaggcataataggccatactgtggcttttactccacgtgaaatgagaagacagtggaggattttgaccagggtattcacgtgatcagacacaacgttgttttgactatagtgttgaaactacagtaggacaagggcagaactagaaagactaataaggaggcttttacaataatagtattaataatagtcataatgcagtgctgtaaatatgacattaggcatgaagttataatggaaacctagaggaattgtcaccttcctagccaagaggtttcaaagatagctttctgataaagcaagaatagcagtgagatagagtggagtgttgccaatgtttgttacaacttttaaaaagaataagcttttataccactccaaagactaattaaatacctatacatttcacctgattttccctttttcctgtaaccttaattttgagggcttttaagctgggttgttttcattgtgtcttatattttcctcttccactaaaaaaaagatccttcatttgttttattccagtattgtgctattgtaaccactctatgtaatatcttaactgaaattacaaaagatccaaagagtcagattaaatctggcatgcaattgtttttctttattaagccatctgcaaattgacaggataattagatttgaaatgtaatttacagataagtaggtttccttctaaggaggaagcaaaattaatattaaagaaaatataattgtattacacgtttaaaggaaatagggattccacatttgagtagtatatgaataaccttaaggcttgtttgaatgacttttcttgggtgtataaaccttctgaaattagcttgagcaggttaatctgttttcttcagtcctgtatttacagttacctgtgtctcttcctgcttagaggtcttcccacatctgaaatacaaaattgaaaacttgatcccatcatcttccctcccagtatctcctctccaacatctttacttcatcagtgtcatagacaccaatatcatcttggtctccaagctttaaattcttagatgaatttttttttcctatcaactcttaatcagaatttgtttctaaatccataaaactacatcagggcctcatcactttttacatgtacatcaagagtccctgtcctactcagctcccttcagtccttcacacagcctcacgattaggattccataaacactgttttaatgtcacacacctacagtggtcccttttgaattaacctaaatttccaactagtgtaattaatgtattcttcctctttgtaccagatctcttatcaccctcatgccatttgttgaggtttttctttcttaacctaatactgccaggctcatggaatggtatatgaagacacatggaaagtataaagacaaaaatcatctattatatccataagacaaatacatatttttaatttttactcaatttacttcagtgttatgtatacaattttacactactttatcatacaacattctgttttaagtgaatccttttacaggttgaagcatcccaaataaagtccaaaattcaaaatgttccacccaaaatctgaaactttttgaggatcgatatgacactcaaaggaaatgctcattggagcatttccaatttcagatttttgggtttggaatgctcaactagtaaatatgcaactattccaaaatcaaaaaaattgaaatgcttctggttccaagcatttcttataagggatacccaacctgtaccatctcccaaacatggatcatttctacattctattccctgaaacattatgcatccttagaactaatgtatagtcaccattttctttcagatttatcttaaagcttctttcagtaagttcctttatatattgttatcagcatccacatttttatttattgccaataattcactaatttaatgtccttttattaagtacctactatatgctagattctggagacagaaaaatgagacagagatcttactttactttgagagcaaagcaatatgtaaaaatttagatttacatcacaggtacaattgaggcagctaaaagtacttgaaagcccccatgtgttggttcttctgacttgtagcccaccaactaactggagaaactcaactgacaagtcatttaaccctatgaaccttggttttctcaattacagaatgagtggtgggaggttgctcattattggaaatgatagctcctacagattgagcagtgactgcatgctgagcactgcgctaagtgctttaacaagcattagttcatttcatcctcataattatcatacatgttaactactagtatgtctgttatactaaggtagttggtctaaaatcacatctggagtgtgaagtggtagagcagaccttggatgccaggggtgaacagttctagtatatagcttcttatttatgcctagtgttccattattggaacactaagcttgtggtagttatttatatctcactgatcaaggttattgccaaggtctgatttttcacaaaaaaaaaatttgcaacctctggcataaatgggttaattactagcacattcctctgaaaatccgtggaatttcattctttttatttcccttgtgaggcatggcagaggaggtcctattttctgattctaagtgatctcccctctctggtttatacagtgatttgccataggcacctatagaaagctccccttattcattttccatttcattgtacagatatgtttgaaattatatggaaatttatcagttatacaaagacataatgggggaagcaaaagtagacactatcccttctttgatggaatgattgcattgaaaaatgacttcttacatttgagaaaagcaagaaaatgcttgaggaccgattttgcttgttctctagctgccctggggcacatctgcactccttaattcatctgtgaaccgtataagggtagatcctcgcttttgaaatttctcttgcccctatgcaacaaacagataagtactttaatggacaggtatttttaacatgtcatttaaaagataaaatcaatggcattcactggctttcacatgaaaaacaattctaacactagccagttttaacacattttctgtccagccttcacacgtaattcttccttctaatattttattaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagacatggaaaagaattgagtgcttttaaatactttttagaaagtaatcataaaagtaaattgaatttcaaacctatttggcttctgttttgtgaaccttttgactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatcctagtgactt

SEQ ID NO: 10205 - DNA, 832 bp, Homo sapiens
ttttttttattcaagaggtaagtacatagcttcaagctcaaggtctaggttgaggacaatcatgagtcctattaaaggacaaccagtttaaagaacactgtcaggcaagctaccacgtagctctccttcactccaggcttagctgttccagacttcccagtactgatgaaggatcatgtttttgttcagctttgcccagtgctgtcattcataatagataaatgaaaagtcccagaaacctgttgtgtttgggaaggttttcttttgttccaggcttcagtggttaatatgcttgacaaatttcagagtctctatctctgtagaccaatgccaaagaattgctttctggattcactgttagcagctcttcgtcttcatctttggcaatgtaagaaaaccaccatattctggcccccagccttcacagccacagtggagaattaagtctagggcaaaatcagccttgccatggtcacgaattaaaagtgtggtgaccagtcttccaacgcctcagttccctttggcatgtgggaacacctgattcattctttgtttcattttcctctgactcggtctgtctgctcatggctctgttggccgttgatgctgatggctgcctgattattctctggctcaggagggctatggccagtcccttcctcagttctatcagcagcagaggctgctgcttcctcttttttgtcatccatctcatcttccgaaggggccaagaagtgaagcttcaggcctgtgaagttggagagcagcaagaatagtgcctcagagcaaaataacttcatgcactccttcaatatatcaggaagcttactct

SEQ ID NO: 10206 - DNA, 832 bp, Homo sapiens; identical to SEQ ID NO: 10205

SEQ ID NO: 10207 - DNA, 3004 bp, Homo sapiens
catacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactga

SEQ ID NO: 10208 - DNA, 486 bp, Homo sapiens
aggtggcgggaaaatgtaaaactttaaagctcatgagcggaacgcaatgcaagtcctgaaactaagagttaaatgtgagtctcagggaaaaaagctagattagcaaatcaaacatacatatgcctcatccagaacatcattcaggcatcagttcgggggctactagcagtaaagttggttttaaatgaaataaagtggaaaagtttgatatcacttccagaagtggtctgtcatcagtaagtattggtgttgagtctaaaatgaattagaaacctcccgttactcttaggattaaagcaacccggtatggagagaaatgaaagaaaaaatgtagtgttagcttgactttatgtccctttcactgaattccatatgagcctatttggcagagaaattttgtactctacaaggaaaacatcactgatgtggacagcaccaataatgtacgtcccattaagctaataaatacccagacggccgtgtgaa

SEQ ID NO: 10209 - DNA, 927 bp, Homo sapiens
cctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagta

SEQ ID NO: 10210 - DNA, 2456 bp, Homo sapiens
gtgagcctctgcacccagccacagtggtgactattgaacaaaactgaataatagtcacatctcctgctcccttgaatgcagaagcaattgtacttcagggcatggtgttatctacttgcaaactttttattttttgatcttacagcaactacttttgatagtacctcactaaaaacatcagcaaggagccaccaatatacattgaccactctggttctaactgctttccccatagctagtctgcctttcaaattgttgctggtgtcagttttacctagtgattggtcaaaacataacaagggtctctagtttttcatcctgcaatatctgtttccacactgccggttgcctggcaacacaataccagagccacatattttagatttttgttatgatggcacttttccattcctacgtatcagtcagctagagctgcataacaaatagcaaagactgggtggcttaaacaaccaaaatttgttttttaacagttctgagggccaaaagttcaaggtcaaagtgttggcaagtttggtttctcctgaggcctctctccttggcttgcagatggctcccttcttgctgtgtccttacactaggcacttgtgcccctaatgtctccctgtgtgttccagtgttctcttataaggacaccagtcttataagattagggcccctctctatgatttcatttaaccttaattatctcctgaaaggccctatcttccaatatagttacattggggctttggccttcaacctataaattttgggggtctacaacttagtccataatattctggtactgaatttaaaactattagggtgtcggctaagccactgtaacagagaaacccccaaatactgtagttccaataagataatttattttctttcttgtagccatcaggaggtagcccatgaaattgtccagggacttatatttattctaccattatttttactctattattattttatattattattatacttattctaccatttattctgccattccctagagtgtcctcttcatagtggtcaacctgtgggatggagaagagaaaagtaaagggcaagcacatacatttgaataaaatgagatagaagttgcacacatcaagtttgtatattcttttggtaagaaattaactgcagaggaacctcttgctgagcagccatgccttctaaaacctgggacagagattttattattaaaatgaggaaagggagaatgaacgggggggaggattatcagttccttcctacattcctcttctatacatcttacattttgtattgagtatgagaagagacctgaaatttagatgattctttacatttttatttatctaaaattgaagtttacctaatttagtttaatttaattattttactgatttaaattaatcagaattttcttaaaattcagtaaaagaaaaaaacgtaagggaagctttgttgctttgcaaaatagggagatatttcaggaaggtaaggggagaggtctatcctacagtatggagtacagaagtgggacttagagatagccaagagagtttgaaatattcaaagaatatatacaatataatctgtagccttttttaaaaaaaaaattagaatttccatctctctgaatgtattccagttgtaaaaaaaaaatgtattgagtttcccatcatatggaagtttttaaaattgtaggaaataaaatattcagaaggctacacaaggtattaaaaaaggggacagggatataatagcttactagcttattagaatgaatttggttccttatgagggataatctagagaaaagaggcatagaataagatctttggaaccaaacagtctgagtttgaatcctggctctcccttttggcatctgtgtgatcttgggcaagctacctaatttctattacagctttgttatctcaactgtaaaatgaggctgatattgatatatcattggagaggactaaatgagaccatgcaaaatgtgtacttggcacagtgcctgatccacaaatactgatgatgatgatgatgatgatgatggtggtggtggtggtggtgatgatggtgataataacagtgatgatgatggtagtatagcattagtgcagcaaaaaggaaaaatggactcaaaactaatttttcctaaaaatttgtgcttttatttatcagatgcttctaacttagtccccaccagtctaagactagaacaatattgggattttccttttcagaagttctatcattggcaagttgtttttatttccagaactccaactcagaagaaatcacctctgaattcattgtctatttaataaagtcaagattcttcaaattctccattttattcagtattaaataactttcaaaatatggctatcttgaaagtctccacttcctcatacttagcaatttccagcattatttaaaaaaaaaat

SEQ ID NO: 10211 - DNA, 2458 bp, Homo sapiens
gtgagcctctgcacccagccacagtggtgactattgaacaaaactgaataatagtcacatctcctgctcccttgaatgcagaagcaattgtacttcagggcatggtgttatctacttgcaaactttttattttttgatcttacagcaactacttttgatagtacctcactaaaaacatcagcaaggagccaccaatatacattgaccactctggttctaactgctttccccatagctagtctgcctttcaaattgttgctggtgtcagttttacctagtgattggtcaaaacataacaagggtctctagtttttcatcctgcaatatctgtttccacactgccggttgcctggcaacacaataccagagccacatattttagatttttgttatgatggcacttttccattcctacgtatcagtcagctagagctgcataacaaatagcaaagactgggtggcttaaacaaccaaaatttgttttttaacagttctgagggccaaaagttcaaggtcaaagtgttggcaagtttggtttctcctgaggcctctctccttggcttgcagatggctcccttcttgctgtgtccttacactaggcacttgtgcccctaatgtctccctgtgtgttccagtgttctcttataaggacaccagtcttataagattagggcccctctctatgatttcatttaaccttaattatctcctgaaaggccctatcttccaatatagttacattggggctttggccttcaacctataaattttgggggtctacaacttagtccataatattctggtactgaatttaaaactattagggtgtcggctaagccactgtaacagagaaacccccaaatactgtagttccaataagataatttattttctttcttgtagccatcaggaggtagcccatgaaattgtccagggacttatatttattctaccattatttttactctattattattttatattattattatacttattctaccatttattctgccattccctagagtgtcctcttcatagtggtcaacctgtgggatggagaagagaaaagtaaagggcaagcacatacatttgaataaaatgagatagaagttgcacacatcaagtttgtatattcttttggtaagaaattaactgcagaggaacctcttgctgagcagccatgccttctaaaacctgggacagagattttattattaaaatgaggaaagggagaatgaacgggggggaggattatcagttccttcctacattcctcttctatacatcttacattttgtattgagtatgagaagagacctgaaatttagatgattctttacatttttatttatctaaaattgaagtttacctaatttagtttaatttaattattttactgatttaaattaatcagaattttcttaaaattcagtaaaagaaaaaaacgtaagggaagctttgttgctttgcaaaatagggagatatttcaggaaggtaaggggagaggtctatcctacagtatggagtacagaagtgggacttagagatagccaagagagtttgaaatattcaaagaatatatacaatataatctgtagccttttttaaaaaaaaaattagaatttccatctctctgaatgtattccagttgtaaaaaaaaaatgtattgagtttcccatcatatggaagtttttaaaattgtaggaaataaaatattcagaaggctacacaaggtattaaaaaaggggacagggatataatagcttactagcttattagaatgaatttggttccttatgagggataatctagagaaaagaggcatagaataagatctttggaaccaaacagtctgagtttgaatcctggctctcccttttggcatctgtgtgatcttgggcaagctacctaatttctattacagctttgttatctcaactgtaaaatgaggctgatattgatatatcattggagaggactaaatgagaccatgcaaaatgtgtacttggcacagtgcctgatccacaaatactgatgatgatgatgatgatgatgatggtggtggtggtggtggtgatgatggtgataataacagtgatgatgatggtagtatagcattagtgcagcaaaaaggaaaaatggactcaaaactaatttttcctaaaaatttgtgcttttatttatcagatgcttctaacttagtccccaccagtctaagactagaacaatattgggattttccttttcagaagttctatcattggcaagttgtttttatttccagaactccaacatcagaagaaatcaccatctgaattcattgtctatttaataaagtcaagattcttcaaattctccattttattcagtattaaataactttcaaaatatggctatcttgaaagtctccacttcctcatacttagcaatttccagcattatttaaaaaaaaaat

SEQ ID NO: 10212 - DNA, 2452 bp, Homo sapiens
gtgagcctctgcacccagccacagtggtgactattgaacaaaactgaataatagtcacatctcctgctcccttgaatgcagaagcaattgtacttcagggcatggtgttatctacttgcaaactttttattttttgatcttacagcaactacttttgatagtacctcactaaaaacatcagcaaggagccaccaatatacattaaccactctggttctaactgctttccccatagctagtctgcctttcaaattgttgctggtgtcagttttacctagtgattggtcaaaacataacaagggtctctagtttttcatcctgcaatatctgtttccacactgccggttgcctggcaacacaataccagagccacatattttagatttttgttatgatggcacttttccattcctacgtatcagtcagctagagctgcataacaaatagcaaagactgggtggcttaaacaaccaaaatttgttttttaacagttctgagggccaaaagttcaaggtcaaagtgttggcaagtttggtttctcctgaggcctctctccttggcttgcagatggctcccttcttgctgtgtccttacactaggcacttgtgcccctaatgtctccctgtgtgttccagtgttctcttataaggacaccagtcttataagattagggcccctctctatgatttcatttaaccttaattatctcctgaaaggccctatcttccaatatagttacattggggctttggccttcaacctataaattttgggggtctacaacttagtccataatattctggtactgaatttaaaactattagggtgtcggctaagccactgtaacagagaaacccccaaatactgtagttccaataagataatttattttctttcttgtagccatcaggaggtagcccatgaaattgtccagggacttatatttattctaccattatttttactctattattattttatattattattatacttattctaccatttattctgccattccctagagtgtcctcttcatagtggtcaacctgtgggatggagaagagaaaagtaaagggcaagcacatacatttgaataaaatgagatagaagttgcacacatcaagtttgtatattcttttggtaagaaattaactgcagaggaacctcttgctgagcagccatgccttctaaaacctgggacagagattttattattaaaatgaggaaagggagaatgaacgggggggaggattatcagttccttcctacattcctcttctatacatcttacattttgtattgagtatgagaagagacctgaaatttagatgattctttacatttttatttatctaaaattgaagtttacctaatttagtttaatttaattattttactgatttaaattaatcagaattttcttaaaattcagtaaaagaaaaaaacgtaagggaagctttgttgctttgcaaaatagggagatatttcaggaaggtaaggggagaggtctatcctacagtatggagtacagaagtgggacttagagatagccaagagagtttgaaatattcaaagaatatatacaatagaatctgtagccttttttaaaaaaaaaattagaatttccatctctctgaatgtattccagttgtaaaaaaaaaatgtattgagtgtcccatcatatggaagtttttaaaattgtaggaaataaaatattcagaaggctacacaaggtattaaaaaaggggacagggatataatagcttactagcttattagaatgaatttggttccttatgagggataatctagagaaaagaggcatagaataagatctttggaaccaaacagtctgagtttgaatcctggctctcccttttggcatctgtgtgatcttgggcaagctacctaatttctattacagctttgttatctcaactgtaaaatgaggctgatattgatatatcattggagaggactaaatgagaccatgcaaaatgtgtacttggcacagtgcctgatccacaaatactgatgatgatgatgatgatgatggtggtggtggtggtggtgatgatggtgataataacagtgatgatgatggtagtatagcattagtgcagcaaaaaggaaaaatggactcaaaactaatttttcctaaaaatttgtgcttttatttatcagatgcttctaacttagtccccaccagtctaagactagaacaatattgggattttccttttcagaagttctatcattggcaagttgtttttatttccagaactccaactcagaagaaatcacctctgaattcattgtctatttaataaagtcaagattcttcaaattctccattttattcagtattaaataactttcaaaatatggctatcttgaaagtctccacttcctcatacttagcaatttccagcattatttaaaaaaaaaa

SEQ ID NO: 10213 - DNA, 2210 bp, Homo sapiens
gcagtggcacgatctcggctcactacagtctccacctcctgggttcaagtcattcctctgcctcagcctcccgagtagctgggactacaggcacgcaccaccacgcctggctaatttttttgtattttagtagagacggggtttcacccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagtcttgctcgtcagcttctgtggccccgtctgaaacttttgagggacatcgcagcttttgcagcccctgcttgctggtgcagacttttagacctagattgccttagagactgaaaaatatacgcttttataggccggggttttagttcatttgactgtaataaagacttcaatgccgtttttaatgtttgactgctgacatctttcaagactcacctttcccttctcccttatgctgcacatctgggcaagctgatggaagcatgggtgcctcctcctttggccccagcaggaagttcaaatcacgcaagccctggcatgcatgcaggaagcttcaccccagcctcacactctaagacggataaaagccaaaccaattaagccgtttctcgaccctcctgggagcctgccctatctccctggaaagtctcagtatgtgagtaataaacctttttataccca

SEQ ID NO: 10214 - DNA, 2210 bp, Homo sapiens
gcagtggcacgatctcggctcactacagtctccacctcctgggttcaagtcattcctctgcctcagcctcccgagtagctgggactacaggcacgcaccaccacgcctggctaatttttttgtatttttagtagagacggggtttcaccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagtcttgctcgtcagcttctgtggccccgtctgaaacttttgagggacatcgcagcttttgcagcccctgcttgctggtgcagacttttagacctagattgccttagagactgaaaaatatacgcttttataggccggggttttagttcatttgactgtaataaagacttcaatgccgtttttaatgtttgactgctgacatctttcaagactcacctttcccttctcccttatgctgcacatctgggcaagctgatggaagcatgggtgcctcctcctttggccccagcaggaagttcaaatcacgcaagccctggcatgcatgcaggaagcttcaccccagcctcacactctaagacggataaaagccaaaccaattaagccgtttctcgaccctcctgggagcctgccctatctccctggaaagtctcagtatgtgagtaataaacctttttataccca

SEQ ID NO: 10215 - DNA, 2210 bp, Homo sapiens
gcagtggcacgatctcggctcactacagtctccacctcctgggttcaagtcattcctctgcctcagcctcccgagtagctgggactacaggcacgcaccaccacgcctggctaatttttttgtatttttagtagagacggggtttcaccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagtcttgctcgtcagcttctgtggccccgtctgaaacttttgagggacatcgcagcttttgcagcccctgcttgctggtgcagacttttagacctagattgccttagagactgaaaaatatacgcttttataggccggggttttagttcatttgactgtaataaagacgtcaatgccgtttttaatgtttgactgctgacatctttcaagactcacctttcccttctcccttatgctgcacatctgggcaagctgatggaagcatgggtgcctcctcctttggccccagcaggaagttcaaatcacgcaagccctggcatgcatgcaggaagcttcaccccagcctcacactctaagacggataaaagccaaaccaattaagccgtttctcgaccctcctgggagcctgccctatctccctggaaagtctcagtatgtgagtaataaacctttttataccca

SEQ ID NO: 10216 - DNA, 622 bp, Homo sapiens
aatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 10217 - DNA, 1511 bp, Homo sapiens
gtaaaataaactgatatttctgcagctctacgctgtattcagcgctaagagcaggtagtcaaactgtaaagcaaaccaggtgtcatgactctgccttcctggttttcctgctacctctctgactgccccttaagaggtcctctctctcctcctgtcctctcatttttagtttccctcaaaggcttagtcatgggcctcagaccttctaaatatgctcctggcttcaattatcacctctatgcagctgaatccaagtctatacagctagtcctaaattgcacctgatttccaactgtctattaaggcttcctctcttaagtgggaaggtcatatcctatggctcccaaccccatatattcaaattaaatgcacaatctttctgctcctcatgctccacaaaccacttccctttctaagtgctcaatttctatcagctattaaatttatatcaaatatccctattatttctttatcaccttggcctgaaacctcagtattccctttaccactacgcctcttgtagttttcttaataatgtccaatgtcctccaaaatgtcacttggattcacctttcctcctccttttcctcacttcattcctgtgattgttttctcgctgtatttattttctcctccatttgattcattttcactcaccatcagacccatttttctaaaatcgttttcatcaaatcaatctctctgcacaactcaagaaggctcaattgaatcactactgattgcagcctcaaggctaaactgttgtgacagactctcaaagccatccataatgtgccccctctcctctccccagttatctaaatttatctccccttcattccaaatcagtggttctcaattttgctgccgagggacatttggcagtatctggagacatttttaattgtcatgacttggagtaggggggagtacaaccacatctagtgggtgaaggccagggattctgctaaacatcctacagtgccaggacagcccccaacaacaaagaattagccagcccaaaatagcaagagtgccaaggccgagaatctgctccaaatcaaggctctctgtccccagaccatgctatatctatacctctgctcagaatatttccctagcaacttagaatgtcgtctctcttccccttaactatcaatgttttatttatcttcaaatcccattctaagtctatagcccatggctttaaataccatccagtggtgacgcctccaaaatgtttatcttatcttctgagttccttacccagctgcctactagacatctcctgagtgtactatttaacatatctgaacctgaattcctgactcccccaaaactccttctcctcaaataggtatacagccccagcaatcacccagttgctcaggaaaacaggtgggagttattctggatgctctcctcaacgttctctgctccagtgtcttgccacaaatcaatccattagcaagttctgtcaagagtctacctccagacacatcttaaatcca

SEQ ID NO: 10218 - DNA, 154 bp, Homo sapiens
gtactttttggagagacagggtttcgcctgttgcccaggctggtcttgaactcctgagctcaagctatctgtctaccacggcctcccaaagtgctgggattacaggcacatgccaccatgtctggcctactgtaatttttaatttcatatttac

SEQ ID NO: 10219 - DNA, 273 bp, Homo sapiens
accaccctagaccttgaaattttctgaagaagccatgttgtttgaggttccaaacccttgcacttacagggtttgctgccctgcaaaggactttcccacctttccactatccacctagaaaattcctaccaaatccttcaagacacggagcaggtattgtttcttcagtcacctcacaggccccattcctccctcaggtgacctcacccccaggtttgcacagcactcgtcctatcctattgcaattatttttatacccatttgtcttccctt

SEQ ID NO: 10220 - DNA, 142 bp, Homo sapiens
tttcttttggagacggagtttcgctctgttgcccaggctggagtgcagtggcgcaatctcagctcactgcaagctccgcctcccaggttcacgccattctcctgcctcagtctcccgagtagctgggactacaggtgcccgc

SEQ ID NO: 10221 - DNA, 147 bp, Homo sapiens
cacaatttttttttttttttttttttgagatggagtctcgctctgtcgcccaggctggagtgcagtggcgcgatctcggctcactgcaagctccacctcctgggttcacgccattctcctgcctaagcctcccgagtagctgggacc

SEQ ID NO: 10222 - DNA, 143 bp, Homo sapiens
catttcttttttttttttttgagacggagtctcgctctgtcgcccaggctggagtgcagtggcgcgatctcggctcactgcaagctccgcctcccaggttcacgccattctcctgcctcagcctccccagtagctgggactac

SEQ ID NO: 10223 - DNA, 170 bp, Homo sapiens
cagtctttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggc

SEQ ID NO: 10224 - DNA, 159 bp, Homo sapiens
tatttttctttttcttttctttttttttttttttgagacggagtctcgctctgtcacccaggctggagtgcagtggcgcgatctcggctcactgcaagctctgcctcctgggttcacgccattctcctccctcagcctcccgagtagctgggaccacag

SEQ ID NO: 10225 - DNA, 1843 bp, Homo sapiens
gcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgtttttgtttatctcaaaataatgttgaaatacaattatcaatgaaaaaactttcgtttttttttttgtttgttttgtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaatttttttgtatttttagtagagacagggtttcatcatgttggccagactggcctcgaattcctgacctcaggcaatccacccgcctcggcctcccaaagagctgggattacaggcgtgagccaccgcaccctgccgaaaaaaacttttttttttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcattggtgttcttgtccagat

SEQ ID NO: 10226 - DNA, 154 bp, Homo sapiens
caatttctttcttttttttttttttttttgagacggagtctcgctctgtggcccaggctggagtgcagtggcgtgatctcggctcactgcaagctccgcctaccgggttcaagccattctcctgcctcagcctaccgagtagctgggactacca

SEQ ID NO: 10227 - DNA, 150 bp, Homo sapiens
  misc_feature (130)..(130): n equals a,t,g, or c
aagttgtttttttttttttttttttgagacggagtctcgctctgtcgcccaggctagagtgcagtggcgcgatctcggctcactgcaagctccgcctcccgggttcacgccattctcctgccccagcctnccgaatagctgggactacag

SEQ ID NO: 10228 - DNA, 155 bp, Homo sapiens
ttctttttttttttttttgagatggagtctcgctctgttgcccaggcgggagtgcagtggggcaatctcagctcactgcaagctccgcctcctgggttcacgccattctcctgcctcagcctcctgagtagctgggactacaggcacccgctacc

SEQ ID NO: 10229 - DNA, 162 bp, Homo sapiens
tttgttcttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagct

SEQ ID NO: 10230 - DNA, 153 bp, Homo sapiens
ggccccactgctttcttttttttttttttttttttgagacggagtctcgctctgtcgcccaggctggagtgcagtggcgcgatctcggctcactgcaagctccgcctcccgggttcacgccattctcctgcctcagcctcccgagtagctggg

SEQ ID NO: 10231 - DNA, 158 bp, Homo sapiens
attttcttttttcttttttctttttttttctgagacagagtctcgctctgttgcccaggctggagtgcagtggcgcgatctctgctcactgcaagctccgcctcctgggttcatgccattctcctgcctcagcctcccgagtagctgggactacaggc

SEQ ID NO: 10232 - DNA, 141 bp, Homo sapiens
ctcttttttttttttttttggagatggagtcttgctgtgtcacccaggctggagtgcagtggcgagatctcgcctcactgcaagctctgcctcctgggttcacgccattctcctgcctcagcctcccgagttgctgggact

SEQ ID NO: 10233 - DNA, 1432 bp, Homo sapiens
atttttagtagagacaggtttcatcatgttggccagactggcctcgaattcctgacctcaggcaatccacccgcctcggcctcccaaagagctgggattacaggcgtgagccaccgcaccctgccgaaaaaaacttttttttttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcattggtgttcttgtccagat

SEQ ID NO: 10234 - DNA, 150 bp, Homo sapiens
gccaattcttttttttttttgagacagagtctcgctctgtcgcccaggctggagtgcagtggcgcgatctcagctcactgcaagctccgcctcccgggttcacgccattctcctgcctcagcctcccgagtagctgggactacaggcgcc

SEQ ID NO: 10235 - DNA, 142 bp, Homo sapiens
tccattttttttttttttttttttgagacggagtctcgctctgtcgcccaggctggagtgcagtggcgggatctcggctcactgcaagctccgcctcccgggttcacgccattctcctgcctcagcctcctgagtagctggg

SEQ ID NO: 10236 - DNA, 1372 bp, Homo sapiens
aggcaatccacccgcctcggctcccaaagagctgggattacaggcgtgagccaccgcaccctgccgaaaaaaacttttttttttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcattggtgttcttgtccagat

SEQ ID NO: 10237 - DNA, 166 bp, Homo sapiens
ctgcctacatgttttttttgttttttttttttgagacggagtcttgctctgtcacccaggctggagtgcagtggcacgatctcggctcactgcaagctccgcctcccgggttcacgccattctcctgcctcagcctcccgagtagctgggactacaggcgcacgcc

SEQ ID NO: 10238 - DNA, 906 bp, Homo sapiens
ggcatgggcaaggacttcacgtctaaaacatcaaaagcaatggcaacaaaagccaaaattgacaaatgggatctaattaaactaaagagcttctgcacagcaaaagaaactaccatcagagtgaataggcaacctacaaaatgggagaaaattttcgcaacctactcatctgacaaagggctaacatgcagaatctacaatgaactcaaacaaatttacaagaaaaaaccaaacaaccccatcaaaaagtgggcaaaggacatgaacagacatttctcaaaagaagacatttatgcagccaaaaaacacatgaaaaaatgctcaccatcactggctatcagagaaatgcaaatcaaaagcacaatgagataccaactcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcctttgctatatacccaaaggactataaatcatgctgctataaggacacatgcacacgtatgtttattgcggcactattcactattgcaaagacttggaaccaacctaaatgtccaacaataatagactggattaagaaaatgtggcacatatacaccatagaatactatgcagccataaaaaatgatgagttcatgtcctttgtagggacatggatgaagttggaaatcatcattctcagtaaactatcgcaagaacaaaaaaccaaacactgtatattctcactcataggtgggaattgaacaatgagaacacatggacacaggaagaggaacatcacactctgggg

SEQ ID NO: 10239 - DNA, 368 bp, Homo sapiens
ctcattgtggttttgatttgcatttctctgatggccagtgatgatgggcattttttcatgtgtcttttagctgcataaatgtcttcttttgagaagtgtctgttcatatactttgcccactttttgatggggttgtttgtttttttcttgtaaatttgtttgagttcactgtagattctggatattagccctttgtcagatgagtagattgcaaaatttttctcccattgtataggttgcctgttcactctgatggtagactcttttgctgtgcagaagctctttagtttaattagatcccatttgtcaattttgtcttttgttgccattgcttttggcgttttagacatgaagtccttgcccatgcc

SEQ ID NO: 10240 - DNA, 4704 bp, Homo sapiens
agagaaaaaagaataaaaagaaacaaagcctccaagaaatatgggactatgtgaaaagaccaaacctacgtctgtttggtgtacctgaaagtgacggggagaatggaaccaagttggaaaacactctgcaggatattatccaggagaacttccccaatctagcaaggcaggccaacattcaaattcaggaaatacagagaacaccacagagataatcctcgagaagagcaactccaagacacataattgccagattcaccaaagttgaaatgaaggaaaaaatgttaagggcagccagagagaaaggtcgggttacccacaaagggaagcacatcagactaacagctgatctcttggcagaaactctacaagccagaagagagtggggggcaatattcaacattcttaaagaaaagaattttcaacccagaatttcatatccagccaaactaagcttcataagtgaaggagaaataaaatactttacagacaagcaaatgctgagagattttgtcaccaccaggcctgtcctaaaagagctcctgaaggaagaagcactaaacatggaaaggaacaaccagtaccagccactgcaaaaacatgccaaattgtaaagaccatcgaggctaggaagaaactgcatcaactaatgagcaaaataaccaactgacataataatgacaggatcaaattcacatataacaatactaactttgaatgtaaataggctaaatgctccaattaaaagacacagactggcaaattggataaagagtcaagacccatcagtgtgctgtattcaggaaacccatctcacgtgcagacacacacataggctcaaaataaagggatggaggaagatctaccaagcaaatggaaaacagaaaaaggcagggattgcaatcctagtctctgataaaacagactttaaaccaacaaagatcaaaagagacaaagaaggccattacataatggtaaagggatcaattcaacaagaaaagcaaactgtcctaaatatatatgcacccaatacaggagcacccagattcataaagcaagtccttagtgaactacaaagagacttagactcctacacaataataatcagagactttaacaccccactgtcaacattagacagatcaacaagacagaaagttaacaaggatacccaggaattgaactcagctctaaaccaagcggaactaatagacatctacagaactctccaccccaaatcaacagaatatacattcttttcagcaccacaccacacctattccaaaattgacatagttggaagtaaagcactcctcagcaaatgtcaaagaacagaaattataacaaactgtctctcagaccacagtgcaatcaaactagaactcaggattaagaaactcactcaaaaccactcaactacatggaaactgaacaacctgctcctgaatgactgctgggtacataacgaaatgaaggcagaaataaaggtgttctttgaaaccaatgagaacaaagacaacataccagaatctctgggacacattcaaagcagtgtgtagagggaaatttatagcactaaatgcccaaaagagaaagcaggaaagatctaaaattgacaccctaacatcacaattaaaagaactagagaagcaagagcaaacacattcaaaagctagcagaaggcaagaaataactaagatcagagaagaactgaaggaaatagagacacaaaaaacccttcaaaaaattaatgaattcaggagctggttttttgaaaagatcaacaaaattgatagacagcaagactaataaagaagaaaagagagaagaatcaaatagacgcaataaaaaatgataaaggggatatcaccaccgatcccacagaaatacaaactaccatcagagaatactataaacacctctatgcaaataaactacaaaatctagaagaaatggataaattccttgacacatacatcctcccaagactaaaccaggaagaagttgaatctctgaatataccaataacaggcactgaaattgaggaaataatcaatagcttaccaaccaaaaaaagtccaggaacagatggattcacagccgaattctaccagaggtacaaggaggagctggtaccattccttctgaaactattccaatcaatagaaaaagagggaatcctccctaactcattttatgtggccagaatcatcctgataccaaagcctggcagagacacaaccaaaaaagagaattttagaccaatatccttgatgaacattgatgcaaaaatcctcaataaaatactggcaaaccaaatacagcagcacatcaaaaagtttatccaccatgatctagtgggcttcctccctgggatgcaaggctggttcaacatacgaaaatcaataaacgtaatccagcatataaacagaaccaaagacaaaaaccacatgattatctcaatggatgcagaaaaagcctttgacaaaattcaacaatgcttcatgctaaaaactctcaataaattaggtattgatgtgatgtatctcaaaataataagagctagctatgacaaacccacagccaatatcatactgaatgggcaaaaactggaagcattccctttgaaaactggcacaagacagggatgccctctctcaccactcctattcaacatagtgtggaagttctggccagggcaatcaagcaggagaaggaaataaagggcattcaattacgaaaagaagaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaaggggatacaaacaaatggaagaacattccatgctcatgggtaggaagaatcaatatcgtgaaaatggccatactgcccaaggtcatttaaagattcagtgccattcccatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctatggtaaccaaaacagcatggtactggtaccaaaacagagatatagaccaatggaacagaacagagccctcagaaataatgtcacatatctacaactatctgatctttgacaaacctgacaaaaacaagcaatggggaaaggattccctatttaataaatggtgctgggaaaacctgctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggtaagaacttcatgtctaaaacaccaaaagcaatggcaacaaaagccaaaattgacaaatgggatctaattaaactgaagagcttctgcacagcaaaagaaaccaccatcagagtgaacaggcaacctacagaatgggagaaagtttttgcaacctactcatctgacaaagggctaatatccagaatctacaatgaactcaaacaaatttacaagaaaaaaacaaacaaccccatcaaaaagtgggcaaaggatatgaacagatacttctcagaagaagacatttatgcagccaaaaaacacatgaaaaaatgctcatcatcactggccatcatcagaaatgcaaatcaaaaccacaatgagataccatctcacaacagttagaatggagatcattaaaaagtcaggaaacaacaggtgctgagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggattgtaaatcatgctgctataaagacacatgcacatgtatgtttattgcggcactattcacaatagcagagacttggaaccaaccgaaatgtccaacaatgatagactggattaagaaaatgtggcacatatacaccatggaatactatgcagccataaaaaaggatgagttcatgtcctttgtagggacatggatgaagctggaaaccatcattctcagcaaactattgcaaggacaaaaaaccaaacagcacatgttctcactcatagatgagaattgaacaatgagaacacatggacacaggaaggggaacatcacacaccggggactgttgtggggtagggggagtggggagggatagcattaggagatatatctaatgctaaatgacgagttgatgggtgcagcacaccaacatggcacatgtatacatgtgtaacaaacctgcacattgtgcacatgtaccctgaaacttaaagtataataata

SEQ ID NO: 10241 - DNA, 1984 bp, Homo sapiens
tttcccatggagacagaatggctttcttcaaagtcagctaccattttctgattgctctgctcacttacaattggacacagccaactctaagtgcctctgtcaatagctaaaacttcctgtcacctgagacaacagacatggtcatccagacagcaacataaagttcctccacagctcttgatgctgagaaacagagagccatgctgacttccttcttcttttcctatattgctctctttcttgccttagggttttaaattatcttagaaatcaccacttactgcttacatagatcagtacctttcaaacatccagccctccaaaggaaaggcttttgatagctaaagattaatgactgtatattccagattttcacccctaataggtgctcaataaaaattacttaaacttcatcaagggtttatcttgtgttattctttaatggcaagtgcattgcatgtactggtgaaaatgtttaaaatattttttcaaaaggaatcagtattcaattttacattaggttggatggcagtcacattacaatatgacaatattaattctaactcttctatgctagacaaagacaaggtttcattttcttacttaatgcactgacattttggtcaatgcccattttaagtgatgacaagaatgcttcttaaatggtatactgcttgcttactattggctcaaatataaactcaatcttctttaggatgaccacttaactacaatatcatcaaaacactgcaagtaaataaatgtacgttcctcatcacaactcctgaaggaaatttcttactgatcatccttaacgtaaggattcaaagatacaaagaaaacttaagaaattgaaagttctatcctaaaactatcacctgtaagggctggttaaatatatatatatgttaattatagagcactgccacataccacaataaacttaagtagaatacaattatcttaggacagtgcctacttggggaatcttttagtttaatctaacaaacacttattgagcacacattaaataccaggtacactgttactcattggaaatatgaaagatacggtctttcccccactgagaaactcagaccaatataaatggctgttgtcttgggaacgtaacaccagatgacatgctttgaatatgaatgtaaggaaaacaaatctacttttttcttataaaaaaaagtcccattttaaatttcctataactgctatataacaacaaaaaaagaaaaagccatcataggtatggcactctcctatgtacctcagaaaaatcacgtccaccctacgctttgccttcagaatcaggactgaagcatcaccattcagtcagagcttaaactaattgcaattaaagttgttttaaggagaaaaaaaaaagcctaagttaaatgaccaaacccaaatttagaaagataatgacagcaaacatcacatgaagctaattctcatttttcattaccatacaattaaagttacaatttattcctccctaagagtcaaaaaaagagttccctgcatgtactgctctagcatattctacatgtagaatcttttttctacaaattatatatttctcttcttacaatattatatatttcaagaacttaaaaagaagatgtcagcttcatattaaagaccagtcttgaataccagacaaaattatccttctcttttcccctcatttttctctttctaaccataggggcattccatagttcctttgcctctagcacacaactaagaaattctgaaagaatattgaactcaactaaaccaatttaataaacacataaaagatatttaataaatatgtaaaggtagtacactttttatctgctatttaaaattttgttttggtttggggagagaggtcaaagaggaaggaagataaactgaaagtgttatagagaggagggaaatttgaagacaccatattagaaacatgatcctatcagaatgacacagc

SEQ ID NO: 10242 - DNA, 128 bp, Homo sapiens
ttttttgtatttttagtagagacggagtttcaccgtgttagccaggatggtctcgatctcctgacctcgtgatctgcccgcctcggcctcccaaagtgctgggattacagacgtgagccaccgcgccc

SEQ ID NO: 10243 - DNA, 2300 bp, Homo sapiens
ggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaacatggaactctgattttcatttgattctcatacaacaacactttctctaaaaatatcactttaattagctgggcgtggtggcgggtgcctgtaatcctagctgctagagaggctgaggcaggagaatcacttgaaaccgggaggcagaggttgcagtgagccgagatggtgccactgctctccagcctaggtgacagagtgtgacactatcttaagaaaaaaaaaaaaatatatatatatatatatatatatatatatatatttatttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgcatagagtgacgtgtgaaaggcttgaggctccctacctacgagacaccctggtccattctagcagtatggcacgtgctgactgggttttgagtctcttgctgtataatcacattactgcacttccctgcattttctcatccaaaaatggggattacctgctttgtggatcggtttgcagatgaaataacacacgcagggtatctagcacggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccaggtgtggtggctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctcttgaacccgggtgagccgagatcgcgccactgcactccactctggtcgacagagctagattccatctcaaaaaaaaaaaaaaaaaaaaagacgactcagtatacaaataaagactggaaagtcctatattaaaggaactagttaaatactagtttattttacttaatctagtgaatttttaaatattttctttccatctttttttttttttttttttttgagacagggtctggctctgtcaaccaggctggagtgcagtggcacaatctcagctcacctcaacctccacctcctgggctcaagccatcctcccacctcagccttctgagtctgggactacaggttcccaccaccatgcctggctaattttgtattttttgtagagacagggttttgccatgttgcagaggctggtctcgaactcctgagttcatgcaatctgaccaccttggcctcccaaagtgctgagattacgcccggcctaaatattactttcaaatagaaccatcttcatgggtagcagtttataatacacaagtagaatttgggaaatgtagtcccagtcttccattcttcacagtggatgcttcagccagtttcctgtctctgcacacacactgcccgacagcgggctttcccttctccttcagagcagtagcagttccctttcttcattcccacccatcacagtgcagccccctctgccctcctgtattctgaatcccacccttataatatgcttagattttgcctttctcccagccgttttgtgagcattgttcgtgtgtaccaattttttctcatcctttaaaaagaaaaaaaaaagcccc

SEQ ID NO: 10244 - DNA, 1561 bp, Homo sapiens
ggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaaaaaatatatatatatatatatatatatatatatatatttatttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtataatcacattactgcacttccctgcattttctcatccaaaaatggggattacctgctttgtggatcggtttgcagatgaaataacacacgcagggtatctagcacggtcccccacatggcacattcagtgttagccacacttccatactaactgcctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccaggtgtggtgctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctcttgaacccgggtgagccgagatcgcgccactgcactccactctggtcgacagagctagattccatctcaaaaaaaaaaaaaaaaaaaaagac

SEQ ID NO: 10245 - DNA, 2296 bp, Homo sapiens
ggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaatatatatatatatacatatatatttatttatttatttattttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtaaaatcacattactgcacttccctgcattttctcatccaaaaatggggattacctgctttgtggatcggtttgcagatgaaataacacacgcagggtatctagcatggtcccccacatggcacattcagtgttagccacacttccatactaactgctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccaggtgtggtggctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctccttgaacccgggtgagccgagatcgcgccactgcactccactctggtcgacagagctagattccatctcaaaaaaaaaaaaaaaaaaaaaagacgactcagtatacaaataaagactggaaagtcctatattaaaggaactagttaaatactagtttattttacttaatctagtgaatttttaaatattttctttctttctttttttttttttttttttttgagacagggtctggctctgtcaaccaggctggagtgcagtggcacaatctcagctcacctcaacctccacctcctgggctcaagccatcctcccacctcagccttctgagtctgggactacaggttcccaccaccatgcctggctaattttgtattttttgtagagacagggttttgccatgttgcagaggctggtctcgaactcctgagttcatgcaatctgaccaccttggcctcccaaagtgctgagattacgcccggcctaaatattactttcaaatagaaccatcttcatgggtagcagtttataatacacaagtagaatttgggaaatgtagtcccagtcttccattcttcacagtggatgcttcagccagtttcctgtctctgcacacacactgccgacagcgggctttcccttctccttcagagcagtagcagttccctttcttcattcccacccatcacagtggcagccccctctgccctcctgtattctgaatcccacccttataatatgcttagattttgcctttctcccagccgttttgtgagcattgttcgtgtgtaccaattttttctcatcctttaaaaagaaaaaaaaaaa

SEQ ID NO: 10246 - DNA, 299 bp, Homo sapiens
ctcaattgtacatcgcaaatcccactcttgccctcctgcagtgtcagaggacttggctgtgatgggaataagccttggctctgttctccttgcatacttagcccatgggaacccagtttctggcctcaccaggaatgttgttgtgctttgagctccctgtggccttgcatgatgcctccgttggtccttacaggaggtgattggctggcacctcacttgctttctcctgtggacccttctttctctgtccttccttgaatgctgcctttgtccctcatgattatgctatcaacattctt

SEQ ID NO: 10247 - DNA, 415 bp, Homo sapiens
gtgttacactaaagaaattgactgttgcacagactacttataattattgtaacttagtaaaaatttagaaacagcctaataatccagcagaaaattggttcagctgtttacaaatctctgtgtagctcttagaatattcactcttcaacatcatttcagtgacatggaaaaattttaaaaggaggtttacttttaaaatataaaaagaaggccgggtgccgtccctcacgcctgtaatcccagcactttaggaggccaaggtgggcggatcacctgaggtcaggagtttgagaccagcctgaccagcatggagaaacccctactactaaaaatacaaaaattagccgggcaaggtggctcatgcctgtaatcttagctactcaggagactgaggcaggagaattgattgaaccgg

SEQ ID NO: 10248 - DNA, 415 bp, Homo sapiens; identical to SEQ ID NO: 10247

SEQ ID NO: 10249 - DNA, 300 bp, Homo sapiens
ctcaattgtacatcgcaaatccaactcttgccctcctgcagtgtcagaggacttggctgtgatgggaataagccttggctctgttctccttgcatacttagcccatgggaacccagtttctggcctcaccaggaatgttgttgtgctttgagctccctgtggccttgcatgatgcctccgttggtccttacaggaggtgattggctggccacctcacttgctttctcctgtggacccttctttctctgtccttccttgaatgctgcctttgtccctcatgattatgctatcaacattctt

SEQ ID NO: 10250 - DNA, 461 bp, Homo sapiens
cgtgcacctgtagatccagctactcaagaagctgagttgggattgcttgagatcgagaggtcgaggctgcagagagctatgatggtgtactgcgctccagcctgggtgacagtgagatcatctcttgctctcaaaaaaagaaaatttactactaatatttttgtggttctaaattttccaaaaactagaattatagtctacattctgcttgtaatttgcatcttttaaatttagaaatataagatgaatttcacttttattatattttctttgcatccacttcattatttaaaatttatcattgcttaaaacaattacatcagtagtaatgtttattataaaaatttgattcacctctttatgtggcaagtttctgaaatcacatatggggcaagagtatcgtgtccctctttggaaaatgccatctgccatagcttccttgagtgcagggattctcgagg

SEQ ID NO: 10251 - DNA, 139 bp, Homo sapiens
ttttttttttttttttttttgagatggagtctggctctgtcacccaggctggagtacagtggcatgatcttggctcactgcaacctctgcctcccaggttcaagtgattctcctgcctcagcctcccaagtagctggga

SEQ ID NO: 10252 - DNA, 1593 bp, Homo sapiens
gcaagatctctgtctgttaatctgcctcatgaaaatgacgaaccaggagaatctatgggacagtaggaaaagctgccagtcactcagatgataataacatttaccttatacatttataatggaaatcctgccactgtttacaccagaaacagtttctttttttttttttaattttattattattatacttaaagttttagggtacatgtgcacaacgtgcaggtttgttacatacgtatacatgtgccatgttggtgtgctgcacccattaagtcatcatttatcattaggtatatctcctaatgctatccctcccccctccccccgccccacaacagtccccgatgtgtgatgttcccccgcttcctgtgtccatgtgttctcattgttcaattcccacctatgagtgagaacatgcggtgttttgttttttgtccttgtgatagtttgctgagaatgatggtttccagtttcatccatgtccctataaaggacatgaactcatcattttttatggctgcatagtattccatggtgtatatgtgccacattttcttaatccagtctacaccagaaacagtttctattgagaaaatggattttaatagaaaattctcatttaaaatttgggcagatatctgtattgttgagttaaccaaatgagaagagaaaaatccttacaacgtagcttgtcatttgcctgacttgatgcagactgctttgcttagtaatcatgcagcactatcaagactgtgtacataatgtcaggatccatctacataagatgtagtatggactgatgccaagtgagcctggggtggaaatcagaactggatgcaaatcctgatgttatccgagaacaggcacctgttacataggctgtgttactgtggcaaaggtaatggtaaaacacagactggccagaagcattgtgtacaatgagaccttgcaactttgtgtatattagtatgtggggggatgtgaattattaaagacatttaaaactgactgaatcagcaacctctaatctataaaaaaaaattccagacgtccagccgggcacgttctcgtgcctataatcttagtgctttgggaagctgaggcaggaggatcacttgaggccaggagtttgagaccagcttgggcaacatagtgagacccctgtctctacaataaaagtaaacaacttagctgggcataatggcatgtgcctgtagtcccagctactcaagaggtggagatgggaggatcacttgagcccaggagtttgaggctgcagtcagccgtgactgcaccaccatactccagcctgggtgacagagcgagatcttgtcttaaaacaaaacaaaacaaaacccagacttcctataattcctaaaaataaatgtgggtttgagaggcctaccttgaaatgtacaagatcctggccagacttcacctatctaacaatatgctagtaactatttgttgacatgtcttaaagaaatgttcatcagggcctcagaaagcaaggcagagaacaggtccctgaaatttactagcttgcaccaaaccatcagataaagataggttaatatttgacagaaaaaactc

SEQ ID NO: 10253 - DNA, 171 bp, Homo sapiens
gatagagagaatttggaaaacgagcagggttccaaagtactgagcaattttcaggaggagtataaaagcctaggggataattcctatgcatctgcatagggaatttatttgatagctatattttcaggacctgttgacattttattcatccttaaaggcctctttcagttg

SEQ ID NO: 10254 - DNA, 174 bp, Homo sapiens
gatctcagctcactgcaacctctgcctcccgagttcaagtgattctcctgcctcagcctcccaagtagctgggattacacatacaggtacgtgccaccatgcccggctaatttttatatttttagtagagacagggtttcaccatgttggcaaggctggtctcgaactcctgac

SEQ ID NO: 10255 - DNA, 10468 bp, Homo sapiens
ggggatcgcaacatctggatcgtgaagccaggagccaagtcccgcggacgaggtgggggtcagctcctgcttcctgcactggcacctcaccacctgcatctaccagtagaggccaaggaagttaatagtgcaggtctattgaagccaaattgcctgggtttgagtcctagctctgctactaatgtgcttcgtgaccttgagcaggttttagcgcctccctgaacctcagttccctcatctgtgacatgaggaggatgataatacctcctgtgaggtgaggattaaatgcagtcatgcagctaaagcactattccaaatcctcaacgtgcttcaatttatgcaatcctgggaaacggaggcacgtgtaggctttcacatgatccagaaggatatccataaggtcctggaagcagcagttggctgcctctagacaaggagatacattttttattgtatgccctttcgtactgcctaatttttgttttgttttatagtctatttattattggtaggaacgtaataggtgcacatactttaaaaaagcccccaacactggccaggtacagtggctcatgcttgtaatcccagcagtctgggaggccgaggcgggtggatcacttgaggtcaggagttggagaccagcctggccaacatggtgaaaccctgtctctactaaaaatacaaaaattggccacgtgtggtggcaggcacccataatcccagctactcgggaggctgaggcaggagaatcacttgaacccgggaggcggaggttgcagtgagctgagctcgtgccactgcactccagcctaggtgacagggctgtctcaaaaaaaaaaaaaaaaaaaaaaagtccagcactttaaatttgtatccatgtatgtattcctgtttaatcaaacaaaactggttaattaggaaaaatttaaaatccttagcaaattcctggctttcccaaagggaactgggttctgattgagggagacagccttacccactcagccctatcagctccgaggggacaagagctcatgacaagctggcccttctcctggcccacgcctgaccttccaatccctgactgccctcttcccccgtaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaagtgagcccctctgctcgcctcccacgagctccctgcctagttggggagctggcaagcaaacaggcgattacagtgcaggggactcgcgcagcagcgctaggctccacacacagactgcaggcaggcaggccctcatcctgccagctgtccttgcatccaacagatttttttttaacagacagggggcggtctcactctgttacctaggctggagtgcagtggcatggtcacggctcactgtagccttgacttcctgtgctcaagcaatccttcctcctcagcctcccaagtgtctgagaccacaggcatgtaccacagctgatttttaagttttttaatgtagacatggggtctcactatgttgcccaggttggtctcaaactcctgggctcaagcgatcatcccaccttggcttcccaaagtgctgggattacactatgcctggcccctccaacagatttgaccgagtgtgtaccttgtgccatgcactgttctgggcacttggggtatagcagtgaacaaaacaagatcccagctctcaagggcttacattctagcagggagaaacaggcaagcaagaacacaagtgaaattatctaacaggttaaaagattatttgggctgggcccagtggctcatgcctgtaatccaagcactttgggaggccgaggtgggtggatcacctgaggtcaggagttcgagaccagcctgaccaatatagcgaaaccccgtctctactaaaaatataaaaattagccgggcgtgttggcgggcgccagtagtcccagctactcgggaggccgtgacaggagaattgcttgaacctgggaggtggaggttgcagtgaactgagatcgtgccattgcactccagcctgggtgacagatcaaggatctgtctcaaaaaaaaaaaaaaaaaaaaagattatatttgtcgttgggggaaaaagggaagcaaatgtagagcaggggaaaggaggtcaggagttttgaaaactaagatgtcgtgttaacttctagggtgagagaaagccttgttaaagcctgaattccaattctgtctctgcagcttccaagttgtttgaatctggtcatgtgaaaacctatttaagccttggtttccacatctgaagaatggaggcagtagtatgaaattcatagctatcaattattgagtgcttcatatgtgatagtgctgagcactttgtatacatgatctcattcttaataagaacccagtgcatacttcttgttcaccaggtctgaagaaaaatataaaaaacagtgaagtgggtactgttactacccccattttgcagatgtgaagagcacacaggttagatgacttccctaaggtctcacaactagtgtggagatggcgcttgaacacgtcctggcgatgacggggccatacccttacccaccctcttatcttccagacactgggatggttaactgagactatgcacaaagcacttactactgcggcccccgtaactagcgccctcagagcagccctgagagataagagtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcaggtgaggaggttgggcccaggcaggaccccagagagtctgcaccctcttccaggcagccctgcagtggagcataggactctgcagtcagacccagtttaagacccagattcaagtcctggtcctgctaaggtgacctcacttccttgagcctcagtttcctgatctttgaaatggggatattattaccatctttctcatgggaatgggagaataaaatgaattcatgtatgaggataatatttctagagaggcatatagcatagccataagagcagagattctggaatctccttgggttcaaattcctgttcagtgacaacaagctatgtgactttggacaagttcctaacccctaggtctccttgtccgtaagaataaaaatagtacctaactcacaaagttaggtactatgagttgtgagaattaaatgagttgataagtaaagtacttcatttatttatttttgagacagagtctcgctctgttgcccaggctggagtgcagtggcatgatcttggctcactgcaacctctacctcctgggttcaagcgattctcctgcctcagcctcccaagtagttgggattacaggtgcctaccaccacgcctggctaatttttgtatttttagtagatacagggttttgccatgttggccaggctggtctcgagctcctgacctcaggtgatccgcccacctcggcctcccaaagtgctgggattacaggcagaagccaccgtgcccagccagtaaagtactttagaatagtgcctggcacgtagtaaatgctactaagttttagctaatgttattattacctaataaggttaggagtttcatcatgtataacctgtaaagtgcctgaatgtatagtaataggcaattactggtagctactattattagtagtattataattatttcactcgtcttgctccaaaaagagattggagtctacttgtaaaatagaacagcattttaaaaaatcagtcagaaaattgattgcaaggctttctgagttctggatagaatttcttgtggcagtttaagtggcttctgattagcctccggtttctgtcaaggtttggttacaggaagagaacgtactgatcacatgacctaagtgacctcgcctttgttacagttgttattgatcatttcttaaattaatatattggcgttttggtttcaaaaaatgtaaacggggaaatacatgggcaggaaaatatgagcaagctgagggaaaaggtgccattgtagtgcagtgctcccaatgccagtgcccaggccagaagcatctgaaagcttctaaaggtatggatgtgaggaggctccacccccagagattgacccaaaatgtctagcttggggaggagactatgtatatctgcatttttcaaatgccccccaaatatcttttttttttgagacggggtcttgctctgttgcctaggctggagtgcagtggcaccatctcggctcactgcaagctgcgcctcccgggttcaagcgcttttcctgcctccgccccctgagtagctgggactacaggtgcctgccaccatgcccggctaattttttgtattttagtagagatggggtttcaccatgttagccaggatggtctcgatctcctgacctcgtgatttgcccgcctcggcctcccaaaatgctaggattactggcatgagccaccgcgccaagccctctaaatgtcttttattgctgatttgttcttgtttttgtttttaggccagcacatagtaaaggcttataccttgcactgtttttttttgtctcttttcatctaggccagccccagtgccttttgaccccatagttttgatcttttgaggggccaggcgggttgttttgtagaactgtcccacattctggatttatctgattgtttccttatggtgtgatttaccttggtcttctgttagctgattgtctcaggaactagaagttaggtcaaatagtttgatgaggttaaacatttttcccaagagcacttcagaggtgatgccgcgtacctcatgtggcatcacaaggcacatcctgtgagagtgtctcacagttagtgctgctgagtttgactgtgggttacagtggtggctaccagattctctccattataagctacatctcccctttgcaattaatttttctgtaaggtgctgtgttggctctgtccagattacacattttcctgtcatcctttcatctaattgttttgataccagttttgattattgcctattttattagagttgcaaaatggcaaatgtctaattctgttgttccttctgcatttattagctgagattcttctgtaaagatgaactttccctcatcatctggggctacttgggagtgctgatagctacatttttatttgatttttttttttttttttttttagacagagtctcactctgccacccaggctggagtgcagtggtgctagctcggctcactgcaacctccgcctcccggattcaagtgattctcctcagatcccgagtagctgggattacaggcgcccaccatggccggctaatttttgtgtttttagtagagatggggtttcgccatgttggccaggctggtctccaattcctgacctcagctgatccgcctgtcttggcctcccagagagccaccgcgcccggcaatagctgcattttttttttttttttttttttgagacggagtttcgctcttttcacccaggctggagtacaatggtgcgatctcggctcactgcaacttctgtctcctgggttcaagcaattctcctgcctcgacctcccgagtagctgggattacaggtgcctgccaccatgacctgctaatttttttgtatttttagtagagacagggtttggttatgttggccaggctgatctcgaactcttgacctcaagtgatctgccaaccttagcctcccaaagctctgggattacaggtgtgaccaccatgcccggccaatagctgtatttttaacaagctccaagtaattctgatgtttagatagattctgatcaggatccttcagtggcacagaagatacctccaactggctccaggttgctagcaaggcacagggagctctcctggagcccagctgagggcaggacatacagcttggcctgataggaactgagagttgtaagggagtccctctcctggacccttctctctgccttcctctgcatattcgttacttcattctctccacagactgtcttctttaaggttcttagtttctgctaccccataacctggattcacacgaggctctaggcaggctccaaacctcttacttgttgggtggcgtaactcaaattctctgtgcagagaatctgattggctcagctcaggaagctgtccaccagcagtggcctgtgcagtggagccacacgcattccagcaggggctgggggcagcttaggagggaaatgtggctgaggggtgctggtgggacatggctaggattcccccttcctctgggctagcaattcctggagctctgtgactctaggtactgactcagaggtgggctttccatttctcagctcagaaacgcctctttgaccaggtgcctcagaaagtaattccacccatctctactctgggtcccgctgggccaaggattccagtaccactgactgagtgggccttgtctcctcttcttgcccacagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaaggcaaggactcggggacccctacccacaggtcagcttctaggaaaggcactggggccaggagcctggggcacagtgagaagccagtctccactgccaccacttcagcccccggaaaggggaagaaaggcaaggcgaaaagggccacagccctggtctgccccaatctctgggagtgggatgcccccagcaccaggatgggctgcattttcaccatgaccttttctagtggggacaggcaaccccaccacttgaacagattgccactgagtccgaagaacccccgggccctgggtaagaccattcccccaaaacacccgagtgttccaaggcgatttattcctgctctccaggcccctcccaaccacctggatcagccaccccaccaaagagccaccagtagcaagtaaaagccactactcacaaagtattgtttaaaaatacacagccaaattagctgggcacggtggtgtgagcctgtggtccaggctactcgcgaggctaatgaggatcgcttgagcccgggaggttaaggctgcagtgagttatgatcgcacctctgcactccagcctgggagacagagcgagatgctgtcttaaaaacaaagacacaaaaaaagcactttgggaggccgaggcgggcagatcacttgaggtcaggagttcgagaccagcctggccaacatggtgaaaccccatctgtactaaaaaatacaaaaattagccgagtgtaggggcaggtgcctataatcccagctacttgggagactgaggcacgagaatcgcttgaacccaggaagcggaggttgcagtgagccgagattgcaccattgcactccagcctgggcaacaagagcaaaactctgtctcaaaaaaaaaaaaaaaaaaaaaacccagccaaatgagtattgtctcctccaaagtagtcactctgcctcacagagtgacttatttcaaagatgacctgatttcaaagatgccaggacttaagcccaggttgctctctccagcgcccacgcttttcccactgcagtattctgcctttgccttcaagcagtcacctctcggggaaagaactaacacatgtccagcacttaacagtttgccccataccgctacctgcccagctcctttagtgtttacaccaacctagcaaggtaggtgctattatccccattttccagccgaggtatcaggaagtttaaggaagttgcccaaggttgcacagctcagaaggggcacagctgggatgcagacccaggtctgttggactctaccctgttttcttctcactgcctctggaggaggaaccgggagggctccgtcggccttcaccccattccctccatatccccccatcctccacacgtacctgttagggcagctaggccaccttgggccccaccccagggcctcacagcttctcttgctcccacagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaaggtctttgcagatgtaaataaatttaagatcttaaatgagataatcccaa

SEQ ID NO: 10256 - DNA, 93 bp, Homo sapiens
gagggcattcgtgaaaatatatggaaagcccttgtcacaatgcctggcacatagtggtgctttatcattaggaactggaatgattaaattctg

SEQ ID NO: 10257 - DNA, 6195 bp, Homo sapiens
tccgtaataaacatttactttcttagcaaatcctcaaaaccataacatgaggtaggaacttttattatcacaagtccagagaggtaaagttacttgcccaatgccacacagcaagcaagtggcctgtccaggatgtgatcttaggtttgtctgactgcagagcccccaccctcactttccagtgtgtgtgagggggtcaggaacagagggaggactattgtaagcggagccccaggcactgtagggtcctggagaaataagggggcagtggtgccaggagctcaacaggggtgtccctggccctggtgcctgggagaaggagccgatgtaggtggaggtgcaagggcagctgggcagcctgggagggggtcaggtggaggcgtctgaggagggcttcatccaggacctggagcgggagaggtacgttgtgttcagccccacattttccaagcagctgagtacccagctctaagggaaatgggagtaaggcgggcgcttcctccattccccactgttctgcaactgttaatcatttcctctttgcacacagatgtgcacattcacacaggcactcacactgcagcagagactggctagggggtcacccaatcagtttcctcctaggcacacacctcaactccatttcccagccctctcacagcttggtgagacgtgagtgagctctagctgagtgaatgtgggtggcagtatgtatgccacttccacacctggcccagaaaaaccttatccacttgaacctacactgtctcccctcatctggctgggtatcaacagcctgggtccctgagtacttagtgcttgaagcagagcccactcccattatttgaccttaacatgagggcacagttcttgtgtgaagactctggtagtctgggcttagtgtgttagagcaggtagaggcatctggtgtcctaatacacgcatgcctttgaccctttgtaccagactcaaagaatggcagacttaagagggctttagaaattagccacatcaactcccttattgaacacatggacagaatgaagcccaagagagtgagtgttacttgcccaaggccacacaccaagatgtgggtacggatacagccttgggagccaaaagggctgcctcccagtagtcccaagctgcacagataaggtctggagatgctgcccatgctcacctctccctccacccctcagaaagcagcaggcaggtgggctggagtacctgtctttggggcttgttgttctcagctggcagcagaaatcgctggcccaggacagtgcccacacgggcagagtacatgtggtccccaagcacagggcagagctgtagtaccatgtgcacctgtagttgactggagaacactgggcaacaggaaagccaggagagacagtgggcagctactcgttctgtgccacccagtatcactcctccccttttcctttggggaaacaccaccccctttctcagatcatatgtttcagtgaggtcagtactatggcccctgcatccagagagggacacataacacgtcaggacgatcacagctatcaatctgcctggctgtgggatccactcatgatgagatgcaaccctgatttaattgctgaagccaccgggcctaaggactgttctttcctgttggggtgctagcctgaagctgcctcctctagctgggcctggtcacatacacctctgggggccatcaaatgctccccaggctgctgctgataccactgtctccccagctccttgcctccctaagccaagtgcagttttttttttttttagccagcgtttcactctgtctcccaggctggagtgcaatggtgtgatcttcgctcactgcaacctctgtctcccaggttcaagcgattctcccgcctcagcctcccaagtagctaggattacaggtgcgtgccaccaactccagctaatttttgtatttttagtagagacagggtttcaccatgttagcctggctggtttcgaactcctgacctcaagtgatccatccgccttggcctcccaaagtgctgggattacaggcgtgagccaccgcgcctggctcaagtgcagttttttttttttttagatgaagtctcctctatcacctagactggagtgcagtggcatgatcttggctcattgcaacttctgcctcccaggttcaagcgattctcctgcctcagcctcccgagtagctggttttacaggcgcctgccaccgtgcccagctaatttttgtagtttttagttgaaacagggtttcaccatcttggccagactggtcttgaactcctgacctcgtgatccacctgcctcagcctcccaaatcaagtgcagttttaaaggctggctagggtgccagacctacctgtcagtggctgcagctggaccagggcacagccagagcctgtggctaccacacgaaagtgactgagagtcttcttgacaccttccaggatgtcctttcgggatggggccttcactggaactgtctgtggtgccagccaagagtgaacaagccttacacaggtctgggagctatacccagaccctccctgctcccaatagactccgggcagggccacagtataggcagtggtcacttgcctgttttaggggacaggagagccagccatcccaaatccatacccctgactcctctctgtaggggtactatatctagaagcacccctcctcttcccagacccggactcacgagattgaccccatcaatgtgttccagtttcagggcagcctggatcttcccctcagaagcagctgggatcccatcagtgacagcactgagaaaggggcaggaggaggtcacagggtggcttgctgggacctccccaccactctaggaacctcccagcacctctcaccagtaggtggctgtgggcctttgggctctccgtgcatgggtgaagtacttctggaggcgactagctgtctggggacagctggagaggagtacaagcccagagctttctctggaataagcagacaaatcacacaagttaaagtcccttgaactcgcccactaaaaaggaaactcttaggaacactgacctgcttcaggccaaacactaacaccaggactataacctagaccaactcctgagaaacaagtaaggtttccccttctttgataacaagactatgtagcttaatgtgtttctcattttgccccggcccccagggaactcagagccaaatgtcgtaacgattgtctaccatgtgccagaattctactagaaattctgtacatattagctcttaaataagttctctacaaaaaagctcatgagtttgtggaactgcagaaatatttcatctcaagtaccatctttaattgatggcagttagaggaaagagtatcatggatcgactagcaatgcctgccacgagtaccgtcatggagaaatgactgcacactgagcataggtattattttctctattttaccattaggggaactgaagctcagggagggtatttgttttgttttgtttttttgagacggggtctcattcaggttgtttaggcttgcgtacagtggcgggatctcagcttattgcagctgccatcttctgagctcaggtgattctcccatctcagccacccgagcactacaggcatgtgctgctatgcccagctaggtttttgtgtgtgtgtgtgtgtgtgttttattttgttttttaagtaaagatagggttttgccatgttgcccaggctggtcttgaacttatgggctcaaggactcctccttcctcggcctcccaaagtcctattgattataggcatgagccaccacgcggaaagttttgttgttgtttttccagagatggggtctattttgcccaggctggtctcgaactcctgggctcaagtgatcctcttgccttggcctccagaagtgttgggattacaggtgtgagtcactgtgcccagcgtcagggaggtgtcatgctttgcctggtatcacaccatttgtacttgaggatttgaacccagagccatcggcttcctcttcttcacagtacttgtatccacctctatgatctcaaaccttcccatggaaaatgtctcagcttatccccaagcagctgtttccccaccacagatggatgcctgtactcctagcttcctgtcacccctaccacttacttcccagatgctcggacaacctgaagctcctgctccctgagccctagggactggctcagctctggcagcactgagaacaacgtcagctctcctggttttcctggaaagtaagaaagaaaaattacaagaggccaaagcttcatgccttcacttttccctccctcagtcacgaaacccccttccgctgcattcccttcccacatccccggcccatacctgtcactggtagaccctgtggcttgttcaacgtcactagaggtcctgaaacatacatcacacgaacatcagcaaaagcaacggtaaccctttatgcagcactaaagagtttccagagcactttctcacgcatcttagcacatgtccccatcatgactctcagacatgagttaactaccccacaccaaattcaacttctttctgttcctctgccacctcagagcctcggcacttgctgtttcctgtccccaaatttcccaggtctggctccctatcatcttggctcaaatgtcacatcacggagaggtctgaatctccaatctaatgtctgccttcctcctgcagttcctcaccatcataacaccctgttttagtttatgcatagcacttaccactagtaacttgttcatttattttctgacatccatttctcccgttagagagaaatccatttctcccctgagagcagaaaccatatctatctttttcagcactgtatagcctgcctagaacagtgcctggaacatagcatatgttcaagaaatagttgagaaaaggaataaatcactgaatagagagtggggttcagagaaattcagttattttcctaaagccgcacagcaagctgatcacagagcctaggtatgtctgactccaaagcctgtgttttgtccgtcgataaataatcattatttatttatttatttatttagactgagtcttgctctgtcatcccaggctggagcgcagtagcacgatgtcggctcactgcaacctctgctatccgggttcaagtgactctcctgcctcagcctcccgagtagctgggattacaggcggacgccgccacacctggctaatttttgtgtttttagtagagacggggtttcaccatgttggccaggctagtctcgaactcctgacctcaggtgatccgcccgcgtcagcaccctaaagtgccgggattacaggcgtgagccaccgcggccaataaacaataatctagtatagcaactcccgtaactgagcgccggctatgtgcaaggctcggtagttatttgcatcttctccccactcttaaccctactgcatcatggcagtagggttaaaagcggggagagggtgcaaattaggtggcttgtcccagctcatgctgctagtgggaggcagaagcagggctgatcccgtggcttcaatggagagcccaactgcacgccgaggcagtcccctcccggtccttgtgcggccgtgcctctcacccctcacctttccggtccaccacggctgcccgcagcgcatcaaccagctcctcccgactgaggttttttggcagcagccccgcgaagggctggtccccgaggggccccgaccgttggcaggagccgcggggttgcctctgatgcctggacaaggagggagaagcaatgggagtcattccatcccgaggtgccacccattcctatctccggacgcctcttcccaaatcctgcggcctctgacaaatgcctcacaatgtctgggctgacctcgaaaattcaggtacgaccggtcccattctacagcggagggcaccgaggctcagagaggccaacggggctgttttcgggtaacatctacctgatccagatcccgcacgtgccttccccctgccctagcctccgtcccgcatgagagagggggtacttaatcaccgggcttcggtgccaaagcctgcgtcctcgggcactgggcggacacccaggccccgccgccagccactccagaaccggcccaaaacacggcggccgtccatctcccg

SEQ ID NO: 10258 - DNA, 851 bp, Homo sapiens
gagagcatgtgtgtcaaggaccttgctgggtcaacaattcatttgcctttgtctggagtctgccagcagcagtagctaatgtctaaaagacacaggggccaggagagaaaagggaggaaagaactaagtctctcctagtctatggcatgctatcatggggtcaagtaggggcagggaggcttcatggggcctacctttgggatgacattaccccagtgggcattgtttgggtggttttcttttaaactatttacactgatatgacagactcaaactcatatttgctattctccgagcacatggaaaggtaactcactctgtacattcagatatcaaactatgcactgtgagggctatgagaagcgcaaacagtaaacgcttggcaggagggaacacttcctctctctgaggaagaggctggaagctggtcttccccctccaagaatacacgggtgcactgagtctttatgcaaaggcaacactgagccatggccaagggcatctctgcggggaccctgggaaaggagcctgctccaggtgtccccaaagagatggaaaacaagacagtcatttggaacagtgatgcataataaaatgtatgtggccaccttacaatactgctaagttgctaaaatatataaagttaatatttgagttctatttttataaaatagttctagatttatggcaatataaacgtgtatagccttttgattttaatttctagttttgtgctttgaagaaatatatgtaagattaaagaactgtatattgtaagcattatattcaaattatttaaaaattgttctaagtctatattcaataaaaagtaatgccaagaaagatgatgt

SEQ ID NO: 10259 - DNA, 851 bp, Homo sapiens; identical to SEQ ID NO: 10258

SEQ ID NO: 10260 - DNA, 2026 bp, Homo sapiens
tcttccctttcaatctgcaccctctccccaatgagtataagaaatcctacccttggattatccatctggcagcaagacaggcagtgaccagtggtggtagttcttctaactttaaaagatgagaggctcaccctaaaacatcttcattcctctaccagtgagactatcaaccatggatctatctatctattttttaagcctgcatcacttcttgagataatgaggtttctacctccaaagcctgctgggtgagcaccttgctcattatactggttctgaatttacctctttgaagtttctagatgcaccacttcctgctcacagcctggaattcggttaacaagtcagtgtcaacctacctttcccttcatgatttatagacttttgggagtaccttctggtagcttttgtcttcccataggaaagaggcccaatcccagtttgtcctcacaaagcggccagctccgtgatatctcttttgcgggcagagttaagattgtacacagatccccacaagtaccacgatttttgcctcaggaaggataaagcacatgtttgtttctgctttcgttttcttttttctttttttcacgaagccttatggagaagtatgtttctgctttctttcctgaggaagcctggcttctgggccacgggactgatcctgtccacatcctctttccctccattctccatcgtgtctctgcccccgtctcaccccaccccgtgcccctctctgcctcagcttcccctcttcccctgcagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcagggaagaaggggtgtgcagagaaaggatggaagagacaggaggctct

SEQ ID NO: 10261 - DNA, 2025 bp, Homo sapiens
tcttccctttcaatctgcaccctctccccaatgagtataagaaatcctacccttggattatccatctggcagcaagacaggcagtgaccagtggtggtagttcttctaactttaaaagatgagaggctcaccctaaaacatcttcattcctctaccagtgagactatcaaccatggatctatctatctattttttaagcctgcatcacttcttgagataatgaggtttctacctccaaagcctgctgggtgagcaccttgctcattatactggttctgaatttacctctttgaagtttctagatgcaccacttcctgctcacagcctggaattcggttaacaagtcagtgtcaacctacctttcccttcatgatttatagacttttgggagtaccttctggtagcttttgtcttcccataggaaagaggcccatcccagttgtcctcacaaagcggccagctccgtgatatctcttttgcgggcagagttaagattgtacacagatccccacaagtaccacgattttggcctcaggaaggataaagcacatgtttgtttctgctttcgttttcttgtttctttttttcacgaagccttatggagaagtatgtttctgctttctttcctgaggaagcctagcttctgggccacgggactgatcctgtctacatcctctttccctccattctccatcgtgtctctgcccccgtctcaccccagcaccgtgcccctctctgcctcagcttcccctcttcccctgcagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcaggaaagaaggggtgtgcagagaaaggatggaagagacaggaggctct

SEQ ID NO: 10262 - DNA, 6734 bp, Homo sapiens
gcgttgccagctctctgctgaggaggtgcggttcccagtctctgtgacccagcagtcccccgctgccgtctccatggagacctaccacgtcactctgacactgccaccaacacaggtagaaggggatgtgggaaactgagttgggcaggggcggttccattggctcagcttcttccatttgtttcctctctgggatggaattcaggaagggagagtcctcgaattaggagtccttgggtaaatggggcaagtcagcccagtcactttgttcctgtctgtagttggaagtcaacctggaggaaatccctggtgaggggctgctcatatcctgggccttcactgatcgcccagatctcagcctaacggtgcttcccaagcttcaggccagggaggtaaggaggcagagctggcagagaagaggcagaacggggagggaggcagaggtgggggatccacctccttgttgttcccttcttctctctgcagagaggtgaagaacaagtggagctctccacaattgaggaactgatcaaggatgccatagtcagcacccagccagccatgatggtcaacctcagggcttgctctgccccaggaggcctggtgagttggcacccaaagcaaaagatttgcatgcaccttgttcctagggtgctatgtcaggattcttgctctttggaccttcttctgctcttaggtacccagtgagaagccacccatgatgccccaggctcagccagccatccccagacctaaccggttattcctacggcagcttcgggcatctcacttgggaaatgagctggaaggtgagagctggaagtggctgcgggactgccaaggctatggttggttgcagatgctctctgcccctctgccaagggtacagcctctttattctgcagtgacttcccatctctgatctgagcatcttctaacttctggttcatcacaggcaccgaggaactgtgctgtgtagctgaactcgacaaccccatgcagcagaagtggaccaagcccgcgagggctggatccgaggtggagtggacagaagacctggcactgtaaggagtaaccctgccccgaccccatgctccagagcagagaggatcaaacctttccagcacagtccttgcaggaatcagctctgttttcagtagcctttggcgtgagctcctattgtatgccaggccctggcgtgggtcttagggatacagacttgaccaagatacagcccccacccctgggtcaatgacaagcttgaggcagagacaggtgtacataaagaagatggtaaaaccgctccagttgaggtttatgtaatgtgccgtcagagtgcctaggtgggggggagattaattcccatgagggaataaggatcagagtaggcttcacagaggagatgacatttaaaccacactttagagcaagagtgggatttcatcagagtgtgaaagtattctcggcagagggaagagctggagcaaatgaaagagggtggcttgcaactgagagactggcaagacaggaagagcaggaccagggaggatttgaatgcatagctgagaagcatggtttccactcaggccctgtccctttctcttgggacgagagagaatttggaggccaggagaatctgattggagcatttatgccgttttatttatgtacacagctctctgcctctggcctgtgatccactcaagtgtgggttcagcttgctaattttctccttcctgccccatctcctcttgtcccacagggatctgggcccccagagccgggagctgaccctcaaagtgctgaggagcagcagctgtggagacagtaagtgaggggtgggaggggcacccctgggtgggtacagagtggggtctggccatgggcccagctcacagtgccatccctttccccagccgaactcctaggccaggccacactgcctgtgggctccccctccagaccactgtctcgaagacagttgtgcccactcaccccagggccagggaaagccctgggaccagcagccaccatggcagtggaggtgagaagctgacccctggggtaggtgggaggacacaggggatgggcagtctccgaggctctgtctcttctctctcccacccctgggcagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattaggtaaagagaaggagcctgggagcccagctctagccaggggcccgggactgcagacccaaggcaggacagtgaaagaggagagagccttaattccaattccccctgttttcagacattccattccagtcctaccacatcttcctcccaatctttgtctcttccaaactttcccttacctcctgccatttccccagcaattcctctcactctgccacccttctggatcctcctgcccctcctcatacaggactgttgcactcctaccttccagcttcccctctggcttttcacaggtgtccttagccccagctgactataattgtccatcctgctaccctcagccctccagcaccccctggggtcctccaacaaacccagaggcctctgtggcatttctaccccactcagtgggcccccatggcacttctgccattataggggccccactgaattgccccaacttcagggagccccagtaccccctctgtccccgctccatattttcatagcatctccccacaccttcagcaggccccatggcactttcctacactcccattagctcctggggtgtcttttagtccccacggcatcttcctaatcacccttgtgattaatcaccctttaatcattcttgccctctgagtcacccaaagtctgcatctcaacaaagacagtaggggtgggggccactctgaagcacctcccagctcactgaccctcccccacccaccagactccccctcccgctccccgtccaaggtggaggtgaccgagaagacgacaactgtgctgagtgagagcagtggccccagcaatacctcccatagcagcagccgtgagtggggaatggggtgcatgagtgtgggttggccctggtgccccagcatcaaaaagtactctgggtgggataggaggagttccaatccaagaaagagccagggagaagtcaggttattcattctctgcacccctagcaggggacagccacctttccaacggcttggaccctgtagcagagacagcgattcgccagctgacagagcccagtgggcgggtggccaagaagacacccaccaagcgcagcactctcatcatctctggtgtttccaaggtaacagggctctggggagaggagctgggatggggagaaagccctaatgggtcggtcactcctgcccattaaaacccgtccctcctgccaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaaggtagggggacgttggcagggtgcccctcatctcttcttttatacacatatcatgacctgggggacctcgagccagtgtgccttctccttcctcccctaagagatagccggattcccagcctagttcagccaagctagcctagagggggatcttggtgccttggttcctggcctagatctgacatgcttgtgataggaagggatgccaaattatttccctttacctccattgttctttcttcctgagtctcagtgccatttttcctgccctttaaaaaaaattataaaaatttattcctaggcagggtgtggtggctcacaccggcactttgggaggccaaggcgggtggcttacctgagtccaggagttcaagactagcctgggcaacatggcgagaccccatctctactaaaaatacaataaattggctgggcgtagtggcacacacctgtaatctcagctactcagggggctgaggagggaggattccttgagcctgggaggttgaggttcaaggaggttgaagcagtgagccgtgattgtgccactgcactccagcctgggtgacagagtgagaccctgtctcaaaaaaaattttttttttccatggctgggcacggtggttaatgcctgtaatcctagcactttgggaggccaaagcgggtggatcacaaggtcaggagttcaagaccagcatggccaacatgggtaaaccccatctctactaaaaatacaaacattagccagacgtggtggcaggcgcctataatcccagctacttgggaggctgaggcaggagaatcgcttgaactggggggttggaggttgcagtgagcccagatcatgacactgcactccagcctgggtgacagagtgagactctgtctcaaaaaaaaaaaaaaaaattcttccctttcaatgtgcaccctctccccaatgagtataagaaatcctacccttggattatccatctggcagcaagacaggcagtgaccagtggtggtagttcttctaactttaaaagatgagaggctcaccctaaaacatcttcattcctctaccagtgagactatcaaccatggatctatctatctattttttaagcctgcatcacttcttgagataatgaggtttctacctccaaagcctgctgggtgagcaccttgctcattatactggttctgaatttacctctttgaagtttctagatgcaccacttcctgctcacagcctggaattcggttaacaagtcagtgtcaacctacctttcccttcatgatttatagacttttgggagtaccttctggtagcttttgtcttcccataggaaagaggcccaatcccagtttgtcctcacaaagcggccagctccgtgatatctcttttgcgggcagagttaagattgtacacagatccccacaagtaccacgatttttgcctcaggaaggataaagcacatgtttgtttctgctttcgttttcttttttctttttttcacgaagccttatggagaagtatgtttctgctttctttcctgaggaagcctagcttctgggccacgggactgatcctgtctacatcctctttccctccattctccatcgtgtctctgcccccgtctcaccccaccccgtgcccctctctgcctcagcttcccctcttcccctgcagtgagtttcctgcgcagcggcactaagctcatcttccgccggatgcctaggcataatgaatctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagccccccgctctgaggacccatctctgaaagggcacgagttctctcatcccattccccacctccccttccatactccttcctggatctccagtgcctgggccaggaaagccttctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcatgctgagcctggtccctgagcggagtcccagggtgctcagctcttcagctgacctttcttcccttatttattctcttttctatttatatgtgtggcttaggaccctccgtgaacagatgatagagggcattttttcccaggtgacctttcttttctgtcccaggagggtgggtaattccctttgggatgggggtacccacacttccttcaggtccccactcagaccagcaccagggtaagcgtcagagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcaggaaagaaggggtgtgcagagaaaggatggaagagacaggaggctct

SEQ ID NO: 10263 - DNA, 246 bp, Homo sapiens
atatatttggggggacaagtgcaggtttcttacatgcatatattgcatgcatagaggtgaagtctgggctttttttagtgtgcgcatcgcccaaatagtgaacatcatacccaataggtagtttttcaaccctcacccctcctcccaccttctcacctttcatagtctccgatgtcttttattccactttatatttccatgtatacccattatttagctcccacttataaataaaaatatgccata

SEQ ID NO: 10264 - DNA, 520 bp, Homo sapiens
ctactcaccaaatatgagatatccgggaagaatggagggtatagattttttttttcaattagataatttagttttatatatttggggggacaagtgcaggtttcttacatgcatatattgcatgcatagaggtgaagtctgggctttttttagtgtgcgcatcgcccaaatagtgaacatcatacccaataggtagtttttcaaccctcaccctcctcccaccttctcacctttcatagtctccgatgtcttttattccactctatatgtccatgtatacccattatttagctcccacttataaatgagaatatgccatatttgactttgtttctgagttatttcaccgaggataatggcgtccagttccacccatgttgctggaaaacacatgatttcattcttttttatggctgagtagtattcccctgtgtgtgtgtgtgttgggcgatgataatgatgtccattgctgtgtgacagctggaatttaatttattaaagtcaaggtggagtttataaa

SEQ ID NO: 10265 - DNA, 521 bp, Homo sapiens
ctactcaccaaatatgagatatccgggaagaatggagggtatagattttttttttcaattagataatttagttttatatatttggggggacaagtgcaggtttcttacatgcatatattgcatgcatagaggtgaagtctgggctttttttagtgtgcgcatcgcccaaatagtgaacatcatacccaataggtagtttttcaaccctcaccctcctcccaccttctcacctttcatagtctccgatgtcttttattccactctatatgtccatgtatacccattatttagctcccacttataaatgagaatatgccatatttgactttgtttctgagttatttcaccgaggataatggcgtccagttccacccatgttgctggaaaacacatgatttcattcttttttatggctgagtagtattccactgtgtgtgtgtgtgttgggcgatgataatgatgtccattgctgtgtgacagcttggaatttaatttattaaagtcaagttggagtttataaa

SEQ ID NO: 10266 - DNA, 8420 bp, Homo sapiens
ggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcaagaggcgggaagggcggccccacccagcctcctcccaccccacctacattggcccctataacagtagcccagccctcacactgcagggggccagggagggcctcttggggaatatctgaggctctgtggtcaccaacagaccagttactcctttaggtgtctggagaaggggtcagctgcctgtatccagtcagggatctcaggcagaagctgttcccagaaagaaaaggccagggggcagcctggcttggccccgagccctgagccccccaagccccaagcccctgatctcagctggcagcctcctgggtgatggagctgtctgtagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtatccctgtccccacctgctgtcacaggctccatagtcttctgctgcgatgcgatgtggtggctgcctcatgcctgaacaccatggtcctcagggacctggtcgggggcttgtgggtggccccccattggctcggtcctctctctgtcttgcgtctgttcctcctgctccagtggcccccaatgctctgggctcattctccagagtcctgtgccctgggtctgaccctgagccccttgcttgcagctgaatcattctcattgtcagcccctcccgctcccgatagtgtttgttccccttcgctccagggaacctcccttcccatctcagcctcttctctgctcattttctatctctcaattcctaatttctagctcctcctttcacttcccccttcctccctgacataaatgtcctttggttccttctgagcccatcagggagaggagagttaaggcccagaaatgggatgtgaatgaggggtgggtactgtaggggtagagaagggaggcagcttcatgggaaggactggaagtgctgtgcatcttgaagggcatgtgaccccacatcccttgtcagctctcacgtgactgccctcccatctcaggagttcatttttattgtaaaaaacgggatagcctgggcctgggagattttgggatcttcttatggctactgctgatgggtccttttacctgcttagtggggagcatagcccccccaccactccttctgttaggccccaggccaattaggaccttcaaaggattctgggtcaaagctgggtatgcctagggggaccagttttggggctggatggtgatttgggggaaccagggctgtaagaagcactgcagccaattgttgaaactcatcagaatggccacaggtggctgggtttgcactatggctgcccgtgggagtggctccatctctctggcctccttccccctgcccagggatatggcctgggcatgtctatccatatcctgggcatggcatgggaaccaccgctcaaaagagccaaccagcctgctgtcccctcccctgatcctggcaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgtgagcgttgggtgagggcctcagggccctggggccagagggcgaggagccggcacagatctgacacagccccaggagactcttgttccccaggattccagccttagcttctccaggacagaagggtgggcatctggagctggccagtcctacatctgtgggcaggggacaggaagaatctgatagtgggcctacactggggaccccaggtttgggtgtcataagatctggactcatggaggagcctggaaatggaagcagttgagcaggcttaagggtttgggaacctggaagggagccaggctcacaggtcctttcaggaagctctaatggcccctgggaggcccgagtgctgaaagaacagcctggagaatcaggagcaccagggagggggttgagggttcagcccactcccctgtttggagttctgggacatttctccagaagagagccaggaagtaagcatctggccctggagcctttgttcaggtctggctgcccctccctaggacccaggggcagggagggagagtctgccattagtctgtgtcagctcagggcttacgcatacccgggcccctttccaggcacatctgccctttgccgtggtgggcagcaccgaggaggtgaaggtggggaacaagctggtccgagcacggcagtacccctggggagtggtgcagggtgagtgtggacaggaaatgcatcctgggggtagaactgagttccctggcctgccctgctgcctgtagtaccctgtgctgtttcctcctcatgcccacctgcgtgcctaccctgactctggagtgtgcccgcctgcatgcctgcctgataccccaccggccctctgctttcagtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcaggtgacagcctgagccagagtgagcctgtcttcacagctgtggccagacacaccaccctggcatctgttccctgagggaccccacatcctcttacccctcgtgcccacatgattctacttctctggctctgccctgccctatcccattccgtcataatcccatccttggcctcttttctctgggtctccacagcctacaagagacatacgaggccaagaggaaggagttcctaagtgagctgcagaggaaggaggaagagatgaggcagatgtttgtcaacaaagtgaaggagacagagctggagctgaaggagaaggaaagggaggtatgtgccaggctgggggctgggatggggaagctgagggagggaaggcctggctgagggtagaggtgggggtgccttcctggcccaggctcaagccctcctcttgctccccgcatcttctgccccctttctgatgccagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaagtaggtggcaggctgcgcctgcgctggctcctcttgctcctgtgggctcttgctttcgttcttgtccctcacctcccttctcgctctcctgctcgccctctcttacccctttcctgtttggttttccctcatcttcagtggctctccccccagctttcttggttgcctttttctttcactagtgatccagtgtctcgccgtctggattgctctgatactcatgcagtctcacttgcacaggcaatcttgtgctccccctccctctcccttctccctttttctctccttctcttcccccttcttcctcttcctccaactttcttgctcacccattcgctctcccatagcccccttggcagctgtggccctgttgcagcgtggtgaaggtggggctgcacgggtgaggagcagcgtggagagggcgaagctgcagggctctgggaatgctgggaatggtctttcaggccaggggcgggacaggacctgggaatgtcagcatctccagccagattccaaaagccgtggtggtttctgcttggacacctgtggcgcatccctcctcagtctgtggggcagtggtgtggagcccgtattggctggcaggtggtgatggagaactgcgggcactcgcgccagccaacactggcctcctggagactggtcaccacacagctgttctgaagggcccgcagggcttaagggaggaaagcggcttcccacaggggctctgtgggttcttttggggagaagagctgcccctcaagtagaggctggagttgttcctgcagagtggagagaggagagaaagactggatggcagggaggcctttcccagcaccaggagtgcagtcaacggagtagtcaggtggggacaactatgagtcacttctccctggcgatcttcatagcctgtttccacacccttagctggagtccagatgtcctggcttctggggctcaccctcgcccacccacctcattcacagccatgctatgtcacactgtggggatcccatccatccctgcttctccctgccccggcctatcttgggtaccatccttctcttgccaacctaggaactaagcaggtgaacccaacctggccgtcattctcgggatccatttcctcctgggatatttggggatgtgtatgcccaggcccttccttccttggtggcaatggagcctagccattagggccagcgggagtctgtgacccaggtactggcacccaaagtgactttgccctgcttcctgccatcttgttaaagaaaaggtagccaggattccctaggaaataagctgtggagaaaccactcagcaactgcagacaggggtctgtggccagttcagggtctgagggccagtgaaggtgggtgcaggcaggctgaaaggacaccagcacagccctcggggtgggggcttgtcactggtgtctggtctccctgcttttcccatgtggcctgggctccatgatacgttctccaggcctgggcctggaaaacaggtctttcctgttctctggacctgctagaaagcttcagtcagtttggtccctgggagagaaaacgctcttcccatgacggctctgtggaggccaggaatggggtaggtgggttgactgggagtactccttcctgccgccctggtcaagggactagtgtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgagtt

SEQ ID NO: 10267 - DNA, 7297 bp, Homo sapiens
ggggagaccggcattggcaaatccacactgatgaacacactcttcaacacgaccttcgagactgaggaagccagtcaccatgaggcatgcgtgcgcctgcggccccagacctacgacctccaggagagcaacgtgcagctcaagctgaccattgtggatgccgtgggctttggggatcagatcaataaggatgagaggcaagaggcgggaagggcggccccacccagcctcctcccaccccacctacattggcccctataacagtagcccagccctcacactgcagggggccagggagggcctcttggggaatatctgaggctctgtggtcaccaacagaccagttactcctttaggtgtctggagaaggggtcagctgcctgtatccagtcagggatctcaggcagaagctgttcccagaaagaaaaggccagggggcagcctggcttggccccgagccctgagccccccaagccccaagcccctgatctcagctggcagcctcctgggtgatggagctgtctgtagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtatccctgtccccacctgctgtcacaggctccatagtcttctgctgcgatgcgatgtggtggctgcctcatgcctgaacaccatggtcctcagggacctggtcgggggcttgtgggtggccccccattggctcggtcctctctctgtcttgcgtctgtccctcctgctccagtggcccccaatgctctgggctcattctccagagtcctgtgccctgggtctgaccctgagccccttgcttgcagctgaatcattctcattctcagcccctcccgctcccgatagtgtttgttccccttcgctccagggaacctcccttcccatctcagcctcttctctgctcattttctatctctcaattcctaatttctagctcctcctttcacttcccccttcctccctgacataaatgtcctttggttccttctgagcccatcagggagaggagagttaaggcccagaaatgggatgtgaatgaggggtgggtactgtaggggtagagaagggaggcagcttcatgggaaggactggaagtgctgtgcatcttgaagggcatgtgaccccacatcccttgtcagctctcacgtgactgccctcccatctcaggagttcatttttattgtaaaaaacgggatagcctgggcctgggagattttgggatcttcttatggctactgctgatgggtccttttacctgcttagtggggagcatagcccccccaccactccttctgttaggccccaggccaattaggaccttcaaaggattctgggtcaaagctgggtatgcctagggggaccagttttggggctggatggtgatttgggggaaccagggctgtaagaagcactgcagccaattgttgaaactcatcagaatggccacaggtggctgggtttgcactatggctgcccgtgggagtggctccatctctctggcctccttccccctgcccagggatatggcctgggcatggctatccatatcctgggcatggcatgggaaccaccgctcaaaagagccaaccagcctgctgtcccctcccctgatcctggcaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgtgagcgttgggtgagggcctcagggccctggggccagagggcgaggagccggcacagatctgacacagccccaggagactcttgttccccaggattccagccttagcttctccaggacagaagggtgggcatctggagctggccagtcctacatctgtgggcaggggacaggaagaatctgatagtgggcctacactggggaccccaggtttgggtgtcataagatctggactcatggaggagcctggaaatggaagcagttgagcaggcttaagggtttgggaacctggaagggagccaggctcacaggtcctttcaggaagctctaatggcccctgggaggcccgagtgctgaaagaacagcctggagaatcaggagcaccagggagggggttgagggttcagcccactcccctgtttggagttctgggacatttctccagaagagagccaggaagtaagcatctggccctggagcctttgttcaggtctggctgcccctccctaggacccaggggcagggagggagagtctgccattagtctgtgtcagctcagggcttacgcatacccgggcccctttccaggcacatctgccctttgccgtggtgggcagcaccgaggaggtgaaggtggggaacaagctggtccgagcacggcagtacccctggggagtggtgcagggtgagtgtggacaggaaatgcatcctgggggtagaactgagttccctggcctgccctgctgcctgtagtaccctgtgctgtttcctcctcatgcccacctgcgtgcctaccctgactctggagtgtgcccgcctgcatgcctgcctgataccccaccggccctctgctttcagtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcaggtgacagcctgagccagagtgagcctgtcttcacagctgtggccagacacaccaccctggcatctgttccctgagggaccccacatcctcttacccctcgtgcccacatgattctacttctctggctctgccctgccctatcccattccgtcataatcccatccttggcctcttttctctgggtctccacagcctacaagagacatacgaggccaagaggaaggagttcctaagtgagctgcagaggaaggaggaagagatgaggcagatgtttgtcaacaaagtgaaggagacagagctggagctgaaggagaaggaaagggaggtatgtgccaggctgggggctgggatggggaagctgagggagggaaggcctggctgagggtagaggtgggggtgccttcctggcccaggctcaagccctcctcttgctccccgcatcttctgccccctttctgatgccagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaagtaggtggcaggctgcgcctgcgctggctcctcttgctcctgtgggctcttgctttcgttcttgtccctcacctcccttctcgctctcctgctcgccctctcttacccctttcctgtttggttttccctcatcttcagtggctctccccccagctttcttggttgcctttctttttctttcactagtgatccagtgtctcgccgtctggattgctctgatactcatgcagtctcacttgcacaggcaatcttgtgctccccctccctctcccttctccctttttctctccttctcttcccccttcttcctcttcctccaactttcttgctcacccattcgctctcccatagcccccttggcagctgtggccctgttgcagcgtggtgaaggtggggctgcacgggtgaggagcagcgtggagagggcgaagctgcagggctctgggaatgctgggaatggtctttcaggccaggggcgggacaggacctgggaatgtcagcatctccagccagattccaaaagccgtggtggtttctgcttggacacctgtggcgcatccctcctcagtctgtggggcagtggtgtggagcccgtattggctggcaggtggtgatggagaactgcgggcactcgcgccagccaacactggcctcctggagactggtcaccacacagctgttctgaagggcccgcagggcttaagggaggaaagcggcttcccacaggggctctgtgggttcttttggggagaagagctgcccctcaagtagaggctggagttgttcctgcagagtggagagaggagagaaagactggatggcagggaggcctttcccagcaccaggagtgcagtcaacggagtagtcaggtggggacaactatgagtcacttctccctggcgatcttcatagcctgtttccacacccttagctggagtccagatgtcctggcttctggggctcaccctcgcccacccacctcattcacagccatgctatgtcacactgtggggatcccatccatccctgcttctccctgccccggcctatcttgggtaccatccttctcttgccaacctaggaactaagcaggtgaacccaacctggccgtcattctcgggatccatttcctcctgggatatttggggatgtgtatgcccaggcccttccttccttggtggcaatggagcctagccattagggccagcgggagtctgtgacccaggtactggcacccaaagtgactttgccctgcttcctgccatcttgttaaagaaaaggtagccaggattccctaggaaataagctgtggagaaaccactcagcaactgcagacaggggtctgtggccagttcagggtctgagggccagtgaaggtgggtgcaggcaggctgaaaggacaccagcacagccctcggggtgggggcttgtcactggtgtctggtctccctgcttttcccatgtggcctgggctccatgatacgttctccaggcctgggcctggaaaacaggtctttcctgttttctggacctgctagaaagcttcagtcagtttggtccctgggagagaaaacgctcttcccatgacggctctgtggaggccaggaatggggtaggtgggttgactgggagtactccttcctgccgccctggtcaagggactagtgtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgacccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttgacaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccactgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagatt

SEQ ID NO: 10268 - DNA, 434 bp, Homo sapiens
tcaggatgtccttctgcctcatgcactgtggtcccacttacactggaaggaaggaggcagagggcactcaacggccaccactggaagctgtgagcagcatggcctcagcatctccatctgtaaaatgggttctggactagaggagagttcttgatatgacctaggagatagtgttccaaatgtatctgactctcgcaaggctaaatgcatggtagctcaaaataagactcatacaggatcggaagcaattaaagtgtaattttaacgaaagcaccaacaagcaaaagtgtgtcaagaaaaaatacagatgtatactaactctataatatagacaattatagtatatctggcccttgaccactttgcacctagtaaatctttcccctcccaccccatggcttagcacatttacacaaacacaccaaaaaaaaaaa

SEQ ID NO: 10269 - DNA, 1052 bp, Homo sapiens
atccggatacttgaagtcactttacagcagtgaagtgagggacaatgaacaaaaaactcgcattgagagtagcaggagcccagacccttcaataaggaccccaagttaaatcttccaagttaaggctgagagctacagctctcttccgaaaagctggagctgccaacccttcccttgggacctgccgattatgcagttttcttctgatactagctttggtttctgaggtattctgccctctccctcccctcttctcccaaaacatctgcctctcctcagtccccgtctgggtggtgggtgcacaataccaagtgcctgaaaagcctgagagagagggtctggggtagggtggggaccactggacaccccaagtgcaaactgctgctttctgacccttgcttgcttatgtactcccttttcaactgtgttgaattttaatgacgtttttagtggtgtagaaatgcaagtattttggcttaacagcatgaagtctgggttgcacattgtatcagaggtgctgtaatctttccagtatctctgatatacggctttctggttgaatgtcaccctgggccctcttgactggataaacaaccatgagggctcttctctgtggagctgccgagagcttggtggtagaaagcgatgtttctaaacaactgcagcggctctttcctgtctgaactgcatcgtgtgtctgactgccttgctgtccatacatacagactccttcccaggcccggctctgtgcagaacttccatgttttaccacatttttctctcctgaactccctttgtcagccccagggtgttgaggctgggtcctctctagcaatctctaccttcagaagagacttttctaaatattttgcttttccagttcttgttgcttttgtcattgtgaagagtcacccaggatgctggcacttggtaccctaagatcagaagtggtgtgtgtgtgagctgtgagacatgcacaccctttcagagtgatactgtgtggtggaaggactgttagaactcaaagaatagttaataaatccagtgtatta

SEQ ID NO: 10270 - DNA, 5011 bp, Homo sapiens
aatggctttgaacactcaatttaatttaaaacaggcacaagtgcaaacaattcacaaaaatttctagggaagatgcttttgttttgaaaactctgacccttaaaaaaaagtccttgcaatttctttgcccccaggtaggtcactagggagcagaagaatctaaaaatattatctagatagaaagggtccagacacctgaagttctttcctggaattccatctcacagcagccctgaagtggggcagggccgaggaggacaaggagacagcagtctgtggaggcagctggggcagatggtttgcacacatggatgcctgtgaccttgacatgatggaaacccggaggtggttcgccttctctcccagatagggttctgaagagaacaatgggtccctgatgacctggttattgagataaacttgaaaggtaacacagttgccaatccttacattcctgtctctggccctcacgatgcacagtacaggagaagctcagaagcctcctgagctcccaggagtgttagacttagcatggaccactccactggccaggtagacacaggagtggagaggtggaagccaggccaagaaagcaggtcccttcaggccagaacttagtgggagagaggggcagccttcctgaaactggctgtgggtgacctggagggacctgggctgtcaaggtggctttcctccccttacacacacacacacacacacacacacacacacacacacacgatgttctctccattctgtaaagtgagagcaccttcaccaccgaccccattctttctctttcactcagaaattgtcccctcactccctgcccccagccatggcctggagcaggccattcacagttctgggcggggaggggctgtacaggtgggactgcaccttcaggacatcagacgtgagggaggaagcgggattccggtcataaaaaccaccccgtggccctctcgagactcgaggtttgaagctggagctgagaacagcaggtatctgtggagaccagcagtctgccctctgcagtggcctaggacactagtggacaactgcctttaaaaaaccacagcagccttttctactgtgttggctgcagaggccaggaacgctggcctctgcgtttcttagaaatatccctgtgcaaatatcaaggggtcatcctgtagaaaggggtctccatctggggactcgggagggagagacactgagggggcaggtccggcctggcccagtaggctgaagggcagagggtggggctggggcttcacatttcaatctttggagagaatactgagaggaggaggcaggcaagtcctgccggcaggctggctgcccagtgtgccctgcctgtgggcgtaggtggcaggcatacttggggtgggctcagcaggtggaggtctgctttcggtagagctggatcaggggcaccaggcactcaggtagccctgtctgcagcaggaaggggtggtctaggagctcctgggctgtggctctctcttgggggtcccgcaccagcatccgctccaggaagtctcgcagcactggggagacctgtagaggcagggcagtaagatgaagccacaatttgcagtcacttcggggtgacctgattgcctggacttatcattgtttgaaagtcatgaattcgctggttttttaacttcctgttcccttgtccctccccaccccctcaaggctctcagcattcagatgctatagctctgtggaaggggcagaggattggcatcagtgatccagatctggctctatccgtgatctcaggcaagtcacagttttctctaggcctcagttttctcatctgtaaaatgggctagtgataaagtatgcttgccctgtctgccacatagggcttttgagattttaaaaacaggtcgctgggcgcagtggctcaagcctgtaatcccagcactttgggaggccaagttgggcagattacgaggtcaggagttcgtagaccagcctgaccaacatggcgaaaccctgtctctactaaaaatacaaaaattagttgagcatggtggcacgtgcctgtaatcccagctactcaggaggctgaggcaggagaattgcttgaacccaggaggcggaggttgcagtgagctgagatcgcaccactgcattccagcctgagcaacagagagagactccatctccaaaaaaaaaaaaaaaaaaaaaaccaacaacaacagaaacaaacaagtcaaggatgaggaagtactctgaaaaatagaaaataaagtgagacctgaaaaggaagatttctttgttgctctaggccttaagagtctaaagcaagggcttatcttggttcattttgagccagtatcttgggatgaggctgagtcttgggcagaaggctacatcctctgaggaattagccaactggagatctttatatgctaattttggggttagcggtgcgggctccaaggaccagttgtcttggaagatgtttcctgttggtcctcccatccagctttgtgttggggccacagaactcttgtttttttgctattttagaggagaggcttcagccctctgagacatttcttgttttggccaccagatggcggtgccacttagcagccccgtgctgacctgccagcagggggcgtccacagtaaggcctgcggggttggggccgatttggcaaaaagggttacatgtatacacttccatgcacttatactggctttaaggggaacgctgtggcttagctgtgtcggggtgtgcaacgatggagcatgagccgactcgccgtgatggacagggacatcgaatcatggtatggatctcccgacacgggttagaagggtttgtgctcagtgaagcttctccggatccctccctggacagcagggattgctggtgtcctggctttccctgctcatgggccccactgggcttccgaccagtgcctgccaagcagcaacccttctgccaagcagcaactctcctgccacagccgtgggaggcgacttgtcggagcgcacatgcgaacttgtgcgtagatgcggctccacacccaggtgcgggttttgtgtggggaaagaggagccttttccaggagcccagaccctgtggcttcagtggaagggagatgctgggagcccaggttctggtccccttgcctcaggaggaatggggtctgcgaggtcgcacccttgtgtgccaactgaccttgtgagagtttttcagcttgggtggggggctgtcccggagcctcttcatggcttgcactggggagtcactgaagtacggtggctccccatctaccatctcaatcaccatgatgcccagagaccagatatccacctgcaggaggaaaatgtccctgaccccatggccagaccctggcccattggtagctgcgttctggtggcagcagtggtggaggggggacagctggccccagctctccttggtgggtctgtctccttcctcccctggtcacctgccctgtggccagttactgcctgcatgagtgaccactgcctatagggacacagctgtcagtcactcagagaaaggccatcatacataggaggcccggccataccccattctgcccttgagctgaggaaagcacttgcaggactcgttcctggcagcaaagtcactgggtaagagcagccccatcgaaagggggaagggtgttgactaggtgggactctgaaaaccagggctgcttttggtgagctcactggaggggccacagcagaagagctgccagttgccaagttgcttttgggaggtctggggggtggagggaacggttacctcagtggcatacaaagacctggagatcacttcaggagccatccagtagggggttcccaccagggacttcctcttagggacgtctttgctgatctgagcacagaatccgaagtccgagagcttcacctgcggttgaaaagggagtgagtggtggatcaggaggaagtgggagcgtggctgtgccagggacaggatgggacctaccctgccatcgagggtcagcaggatggagtcactcttgatgtcccggtggatgacaccctgagcatgcaggtaggccagggcctgcagcacagcctcacacacagtggcaatctgctcctcattcagcctggacaggaaggtggggccacccgatgaaagagaacgttagctctggcaggtcgtggggtggctgagcagagtaggagtccctggtgctaggccccacagctcccaggcaatctgtttggcagcacagtcaggccatagccctggtgaaaactggggcctgagctttggctagaagctatccttctcttctccactcccaagacccctgggtctcagttaccccagcaggcaggggagcccaggcatcccaagtcttctgggccacaggcagaagaccacattgccctggcagggccatggtgagggcagcctgcactcagggtccagccctcccagctgcccacctgacttgggagacgatgtctgtgagggctcctccctgcaggaactccatgagcacccacagctcctcgcccaccaggtagctcttgtacatctccaccacgttgaagtgctggtagtcccgcatgatcaccacctgggggcaggcgggggcctgagtgccaggcacagtgcccagacgcatggccacccactgcccctgctcacagatgtccagcctggctggctgctcactgcccatccccaacgcccccgtctgtgtcccaccctgtcctcccacctcgttgaagagcagctccctgcgctgctgcttcctgaggtccatcatcttgacggccacctggcggcccgagtgcttctcccgggccaagcagacgatgccggtggagccctcgccaatcttcacgtagctgtccagcagcagccgggggtcaccctggtccaccaccatcctgagcgcagccttgaactgctcatgtgtcacaacacctgtgtcctcaccagccagggcacccttggcaac

SEQ ID NO: 10271 - DNA, 9779 bp, Homo sapiens
cagggttacggaggatgcagatccctatgtgcagcctgaagatgaaaactatgaaaatgactctgtccggcagctggagaatgagctccagatggaggaatacctgaaacagaagctgcaagatgaagcttatcaggtacagggatccaggcccaccccaccccacctcttctgcctcaaccccttggtagctgggtctttgacatgacttgcagaatcagagccttcttccttccaccctcccttttcaaaatacactgatttcactccttaatccgtgtcttttagacagtaaacattttaaatacttcttttttttttaagacagaatttcactctgttgcctaggctggagtgcagtggtgtgatcttggctcactgcaacctccgtctccctgatttaagtgattctcctgcctcagcctcccgagtagctgggactacgggcatgcaccaccacgcccagttaatttttgtattttttagtagagaaggggcttcaccatattggccaggccagtcttgaactcctgacctcgcgatccacccacctcagcctcccaaagtgctaggattacaggcgtgagccactgcacccactcttatagctgtcactcaccatgtattcttttaaattctgccctagaaagtgataaacagccttcttatattggaaaaaaacaaggtaactaacagtccagactctttcaggcccattaagaaagatgctttttctcataattatttttaaatggatacaaagaacagggcacgaggaaattgaataagcataaacccaccacttcccttgaattatttgccctcagtcttcctcattgcccacctcatgccaagtgtaagtaggagaatggcaaaattcctggagaaatgttgggggaactgcaggcctgtgttcatcaaggtatggacggacagattttcagatgtactggagtatgttagccacctgaaaattcactgaacatgacatatacaattggcaataaatgtaaccagcgactcatcctaaaggccatgcatttccccatggaggtcgttctactaccttgtttgtcttcctggtatgttccttttccctttaattcacaggcgtttacttggggttctggtatttcagggatgtttgcctggttgaacctgggcctcaatggttattttatcctgtcagactttctgtccagtggccagacaagttttctgcacattcttttgtttttcttttttcctttttttttttctttttgagacagggtctcattctgttgcccaggctggagtgcagttgcccaatcatagctcactgcagcctctaactcctgggcacaagctatcctcccacctcagcctcctgtagctgggactacaggtgcacaccaccatgcctggctaatgtttttattttttgtggagtcagggtctcaccatgttgtccaagctggtattgaactcctggtctcaagtgatcctcccaccccggcctcccaaagtgttgggattataggcataagccaccatacccaggctttctgcatattattagggcagcagtgccctgtcttactttgttattgaaaaaaaagggaagcagagagaagaaattatctcctatttctcatatgtctatagataaagccttgaaatatttttccaagaagattgtagcaggagggaaacggaagcccaccaattccatcccagcaatataaaaacaaagttttgcctctttggaatgttccatttgccttttcagtttaacgaccacatttcagaagcaactaaaatgttggtctagccataccaaagaaagagggtaaaagaaaaacataagtgactctatatgtagagccgtgctcccatgcttcagaaacaaattcgcctgattgcaaacccatggagagtgcagttttccttgcgccttctatggctcctccacagaaggaaatcagcctggaatgaaactgccagggtgtctctgggaatcctcagggatggcattcctacacatatctccttaggctctgctgtgtagaaggaaagaaaaatgtgactaaataaccaatgttctggttcatgctattagaagcgtctattaggcctccctctttgagctcgtgtcaccttctgtatttcagtggcagcagtaactgaaattctaggggttcttttttttctttaagggaggcaggcttacaccattccatataaaatattagatttttattcattttaatgaattaaaaatgtaaccttctatgagtaaaatgaagggaatttctactaatgacttaagattcaactggagtttttaccatcgctggtaaatcttaagctccctctccctctcctttcttttccgtgcctcatgacttccaagaaaaggacagggaagaagctgggagactataacaggcctgtgtatctccactcaaaacatactccctggaggagatgtcaaagtggttttccttgaatgctctgtgagcatacggttgttggatggattggaacgctactctcactcaatagactctctctctctctgtgtctttgtgcatggcttcccgccaaataattcaccagcttgactgcatcacagacttgacgtgtcacctttctcgtttgtgtcctttgtcacccacaggtcagcttgcaaggttgaatgcaatatccttttatcacactcctctcaagtaagtaccatcttatttaggaggaatcatggccactgtacactgaattctgataacctgtaatgcgaattcacaatcacttctcttagtcatttctttctatgtgataaaataccctccttaactgctgatatcgaagagtcgtctcagtctgtggagggtttcattataaaccagtggagatttgccagacatccttgggaggtgacttcttactctattagctaggaaaattggcacaaagcttctaaacctagagacgttccagtaatcctctgtggctatgaaacttaccaataagtttgtcacatcaccaatccatgacaatatcggagtttgtagccgctctagcacttgaaaaggaaaagtcagtacctctagagatgggccagcttgttagtcatactatacctcgggctcaagagatcaaatgtgtgtgccttaacgagtgaaagcaaaatcatgcattaataaagagaacaaaagagcccaaacagaggaaaaattctgcagccttatgtttttggaatacctgattcaaatccattgtggaattcagcagtatataaattaatttaaaatattattttcatggcatgtgaaaccactccaaagccctacctaaatatgtggaaaattctcagtaattttttaatgcagagagattagcactggactggcagcatcacttgactgtagtggtctgaagcttaggcgccagactctaatagacccatttcaaatacgggtttcaccaaatcctaacagcagaactttgggcaaattattaaacccgtattacctcagtttcctctatacaacatattgcataatagcctcatagaagaggctggtattatgtatcaccacagaagaggccggtattaaaaaccatatcctactcactgggatgtagtttttaaagagcttggcatagtggaaggcacattatcatttattatgaacattcacatatatgcctgcccctatgttcagtgctttatagcacttcaacacctggcagctgccatattgcttacctaagtgtacgggaaacactgggacccagaactagcttgctttctcttctacttttataaacaaggctaggatgcagctacatgtgatgacttggcacactgtgggccacactgttccgtaagtctagattttttctctggctccagctaatagccatttagatgcctccatggtagttcaaagctaatatacctctcaaaggattctggctgcactggcccaaacatttgagctttcccaatcatggaatcccataagtctgtactgcagtggacagtaaatgctatcaatgttggttgctattaataatttgaaaaaggaataaatatctgttaagtgacatactaattagtaaagaatacatgctagtgcaaatgctactgacatcctgtctcagtcctcaggttaaaattaagcaagtgaaaatcatggagtaattgctatgatcatatatattttatgagcgaagaggaaggagctcattgaccactctctattctgcctctcctggatttgagagtgccaccacacatgctctcctgactcattacaagtagagtgaaaaaattcccaggagctgtttctgaaaatattcactccagttataacaaatttagtcccaaggggcaggccttttcctttaatagcactttctttctcttagcttcagcaatttgatcattgttgttctgcacattatttaaacatcagtagctagttcttagaaaaatatttttgaaagtctaataaaatgtgcttgcgttaaacccagataaaaagtggaatttggtacctaaaagccaaaaatttcagtactctagaagttcctaggccattttttaaatctttggttgcaaatttggcagtgaaaaattagactgttgtagtctttgccatttactgcatcctgtagcctacctagctggaattccacagaactctgaacaagaaccagcctgtcattcaatcagccacataggcaaattcatttaaaacctgatagaatgttgtaaaaactagtggcttttcatttttgcagctggttctatcctattgtactttttcttaatgtaaccaagaaatgcaggtgcattttaggccagtttatttcattaaaatatttttgtttagactttctggctgtactgcaagaccagaaattatcccaaagtatatgtgtctcttatccaagggttctgaagccagattcatcagcttgacattagttagccatccgccaaggcagagagccttgcattgggaagaggcagaaggtggacgccagagacatagaagatgcaacctctgctcaaaaagagctttaggcttatttgaaaataagtacacactttcaacatacaatattaaaaaaagtgaatagtttaaaacctggtttattggttttcaactagccacttttgaagaaacggtatacataatggcactcagcttagggtcctccaagactcaattttagcccatttaggtattcaatttgtccctgttacatcctgtggccacatggtacaccactgtccttggccactcacatccaagtggaaattagaggattggaccatccaaagtagattttttaaaaaccaacgtggcagcctaatcatgggtcactggttttatctctttgtccaaaagacagcacaaatatttctgtttgtgttgcttttcccctccagatgcctctggtacccactaagaaagagatccacatggaggacttcctgtcctctcttccagaaggtgcaatagcacagtgtcctaggactttcattcctgattgtcgtaggaaaggagtgtgtgtgtgcatgtgtgtgtgtgtgtgcgcgcgcactttcttctatattggggaaaggggggatcctaagtttcataaccctaatttagaaacaatttgcatctttaaaaaaaattacacattccttattcccaggcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 10272 - DNA, 16523 bp, Homo sapiens
ctgctccaccccgacgcacacgccgcaggactccctcacaggagtagggggagatgtacaagaggcatttgcacaaagtaagtggctttatttcttgttgtggtctgcttttatgtggcaaataggtcaccaaggtctattgagtggtcaagagttgtcagaaccacatgtgactattgtagggtctttcatggctggtgtcagagcctggcctgccagccattttgggaactccctacaccaatttgttctcacttcacgattttaccttcctttggcttttgttgccctgccttattttttagtaagtctttgttcatcaaaagacaggaaatcttttcaccaatacccccagaaaacttcataaatgtaatctattttttttaattcttagagattttcttatctcatattgtcttttctttatattaaagtcaagactgagataagtaatcacagctctttagcaatgaggtaaccaagaaggacatttagtcatttgacagattccctgttctgatgccccgaagagttgaatcattgcctctgtaaggcagggctacagggttaagcctctgcagttagaggagtacaaagagggatggggatgccagccagcactttcccatgacagggagagtaactttattaatttagaaatatttttaacactttttaaaacctcttcttactatcactttttaaatttatagagaataataataaaaaaatcattctgtagaccttcaccggcagctttcattcccagaagtaaccactattaacagtttgatccttcccaaagttttgcttatgtgtaaatagatatgtttaaggatgtgattatagacacatactctttttttcacacaaataggatcatgcattgcattttggggtctgcaatttgcattttctttaaattagcaatatatcattaacattcttcgaagtcttcacatagagatctaaggaaaagagagacatgtttgaatatgggttttaaggcaaaagagatcataaacaaagttaaaagacagaaaacagtcttgaggaaaccatttccagcatatgtgtcaatcaagtttcataatttcagttatacaaaaatcatgtagagatcagaaagaaaagacaccaccaaaacaaaaacaggtgaaatatacgaatagacagaagaacaaagagaaattgccaataaatatatgaaaagatgttcaacctctaattacagaaatataaattttaataagtatcactttttgcctagaagattaaaaaaatgttttgaaacatcataatatccagggatagcaaaagtgcgaggaaaaaggtactctcgtccatgtagaggggtgataaaatcttaacacacttcaatgagagagaatgatgaactctctactctgagggaaaaggaaggatctatattagaactttttcttctaggcactgaatataactcaagagtttttaaaaatgtaattcacaaaataacttttaatttttagaaagaaaatatcccttctcttaatcatattttaaagaaatgtactatattttaaatcaatttgtgatttccattataattaatgtttttacttaactactctgatttttttaatttaaacatttattattttatttagttagtattactttctgaaaaatgacggaatgaaattccattaacccttagtgtgcctgaaacaaaataataatctttctctgccacaaagaaacatagtctaagttccaatttatagtaccagacatgcatctgcccatgtcttggcagaagaaacaagaatcctcacccctttctcacgctctgggggcattcagtgcatgtgggtttcccattcccaagtggtacttacactggcaggaagagctccaagagccctgataggagacagcgcatgtcctagtagagaccagaatctaaagggctcagccaccaggtaagggcaagaaaaataatagcagctaggaaggcgcagctctcctggaaaacctgatttttcatctgtgtggattattcttaagaagggtgaccacacgcactggtttacctggaaccatcccagttttgccaggtcagccagccttattcatactgctctctttcaccttcaaaattgtccccatttggacaaataatatatgaaactccatcattagccatgtcttcttactgcaggacccactgccctaagcagtgttttgttgttgttgttgttcttgtttcaggaaatgaactaaagcacttctgaaaaggagaagtcttagaagttttcttgctttaggttattaatgggaaggataaataaacaacataaaaatttaggatagaaggaagctttggttttttaaattatttcttcttccctgaaggttcaagaagaaacttaaggaatgacttgctagtggctgcagattccatcactaacactatgtcctctcttgtgaaagagctgaattctggtgagttcctgattccctctcatttgtctgctcatcatggagggatccataagtgctaggggtctctcttagagatctgcttattgtctaatatcaaaagattctttaaagctctatgtgatattttgttggtctattcagatttgaggggttttttttttgtttgtttgtttttggttttttgagacagggtgtctctgtgttgcccggctgaagtacagtggcaccatcatagctcactggtatgtcaaacacttgggctcaagtgatccccctacctcagcctccctagtagctgagactacaggcacatgccagcacgcctggctaattttttgttgttgttttcatagagacagagtctttgctatgttgcctaggctggtctcaaactcctggcctcaagtgatcctcctgcctcggcctcccaaagtgtgtgagccactatgcctggcctattcagattttttaagtaatgtttatattttgcttattaaaagactattaacacatactcaatgtagaaagtttgaaaaaggcagagaagaacaacgaaaaatattcaaactgacctataattctggaatccaaagacagccactgttaacatctatggtgacctaaaacaacatgatgctaaggttattttatagggtcaagtgtattatttatctttttttgagatggggtcttgccttttttccccaggctggtcttgaactcctgggctcaaacagtcctcctgcttcagcctcccgaagtgctgggattcccagcccttatctatttaggtttcattaatttggaatgcctgatcatttaaatttgaatttcaaactgaaatttacctttgcaatgtctctgaagatagatctgcccagaaataaatagcataaaatttaaggagactttttatccttttaatactacaaagagtgttcaaaactttagcagtatgaatatgcaaataaatatcttaccagtcactaatacatctccatctattccttaaggccgacctaccaagagatttgtctggcaagactatggtcttacagctgagattgcaactataagaaataaaacttcagttttaaaaaaatcctggacttcgctttcttaaagcctctcaattgaaaattgttgctgctaatttagattaagattaccaaacggaataaaaagatagtagttaatacatcatgattaatggcaggtaaccactgccctagcaaatgatgagtacaaagttattcttggtgtagaagtcttaagtactgttagtttatactcataattctttaaagtattaagtgatagggttcacttaatattttaagttcatattttaagcattttaggtgaatattttatggttaggattaggttttaactcatagttcttaaattagtgtaatattaagcaaaagtaacaattttagttaagtctcttacagaaaggaaaaagtagaagtcttaaagagttaagtcagttactaagatggcaaaaattcctcataacatttctgagattttaaaaatgctgtataccaaatgattttatagtaattcatgtcaatatcaattcttattttgaaacaataaaaatgtatttgattaaaatatgataactggttaacattttacacagcacaggttgatttgtgaagcctactcctttatttgcaggtcataaaaaaatctaacgagtcattctttatttcttcaattgtatctgctagaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatgtgagtatcttccgcttggaagcattttctcagtaacaaaacaatctgtaggagacaataagaaagtaaaagcataattgtttagggtttttttaaccttcagaaggggtgacatagttttctgttctgccagagatatagaagggtgctacatttaaattcggcattgtaatatttcccctcttacaatttccagagagttatcaataacctaaaccaaccagtgcctatcaagagcctgccttgcccaaggcacattgctagtgctatacaaaatagtattaaaaaactgctgccacccttttaggactcacagactagttcaggagataaatcatcctatcttctgaacttattgtatttgcacttagaggataccatgacattggagaggtctctgtccagaattggtgtaaacaacatcacataagtatttggaattgaaataagtacatgtataaaatctcattataaagaaatccagtttggttgacttgttgaatttgtatgaatctgaccctccaaagacttatttgcaaaagttttcacccagttctggagcttgtcagaaaccagcagcatcagtaacgtccccactagactttctgtgaccctggatcagctcaaattagtcaacagagaaaaccaaagctgagaaacaaaggcaaagctgggacagagctgcagagcccaacttgggagaaaaaggagaaaaacaaaagaaatgaagaaagtggcccattaaatgaccatggttcatggagttatgggaaatgtgggcaaaggctgacccaaaagctgggggagggagtttctgaatgctaaaaatacctcagaagggtgatgttgcttaatatgaaaagtacttcagactagtctataaaaataaactggccattttaaagactcagagaagaaactaaacagaggcctttctggtgtttggctctccatccaagcagtgaataaacaatcagtaatcatggagaattatcaagaggtgtggtctgagagtcagctatgaagcagcagagagtaggatcaaaacaaaaccattatcatgggacttaacatggcagtacgctgctgcttaatatagtttgctttcttgtcctttcttctgtattctagaattgttggatttgttattcaaaatggtgaattagttgtcatctgttttgtctggtaaattcatatctatttgactttttattattaagcatttatatggcagttagctagaatttccttgtcctaattctaaaatccaagactattgaggccaccctaatctgctagccctggtatgctgagtagcagtaccagctaccaacatgtgactcaggagttagggaaggaaagttaacagagtcctgggcagacccatttagcctggccccaaacctccaaaaataaccagaacatgttgtacagctataaataaacgcaaacaacgacatttaagttccaacctagaaacttcttcttgaccacttatttcattttagggaataatttaatatttctattgtctaaacatgtacttgtgttttaccctgagactcttttagtcctatgatttaggtagtgagtttatgtccagccccatgaaaagctttgcatagtctaggatgaatagatggagacagagtcccacattagggaatgaggtcatttttatctatttatttgatagtggaattggataattaaaatgcttttttttttttttttttttttttcagatttagagctaaggtcaagagttatgggttagtagccctcctggcattgactagctgatattctaagacttaattctataaaaataaggcatgaatgtggtatgcatgcatatgtgtatgtgcatgtatgtgcgtatgtgtaacacaaaagaggttaaattataaccaaatgtccttaagcattatttcactagagggctcactctccacacagaaagtgatcttgggttctattttaaacaagaataaaaagagccctcagattgggaaaactttgtatcccctcaaaagatgtttgccattttttaaattatagaacatttaaagggccaacccattccagtaaaccctaggaaaagataaatgaccaatgatcgcaactgccataaaaaaaattgtgtatgaaaataccttgatcatatatcgcttcaaacctccaaaatgtttccaagttttttttaggtattgctaaagaagacatgaaagtgacttggagaactaaggggaaataaaggtgccaacgaaactacagctcacacatgaatcccgcttgtaattctcttttaagatttgctctaacatgtcatctgtggtttattttcagggttacggaggatgcagatccctatgtgcagcctgaagatgaaaactatgaaaatgactctgtccggcagctggagaatgagctccagatggaggaatacctgaaacagaagctgcaagatgaagcttatcaggtacagggatccaggcccaccccaccccacctcttctgcctcaaccccttggtagctgggtctttgacatgacttgcagaatcagagccttcttccttccaccctcccttttcaaaatacactgatttcactccttaatccgtgtcttttagacagtaaacattttaaatacttcttttttttttaagacagaatttcactctgttgcctaggctggagtgcagtggtgtgatcttggctcactgcaacctccgtctccctgatttaagtgattctcctgcctcagcctcccgagtagctgggactacgggcatgcaccaccacgcccagttaatttttgtattttttagtagagaaggggcttcaccatattggccaggccagtcttgaactcctgacctcgcgatccacccacctcagcctcccaaagtgctaggattacaggcgtgagccactgcacccactcttatagctgtcactcaccatgtattcttttaaattctgccctagaaagtgataaacagccttcttatattggaaaaaaacaaggtaactaacagtccagactctttcaggcccattaagaaagatgctttttctcataattatttttaaatggatacaaagaacagggcacgaggaaattgaataagcataaacccaccacttcccttgaattatttgccctcagtcttcctcattgcccacctcatgccaagtgtaagtaggagaatggcaaaattcctggagaaatgttgggggaactgcaggcctgtgttcatcaaggtatggacggacagattttcagatgtactggagtatgttagccacctgaaaattcactgaacatgacatatacaattggcaataaatgtaaccagcgactcatcctaaaggccatgcatttccccatggaggtcgttctactaccttgtttgtcttcctggtatgttccttttccctttaattcacaggcgtttacttggggttctggtatttcagggatgtttgcctggttgaacctgggcctcaatggttattttatcctgtcagactttctgtccagtggccagacaagttttctgcacattcttttgtttttctttttttcattttttttttctttttgagacagggtctcattctgttgcccaggctggagtgcagttgcccaatcatagctcactgcagcctctaactcctgggcacaagctatcctcccacctcagcctcctgtagctgggactacaggtgcacaccaccatgcctggctaatgtttttattttttgtggagtcagggtctcaccatgttgtccaagctggtattgaactcctggtctcaagtgatcctcccaccccggcctcccaaagtgttgggattataggcataagccaccatacccaggctttctgcatattattagggcagcagtgccctgtcttattttgttattgaaaaaaaagggaagcagagagaagaaattatctcctatttctcatatgtctatagataaagccttgaaatatttttccaagaagattgtagcaggagggaaacggaagcccaccaattccatcccagcaatataaaaacaaagttttgcctctttggaatgttccatttgccttttcagtttaacgaccacatttcagaagcaactaaaatgttggtctagccataccaaagaaagagggtaaaagaaaaacataagtgactctatatgtagagccgtgctcccatgcttcagaaacaaattcgcctgattgcaaacccatggagagtgcagttttccttgcgccttctatggctcctccacagaaggaaatcagcctggaatgaaactgccagggtgtctctgggaatcctcagggatggcattcctacacatatctccttaggctctgctgtgtagaaggaaagaaaaatgtgactaaataaccaatgttctggttcatgctattagaagcgtctattaggcctccctctttgagctcgtgtcaccttctgtatttcagtggcagcagtaactgaaattctaggggttcttttttttctttaagggaggcaggcttacaccattccatataaaatattagatttttattcattttaatgaattaaaaatgtaaccttctatgagtaaaatgaagggaatttctactaatgacttaagattcaactggagtttttaccatcgctggtaaatcttaagctccctctccctctcctttcttttccgtgcctcatgacttccaagaaaaggacagggaagaagctgggagactataacaggcctgtgtatctccactcaaaacatactccctggaggatgtcaaagtggttttccttgaatgctctgtgagcatacggttgttggatggattggaacgctactctcactcaatagactctctctctctctgtgtgtctttgtgcatggcttcccgccaaataattcaccagcttgactgcatcacagacttgacgtgtcacctttctcgtttgtgtcctttgtcacccacaggtcagcttgcaaggttgaatgcaatatccttttatcacactcctctcaagtaagtaccatcttatttaggaggaatcatggccactgtacactgaattctgataacctgtaatgcgaattcacaatcacttctcttagtcatttctttctatgtgataaaataccctccttaactgctgatatcgaagagtcgtctcagtctgtggagggtttcattataaaccagtggagatttgccagacatccttgggagttgacttcttactctattagctaggaaaattggcacaaagcttctaaacctagagacgttccagtaatcctctgtggctatgaaacttaccaataagtttgtcacatcaccaatccatgacaatatcggagtttgtagccgctctagcacttgaaaaggaaaagtcagtacctctagagatgggccagcttgttagtcatactatacctcgggctcaagagatcaaatgtgtgtgccttaacgagtgaaagcaaaatcatgcattaataaagagaacaaaagagcccaaacagaggaaaaattctgcagccttatgtttttggaatacctgattcaaatccattgtggaattcagcagtatataaattaatttaaaatattattttcatggcatgtgaaaccactccaaagccctacctaaatatgtggaaaattctcagtaattttttaatgcagagagattagcactggactggcagcatcacttgactgtagtggtctgaagcttaggcgccagactctaatagacccatttcaaatacgggtttcaccaaatcctagcagcagaactttgggcaaattattaaacccgtattacctcagtttcctctatacaacatattgcataatagcctcatagaagaggctggtattatgtatcaccacagaagaggccggtattaaaaaccatatcctactcactgggatgtagtttttaaagagcttggcatagtggaaggcacattatcatttattatgaacattcacatatatgcctgcccctatgttcagtgctttatagcacttcaacacctggcagctgccatattgcttacctaagtgtacgggaaacactgggacccagaaccagcttgctttctcttctacttttataaacaaggctaggatgcagctacatgtgatgacttggcacactgtgggccacactgttccgtaagtctagattttttctctggctccagctaatagccatttagatgcctccatggtagttcaaagctaatatacctctcaaaggattctggctgcactggcccaaacatttgagctttcccaatcatggaatcccataagtctgtactgcagtggacagtaaatgctatcaatgttggttgctattaataatttgaaaaaggaataaatatctgttaagtgacatactaattagtaaagaatacatgctagtgcaaatgctactgacatcctgtctcagtcctcaggttaaaattaagcaagtgaaaatcatggagtaattgctatgatcatatatattttatgagcgaagaggaaggagctcattgaccactctctattctgcctctcctggatttgagagtgccaccacacatgctctcctgactcattacaagtagagtgaaaaaattcccaggagctgtttctgaaaatattcactccagttataacaaatttagtcccaaggggcaggccttttcctttaatagcactttctttctcttagcttcagcaatttgatcattgttgttctgcacattatttaaacatcagtagctagttcttagaaaaatatttttgaaagtctaataaaatgtgcttgcgttaaacccagataaaaagtggaatttggtacctaaaagccaaaaatttcagtactctagaagttcctaggccattttttaaatctttggttgcaaatttggcagtgaaaaattagaccgttgtagtctttgccatttactgcatcctgtagcctacctagctggaattccacagaactctgaacaagaaccagcctgtcattcaatcagccacataggcaaattcatttaaaacctgatagaatgttgtaaaaactagtggcttttcatttttgcagctggttctatcctattgtactttttcttaatgtaaccaagaaatgcaggtgcattttaggccagtttatttcattaaaatatttttgtttagactttctggctgtactgcaagaccagaaattatcccaaagtatatgtgtctcttatccaagggttctgaagccagattcatcagcttgacattagttagccatccgccaaggcagagagccttgcattgggaagaggcagaaggtggacgccagagacatagaagatgcaacctctgctcaaaaagagctttaggcttatttgaaaataagtacacactttcaacatacaatattaaaaaaagtgaatagtttaaaacctggtttattggttttcaactagccacttttgaagaaacggtatacgtaatggcactcagcttagggtcctccaagactcaattttagcccatttaggtattcaatttgtccctgttacatcctgtggccacatggtacaccactgtccttggccactcacatccaagtggaaattagaggattggaccatccaaagtagattttttaaaaaccaacgtggcagcctaatcatgggtcactggttttatctctttgtccaaaagacagcacaaatatttctgtttgtgttgcttttcccctccagatgcctctggtacccactaagaaagagatccacatggaggacttcctgtcctctcttccagaaggtgcaatagcacagtgtcctaggactttcattcctgattgtcgtaggaaaggagtgtgtgtgtgcatgtgtgtgtgtgtgtgcgcgcgcactttcttctatattggggaaaggggggatcctaagtttcataaccctaatttagaaacaatttgcatctttaaaaaaaattacacattccttattcccaggcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 10273 - DNA, 523 bp, Homo sapiens
aacttttggaggtgatggctatgtctattaccttgattgtggtgatggtttcacaggtatttaagtatgtccaaactcatcaaattgtatacattaaataggtacagattattgtgtatcaattatacctcaataaaactttaaaacaaacacatacagatataaatcttgcacgcacagatggaagaaatagagtccacagtgatgatcactccttctattcacatctctccctcagaacctctgtgagtcccatgcaatggaagattgggtgtttcacttgctgaaagatctgttttctttacaggatctgtgagtctggctctacgcttcaagaatagcatttttgggaaatctgactctggtgctgaaagtctgtgctcacagggttgggttgatttgaagtccatggaaacaactgtcaacactctagacgcactagagagagaaattaagaagttctccatcaattacaaaggcaaatactgacctgagataatcgtgagagggaactcacacagtc

SEQ ID NO: 10274 - DNA, 523 bp, Homo sapiens; identical to SEQ ID NO: 10273

SEQ ID NO: 10275 - DNA, 13558 bp, Homo sapiens
ggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtaagaaccttggaactgtaaaacactattacatctcttcttcctttgtagcgtagagttgtaaaagtggatgtgtataatttagtaattatttggaccaaaagtcaatttatggcttaagatttatgcttttatggaatattagtcttgtccactgatgatagcaataaatcaagtcaaaaactttattgggaaatctctcctttgttagaatcagtattgagtaaagcaaaaaatcctagactgagtctttgaagatttaacttttattctcatctgtctcatccactaacaattattctaacaacacatttcttaaaacttagtttcttttatagaaacatggaaaattcaccttatgacacaactttagatcaaatgtttgtaaattatataatgctccttagataaaaggaataaagaatgtagattgccagactttacttacccatatttgaatttagcatggcttctgagttactgcgacatttctttggaaatataaaattaggttcattattcttttagctgcagtttgggtgtgagtcatttcaaagcatcaaacagtttaggtaaaatagagcagtgctttaagcacaaaagattttagaagtctgatttatttctatagtaattgctttatatttttacaatagaataatgttttctgttattttttatttatttatttttaagagactgggtctcactctgttgcccaggctggagtgcactggcctaacatacggagtacagtaactcgagtgcagccttgacctcctgggctcaagcaatcatcctgccgcaaccttccaagtagctgggactacaggcatatgcaatcatgcccagctaattaaaaaaaaaattttttttgtagagacagcatctcactatgttgccgaggctggtttcgaactcctggcctcaagcagtcctgccttggcctcccaaagtgttggctcattatatgtgtgagctacaaacttttttatatttaactccaaaataatgtatttggagagacatgaaaagattccctttggataaaactaggttcaggaattcctgatatttcttcttactcagcatttattgtgagccctatgttatctgttcattacattttatatatttacaggctaggacccacaaggcttagtcacctctgaggaatgctagcatattgttttttttatttttttattttttttgagacagagtctcgctttgtcacccaggctggagtgcattggccctatctctgctcactgcaacctccgcctcctgggttcaagcaattcttctgcctcagcctcccaagtagctgggactacaggcgtgcgccaccacgcccagctaatttttgtatttttagtagagaccgggtttcaccctgttggccaagctgatctcaaactcctgacctcaggtgatctgcccacctcggcctcccaaagtgccgggataacaggcgtgagccaccacgcccagcctacatattggttaaattcattgaaaataagattctttgcatgggtgaagcacctctttcttctgtatcttgctgtttaaatcattgattgtgtagttggtgtccttccactgacaggtgtatggactggagaaaccattcctgtgcggacttgctttggacctctaattggccagcagagtcactccatggaagtagcagaatggacagacaaggcagttaaccatatctggaaggtcagtcctgatgaaacttttctgtggcttttggctgtttttcttagtaagaggtagttaaaaagttatgataaagtcaaaatcagccagaactgatacagtgccattcactggtcagtcatttatttcacgtacatttttttaaatgttacattcatcattcttggtagccaaattataacatacagcaaaacaccagctactggaaatagaggacaaactgtttttgtctctgttttgtgagttaatccaattattttaaccatttaatgcatttgaattacttgtgactgctgaggccacagactttgtttgtatgataaaagtcttactttgtaattaaaacattcctcaaatgtttatcttaggaaataattctggaataagaagctaagattatttttctagttttctttttttttcttccttgagatggagtcttgctctgttgcccaggctggagtgtaatggtacaatcttagcttactgccacctctacctcctgggctcaggtgactctcccacctcagcctcccaagtagctgaatttacaggcacttgccatcatgcccagctaatttttgtatttttgtagagacggggtttccccatgttggccagactggtcttaaactcctgacctcaagtgatctgcccacctcagcctcccaaagtgccgggattacaggtgtgagccaccgcacctggcctatttttctagttttctaatgaggggttagaaatacaacattttcacatagatatctattgggaatgatgcttgcgaaattgaagtaaggagaaaatgggtcttgtgatctttggaaaggtaaggtaccactgtcattgggaactttaaatttggaatgctaggcccaagtgggaaaatcatgacaagggatgatcctctgcccttaatggacattcagtcattcagtgcctactgtgtgataggtgatgaagacaggtggacaggtagactggttttttgtcttttccaggcaaaggttgaataatcaaaaacaaagtcagtctcttcactgagcactaactgtaggtctctgatggtctttatgtattgctggaaatagggagaatgttgaaatgatagcatgttggagaagtaggaatatattttcccactaagaaagctgggacctactgcaaatgagtaaatgaggtgattgctggcctaagtgtaatgtagtgctttattgcatgtcagtgcatttgacatgtgtgcttgctttctgttggcagatataccacaatggtgtcctagaattctgcatcattacaactgatgaaaatgaatgtaattggatgatgtttgtgcgcaaagccaggtatgagtagtcttggatgagaaaaaatagttaccatttagatgtttttcaataggaagctttgcataaaagaagaaagagttaagaatccaaattacaccaacacctggacatacttaaagcccaaggcagccaggcatggtggctcacacctttaatcccagcacttggggtggctgaggtgggagaatcgcttgaggccaggagttcgagaccagcctgggaaacatagcaagaccctcatctctaaaaaaagtttttttcaaattagctgggtgttgtggtatatgcatgtagtcccagctcttgggaggctgaggtgggaggatcatttgagctgaagagttcaagctgtgatcatactatggtggtgctgttgcattccagtctgggtgacaaagtgagattctgtctcaaaaaaaaaaaaaaaaaaggcacttaccaaggaacaatatagttaccactgaatttgaaagtgggtgccttttctttatattggctgttagtccacccctgagttactggagttaattcttgtttagctagctagctctatgtctttgtcatactgttttttaaagacttcattttatttatcttgtttgcttccaataacagactgtagtgtttttgactacaaaaggtcatcagctaatatgttgaagtaagaattctgtttctctacaactgccttctcatagataggacgggaaattacaaaaacattccagaggaaatagtaaatagttctgcctaagctttcatataggattttgcaatgggggaatgttgtacttagtatgcatttcaaaattaatgtgcttgatctattaaatgtgataactcaggaaccgggaagagcagaatttggtggcttatcctcatgatggaaaaatctttttctgcacctcacaagatatccctcctgaaaatgaactgcttttttattatagccgagattatgctcaacagattggtaagttaatatgtgtttataatgaatctggcttagtaaaaataccaaagaccaggattaaagttttggtaatgatttacatgttagctgaagcaaatcatatacctttgtttgtataaatgcaaactattacttgtatttgaggtgttaaaatctgtgagattcttcacaagctgaatgttattgaccaagcaataattcatatgatacggtcttttatggtaggactttggtttggggcattgaagttccttaggctacttttcgagctagcaccattgagatataaattcatgaaggacagcgaagtccctcggtttgatttaacctgcatatgctttctctttgctgtgctgtttcatgatgacagctaatgtttaagagtttgggtatgctataaaacctaaatattttgcttacaaaagaggccttataatccagtatttaccaagtgctttctttgtgcctggtacactattttattttacttatgtatgtgtgtatttagagataaggtctcactctggcaggctggagtgtagtggtgcagtcatagccaactataaccttcaactcctgggctcaagcagtttcctgcctcagtctcctgattagctaggactatgggtgtacatcaccatgcccagccaatgattattaagttttttttttttatggagatggggtcttgctgtgttgcccaggctgatcttaaactcctggcctcaaatgatcatgccactttgggctctcaaagcactaagattgcaggcctgagccactgtgcctggcccatagtacattattttagatgcccttagtacattattttagttttataggaagtgggcaaattggaaatatggagagaaaggagaactggaagcaatgattgttaatatcaagaacaagttttaagattcaagtattgggagataatgagtaatttttttttaaaaggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtaagttgtgttggcccatcagaatggaatttttgcaacaattagaaaatgcggtagtaaaggctttgtagagggattgtaggtggagttgagatttgatgtcagagaaagaaaccttcgtggtttaactgagattccttggaggctgtcacttccaattattaggatgttctgctttccaggtctccccaccatagttggaaggtgcctgggaaaatgcacttaataatcaggaagttgatcaatgtgtttggtcttaaatagaagcttctgagtctgagtctgagcctctcattagagctcaccccccagtcaccagccagagccagtttctctcctttaatattattgctcaataaatattgccacagtttattttttgagcttccattttctaaatcccatgcaaaccaacacctttcttttagtactttttaagaaaaaaaaaaatttttttttgagatagggcctcactctgttgcccaggctggagtacagtgacaccatcttggttcactactacttctgcctccaggactcaggtgatcctcccacctcagcctcctgagtagcatggactgcagacatgcgccaccacacctgactaatttttgtatttttaatatagatggggttttgccatgttgccaaggctggtcttgaactcctgggctcaaacagtctgcttacctcagcctcccaaaatgctaggattataggcctgagccaccatgcctggccactaactttttttaataaatactacaaaataactgatggctttagctttcttgttggggtcatcttttctccagatcttcaaaagtttcttccccatccttttgcaacagagaccttatggcccacaaagcctaaaattctatctatcctttaagagaaggtttgctgaccccttagaggaatcttatttttgcattcttggaaggattttgtttcatccctggttttgaggcaatattatatgttttaaaaagatagaaaactataaaatctatcttgtaaaagtatgtttccctatagacacgtcctagaattcatgagttttttttttttttctttatgtttgtgttagggcattaggattataagtcatttttttcaagttttatgtatcacctatacattttttaaaaatacatatttaggtcagaggtcctaaaggagatcaaattaatttactagctttagttgcagaatataaactcaggagctcttgagtggtctcacatagacaaccctagaaagtaaaatgctgcttaccagtcagctctgtttcattcctgcctctgctgcatgcacatatgtgtgcctgtgtgtcttggggatgccagcagttgttttcttcacggtgtaatactttgggctgattgcaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcagtaagttaccctgcagccaagacgtcgttcctcaggtggtgagcctttgtgtggctgcagcccacctgctgattgaagggctggggagtcctggctcatctgtttcatgccttggtaccatggtagatgccttctgtgttccatgtagccaagccaaggttggaacactttttttggtgttatcctggaagatttcagttgttggctttctttttcttacttttcacatgtactcttttttcacatctacaaaaacctagagacaaaaaggactattgactgcaagtggttgcttatagttagacgatagtgtgcatgtgagagagtgatggagtgagaagagtaagagtcagcagccacactatggagaacctttggtcctattaagaaaattcaatttcagtccagaaataatggcgagacactgaaggatctgccagcccctgccattttggaactgttctgttggtgtgtgtgtgtgtgtgtgtgtgtgtgtgtgtgtgtttgtctgaattgcagttaaaaaaaaaaaattgttatcttaactgtttgtaagtgcccagttcaatagtgttagttatattcacgttgttgtgcaagcactataggattttaaggaaaggagtgtcatagtgacatacccattctgttaatacaaagattacttaggcagctgaacagaggatgattgagggtggggaagcctaaatattggaagaccaattaggtatttattgcatgaatccaagtgtaattaaatgtctagactgcattagtcacagtggtcatagaaagaagagatggattttgttgtccttagcttttaacaagtgtcagaagaggaagaaaatgttttcagcttatgttatggaaattctctttagaaatcttaccttcactgaaaacgttatattcttaatgtagaatttggataaacacttggctttgataccagttcttctgtctgcttccttatcacaatgcagcctgagatgctaaacagccaaggagcctggatctacattcctaactctcagaaggatattctaaaacaaagacttctttagttccattgctagcatgaaattttacaaaattagacagaaattatcaaatattacatcaaattgtgcaatattggagccaaaagagatccccggatcatctagtcttaacatcctgtctaggcagctcaggttgtgataataaaataccacagattttgtggctcaaacaacgggagagacacagtgagagaaggcagtcatgagcaagcctggaagagggcccccaccagaacccagccaggctggcaccctgatctctgactccagcctccaggactgtgagaaaatacgtttctgttgagagaatgaaagagaaagaatatgagagttccaatctcttctcataaggacactaatcctacatcatggaagccccatcctcatgacctcatctaaccctaattgccttccaaaggctccacctcacactgggtgttagggcctcaacatgtgaatttggggtgaggggggacaaatatttgtccagaagactgcccattataattgcctggaaaatgtgaaaaacaacaattggtgctaggaccccatccatgggaattctaatttaattggtcagagttagagctctggccttggtattttaaaaagctccccaagtgattctcgtggccagccagggttaaggactactgacttcatccacatgcaagattgatttccacaatgtctctggcaagtggatatattgtttcttaaagatcacacaattatagtttgaggaaaagttttgcttgaatcaagtcgatatcagcctctatcctttcattttacttttgcttaacaaatgtggatctggactccttttcagggtgagaagatatggtaagcctctttgccaaactttcatgggatagaaagaaggttttggactgtcaaaacttaaagctggtataagtcattcttataagaagcactgttccctcaaaatggttttgaatgaggctttaggcttcctatggagatcgttggtaaaattttcagatgcttgtatttttactttggggcatttcaaagtggatatagtagtattagcagtctttttatttatctacttaaaaaaaacagctacagccctaatgccaaatgcaagaggagttccccccctagtgtcccccgagagtggaagggtggtgacagaacctggctttgcccttcctgtaagaaagaggaagtgagcagaagaacagtgatgtttactccccaggtcatcttgtctcatggctttagataccgtcatatgatttatgtctccaccctcatacacctcaccatcactcagcggctctgatgctggatgttcgctaggcaacttaaatcttatgtgtccaaaactcaacccagtattaccccatgaatttgatttcctccagtgctgagcagctcattaaatggcaccaccattattcacctcaatggtcaagccaaacaccttgaagtaattctcaactcagtttttccttccttccttcattcaactaacaccttgtccagaccaccagcttttcttctatggatggcttcagtagcctcccagttgatctccctgccactacttgctgtttctcctcatctactccgcaacacagatgaacacacatacacacagttttctgtccgcagtgccagagcaatccatttcaaatataagtcagattgtgcctgtctccactcatacatctctggtggctttccatcgtatttgtgttaaaagctttttacagcagtcagaaggccctttatgatgtaatagtacttggctacctctcccttcaccttttcttacttttcatattctgctttggccactctgaccctccccttgctactccttgagcatactaagcacatccagtctcagggcctctgccttagaaacttctccctccagatgcctgcatgtcttcttccctccattcaggtttctgctcaaatgttatctcctcaggagggccttccttgactatcttatctaaaataggaccccttcacttttacctggcttcgtgtgttttcgtagtctttattgctatatgataccacgttacacatttgtttatgctataatctgtccacttagaatgtaagcttcatgaaagcagggacttagtttacccacatcctatagccctagcatctagaacagtgcctggcataattagacacagtaaatatgtgttgaataaacatctaaaaaccatcagagtagaagatgaaaagtcagacttttggtaggggttttgttgtggccttgggcaagttccttagtagtttttatgcacatgatgtttcccatctgcagaattaagaggttggattagattggtggttttaaaactgctccagggaattctaagggttcttcagtgccatctgttgctagaagaggatgagagaaatgctaaggaagccaggcttcagaacgcccgactgcaccctctcactccttccaggattttattaataacctgctttaactgtttcatattgggctttcataaagacatggggttcagctactcaaaaaaaaaaaaaaagctaaaaaattcctggtctgtgtgatctctaaggttcttttcagctctgaaatgtctaggccagggttactcaaaccttgacattattgacattttgaccgggttaattttttgttgtggggctgccctgtgcattgtagaatggttagcagcatccttggccttttcctactagatactaattataccacccctccccagtataacaatcagaaaggactccagacattgccaaatgtccccatagaggcagtcgcccctacttgagaaccactagtctaagaaaaggacagaaaaatggtaattccataaaagtggcatccagggaatacaaataacggtgtaatgagataccattatgtactggctaattggcagacattttcaaatttgagtcttccagttgagaatatgggacaaccagaaccgtcaatgatggatgtgtatattgaaacaactacattggaaaaccgtttgtcattatcttgtaaagttgaagatgtgcatatcctttgatttagctatatagttcttgggtatgtgccctagagaaacatgtattgcagagcaccatacaagtataaaaatgttcaaatgccaggtacagtggcatgcacctgtagtcccaggtacttgggaggctgaggcggacagatcacttgagcccaggagttcaaggctgtagtgcatgatgatcacacctgtgaatagccattgcactccagtctgggcaacatggtgggaccctgtctctaaaaaataataataaaaatttaaaaaaatttaaaaacgttctagcacttttgcttgtgataataaaaaactggaaaccaccaaaacattcattagctagagacaaatccagtaccatagataagttgtggtgtatttgtatatttgtaaatagtatacagcagtggaagggaacaaacaactgatacagcagcttgaatgaattttatgagcatcatactgagagaatgcagcaagacaaaagaaatacatatagaatttacatagaatttgagaatttacatagtattctaaaacaggaaaaatgagcctacactgttttaaactatacatgttttatgagtcttctgtatatcacctatgcaaaagcctgattcagaaggatagagctgctctgacaaaggcctgcggctatgaagaataagtgttgcctcagttgttatttgtaaccccaaatcaaatgttttttcttgtgttcctcttagagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacagga

SEQ ID NO: 10276 - DNA, 430 bp, Homo sapiens
gtacgatctacttaatgtaagggataatgtacttgattgttgaagtaatatggtgctatttttttcttttattattatttttaattttttttaaacagatgggatctcactgtgttaccccaggctggtcttgaactcctggactcaagtgatcctcccttctcagcctcccaaactgctgggtttacaggcgtgaactaccatacccagccaatttttcattagtgtttctcttatgcactgaataggaaacttgtcctgttggatcaaaagaaaaaaaatcagatcttactgaagtctgaagagtggtgtaagagtaggtatatatgttagtgtaaggaagtgagtctttgataagaatatctctattagaaccgtgcttcttactggatacattttagtaattagcatttaaattaaaacctggggc

SEQ ID NO: 10277 - DNA, 2714 bp, Homo sapiens
aaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcaggtacggtccggggggctgtccccgcacttaggacggggtgcgctgcggctaggaccccccaggcgcccctcggagcgcgcagagcgctgggccggtttccccatccgcgaggcggcctcgggagggagcgggggctgcgccgggcggggacccgcccccgtctcagcgccccgtcccgtcctgtccccagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgagtggcggtctggttgggacagggtgggagtcccgaagtcttaccctgcctgggcttggcgggaatgtgccttgtcggccccactgcagaaggaaaaagtgagctacaagggttggatgggcttgtcaggccacacagcctgggactgctggggagggatggcctccccgccctcccttcccgattcatctctggaaagagctggcaggggcagagtggagggaaggggaggccgggcccagcaatcctgggcctctggtccctgaacggttgggggaagagatggtggggacagaatcgaagcctccggccaaagctgtccggggctccctggcccagcggtgacctctctcccctcccccagcccaaccaacaaaagtccagtgtgcagcccggtcaccatggagacgccgctcgcctccctgcagggcaccaggcccagctcttgcttggctctcctggagcttggcgcctgaccctgaaagggatgggctctcgctattctgccccctggccctgggccagggaccccagaccacccttcctctgcccccacttcctatcaccctagctgggctgctgctcttcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtacgcgcctgcaagtgtgtttcctgagtacaggtgtcgccgagggcgtgcacatctgctgtgtagctctctgggacccccaggtgccatcaggccctgagcgtgggctctgctcatttgcctgctgcctcctgccgcttgtgcggacaagggacggggcctggggtgatgccgggagagggcagggcctctcctcaccaccccctctgcatgccaggtgcctgcaggccctgcagcgacgctgagctgctcctggccgcatgcaccagcgacttcggtgagtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaa

SEQ ID NO: 10278 - DNA, 146 bp, Homo sapiens
cgcctgtagtctcagctgctcgggaggctgaggcaggagaatggcatgaacccaggaggcagaggttgcagtgagccgagatcgagccactgcactccagcctgggcgacagaacgagattccgtctcaaaaaaaaaaaaaaaaat

SEQ ID NO: 10279 - DNA, 487 bp, Homo sapiens
gtgccgacttcccccatggctgctgtgagcccgcagagtcatccttggccccgtcccgcccttggggaagaatgggcccctctgtcctcaggccccttcgacgtgctgagcatccagacgtggcgaggagcccgaagggtgtggggtcccctctgcagggtcctgcttgttgcctgtttccggcgggcggggtgcacaatggggtctctaaggaccgtttcccgccactggccccattgtcactgtctccgccttcctcctcggcctttcagccgcataaagggccagtgaggtttgggacagccacagcccaaggctccgaggctaaaagcccctgggtgggggtgttccaggacacctggccctgtgtgagctgcctcctctcaccccaacccctcggatcctgggaaagagacagccatggctcaagggccagggacccctgggctgagccccagaaatggctttccattctcgcctgggccgg

SEQ ID NO: 10280 - DNA, 8614 bp, Homo sapiens
ggagggggggggggcgtggcaggagcaagcgtctgccgcggtggccgggtgccggtaagggtttccagcgcccccggcctaggttttggaggcgcgggaatgcgttcgttgctcagtgtcggacttccccctcattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagacgtgtccctgtccctggaaacgcaggcaccgcgtgtttggaaagacattcatctgggctgtttgacagactccccagttggtgccatgctctgtgcttagggaactgtgagacccctggaggggtgggtaccgggaccgcactcagcctggggtttggaggcggcctcctataggaagcgacctgggacctaagatttttagactgactgtgggttcactggaataaaaaggaagaaacaaagagcattgcaggcatcgggactgtcacgtgagtaagaaaagtttgttcaggaaacagtggtcgtactgggtgacgagtacttgggacggtggctttaatacacaagataatcagtgtgccctgggcattgattatcttgatgcttcccatccttccagccccttatgagggaaggcaccttcgcgcctaatcccggaaatgggatgttgaccttcaagagctgacgcctgcgtttatcttgaaaggaagagtggcattagtgatgtggaaaagggggttttaactgtcaaggctggaaaatgtgacagggttggaggtgtttggagaagggacaggtgaaaaagattgagaccaaatgtggaaagatctactaaggaatcatgggtacaaaatgtacacgtaacagttggaggcaataatacctgagcaattgaccacaaagctgacctagcttgtttagtagattaagttaggacaagaagcaagagttcaaggatagaaggcctactgaagctcgagtgatttgagaaaactttacaaaggtggaaaatctacgtgggcctccgaaagtcaggtttggatcagctgaggaaagtgagaagggtatcccaggagacagagcagcaaggacaaaggagtagcagcaggaaagtggggagcacttgtaagacagggacttcaaaagtataaccaaaacttcgtcttgctttgagttatccactgggtagtactcggttaattattgagtactggattaattaagccctcacctggctcaccggtgacagaagtagcagggcgcattttgcttaacttttgccgagatccttgtcatgggggtgtaaaccctttcccacaccaatctgtgtataatttttgccaaggtgttagggatatcttgcagttatcctatgggggacagctgtgagcctttttggttttttttgtttttttttttccgagacggaatcttgctctgtcgcccaggctggagtgcagtggcgcgtggcgctatctcggctcactgcaagctccgcctcccaggttcacgccattctcctgcctcagcctcccgagtagctgggactacaggcgcctgccaccatgctcggctaattttttgtatttttagtagagacgaggtttcaccctgttagccaggatggtgttgatctcctgacctcgtgatccgcccacctcggtctcccaaagtgctggattacaggcgcgagccaccgcgcccggccctgtgagccatttttacaaaaacttccacctgccttggcccaaacctcagcgttcttaggcacaggagctcatgaacatactgagataacactaaactggactatgcgaagggaccaactacagacctgacacaaatcctcaaggcaagacgatgtctgaagttgagcttgtaaaggaaatggcttccttccttaaaatatcacccaggctgagctctgaaaaaagcacctccagatggtgggttccaccccgctccaccaccccaaaattgcttattgtgtgagtctccatagtctcagaaactgagagtacctttgatgccagtggcttccgggctttttggattgtcacttggtagcagggagcacccataggatgatgcctatgatgagtcagggcccaaccttggaaacagggaaatccagaagtatcctacaagctagccagccttttggattagattatagcagtttcagagaaaaatggggaatcagccatggtcaaggagctaaataagcatcgtgaccatttgggccagaaattgaagggagtgtagcgttaagaattagaggaaggaacctccgaggaaggagctaccccaaagggaagcagaaactggagaaactttagcagtatgaggttctaccactggtgttcacctagaagtgctttattcagatctcagcctgggtactattttagggaaggaagccgtttcctttacagtatgttcgtgtgactcctgtgcctaagaatgctgaggtttgagccaggggctagaaaggaaacttagctggccattatgaatcagggactcatcaaaggcatcacaaacaggaaaaggtgaatgttcaagttagaagagaagagctacattgagatgcaacatattaatatttgagggcctcgtttaacgtgttgctctcctgtcacactctatgacactggtctgtcagctgggctatgcctgtccagtatacactataaaatatgtatcagttggggttggagagaggaactgtgatcaaagtagtcacccggcccatatgagaaaatgaaccttttcccaaaaggtggccccagactaaaaagcctggagaatcctaatagtggattataccatctcttcagtcttcgtgtttaagaaataacctctttggcttacagatttgacaagatcaaagctgcaggaaaatggacagtgaggttcagagagatggaaggatcttggatttgattgatgatgcttggcgagaagacaagctgccttatgaggatgtcgcaataccactggtaggttatgatttgagctgaggatgggttaaaggtattgatctggcagtaactagtggaggagggatatcaatggaagataaactagtgtggcaaagaaatcaaagctgtggaattctctaactctagaagcttctggagagcatccagttgtatgttttatttgaagaaaaatgtggttcagggagctaacatggccaggtcagttaggagtcatgccaggactagagccccgattttctgagccatgttctgtccaccacacgaaaaccagagaaaccaaataatgagagtttaatgcgcaagatggggaagaacaagaagcagcagcatatgagctctgtttcttacttccctgcctgtggctcatcagtctttcagcatttttagaaacttacattcttggagcatacacctatcttaggttccctggaaaatattcagaagatacctgggtattcttttgcgtttaggccagtggccttctggaatactcttttcttccccatctttggaaaactctgctgcagggagtttgttaaacctcatgtaataagtgatccaaaagttttgcttatataaatgtttgtttaaaatcctatttatgtcatagaggcctaaaaaagggaaaacaggactgtttttctttaaagcatgccagctgccctgagaagagtagttagtattgaataaaatataatttatagttagaatatctgctgttgctgtttgcaaagaaataaaatagttcatctgtattttcatttacgaataagagatagtaatatgttcaatgaataatatacatatcaaataagtcatagcttagttcaagcttaggaaaatagtcaaaagagagagcataataagaattatagatgtcatttattgaataccagttttatgccatggactgaggttggaaatatacattatctctaattcttaaacaaccctgtgagggaggtgctgttattcccattttataggaaaagaataggatcagaaagggcaacttgcccaaagtctggtagcaggtaagtagggcttcatataacatatacctaggtctgtgaagttccaaatcctgtcttgtgaacttctgttcattcattcatttgacaagcattttttgaagcctactgtgtgccataagactatgtgaacataagatacagttcctcctcctgaggggtctagaaaggcaacacttatagataagtaattgtgataataaatattctaggtgggggcataaacagccacatcatatacgaagtggctgattgcctggtgggcatcagaaaggcttctgagagaatgtcatgtttaagctgggtcataaggaaggaccagaagtttagtggaggtagacaagggtattgcagcagaggggacagatgtgtaaaggcccagagttttgaaaggctttgggacatggtgagtcattcactgtggatgaagaatacatttgtcacataagtaggctgaaaagttgggcttggatcagattgagagtggtatttgatatcacacttagacctcatcctcaggagatccaggaatgaatggtcttaaaagcaagactgctatgctcagatttggcttttggaaaatcagtttagccagcattgttagagatggtgtgacatggagataggggcaagtgagaccaattggcaagctgttgtggtctaggcaagggaggagggcctaaacaaagtcaagaaaataaaggagacgtccatttctggagaagtttatggctcagattggagaacatttgggtggcaggggtggaaggaggtttccctgctgacttccaggcgaagttggcttggccctgctgctaatccacacctttcgcttgtcttgcgattctaaggcaatgtgtatgccagttaggttttgctgcataacaagtcaccccaaagcttagtgacttaaaagagcaactgtttatttcatgattttgtagctcagctgggagggacttctagtctgcaccagctcagctgatccctgccaggcttgcctgtgttgtgcagtcagccaacagactctggaggctgggtaatctaggactgtctcacatgtctggcagttaacaagctgtctgctgggtgatggggtgactatgccatggtctctggtatccagcaggctagcccagacttctcaatctcagggttccaagagcaacctgagaggaaacggcagagcttcttggagcttaggccaagaactggcccactggcatgacagcttcattctgttggccaaaacaactcacagggccagtccaaatccaagattggggaaatcagtttcaccttttgataagagtagctgcaaagaactaagggcattttacagtacaccataatgggtggctgggtttatgatacttttgtttttgttttccaggcatatatgccattttatgtgttggcatgtattgcaagggacagtagataccaaatgaaagacacattattttagaaagcataccacagataggatgaaattaagcaacgttgtctgcttctgaattaaagaattcattaaccaaggacctatttattctttgtcatctataagtaattattaggactgaactttctttttaagtttaagataatatattattgcgttacaataaatgatagctcttctcaatctgttcaagtatgtttgaatctgtcttgtagaacaagatgtatgtgattcaaatatagataagtaaatatcatttaatatatattgagcataattttagaggggaaaacatattcacatactacaaattagaatccagtggaaaattttaagtctggatatcgcataacagtttgctaaccataaaacaaaacacagataattgaaaagaaatatattggtatctgtgaactctggtacaaagcagagtttcagtagtaatacatttaaacttaaaatacaagtaaatgatcccagatcctacagtaagtgtggcccatgacttaccattttaagaaaattgctggtagggtgtgaattggtcatttgttgtgttttttgttgctctgctccaccactagagggaggtcttatctattaattacattttcagtgtttcctgccctacctccatttttattataatatagacatgttgggccaggcgcggtggctcgcgcctgtaatcccagcactttgggaggctgaggcgggtggatcacctgaggttgggagttcgagaccagcctgaccaacatagagaaaccccatctctactaaaaaaaaataaaaaaatacaaaattagccgggcatggtggtgcatgcctgtaatcccagctactcgggaggctgaggcgggagaatcgcttgaacccgggaggcagaggttgtggtgagccgagatcacgccattgctctctaacctgggcaacaaaagcaaaactccatctcaaaaaaaaaagacatgttgggtccaagataattttttggatacatttcttgtgtctaaggaatatgccagcaaactagtattcttttaaagcacgctcccgctaaagaagatttaggattcactcatctcagtgttcctagccgctaataataatagcaaatattccttgagcactggataccccacagagtgctcagcacttgatctgaattacctcacctaatccttacagtagtcctgtgaggtgatggctcttttgttctcccatttgccaaggaagaaacaaaggccccaagggtttgcataccttgcccaagtaacccagcaaatgggagagttgtggtcttggatcctagttggcttccaaaagcctctgcccttaacctttctgccacagtgcctccttcacaaatgtcagagtcaaaatgcccatcattccctactgaagaaggcccgggccatgtttgaatgatacttctgatagtttcctcacgtgtatgattttagcttttttagaatacacatatcaattatgttgcctgttcctaggaactcacaagctttaattctaagtgttcttgagttccaagaagatgcagaatatattactgttctgaatttctattgtaccttttcagaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttttatgctgggtctttttgtttacttagcttttaggaggaagaggtacatgaaaaaacaaattagcttattttaggttttcaatcacaaacatgattttagcagctatcctataatccagatacatccaggctgatttcttctctttgcatcagtagttctgcctagaaatcttttatcttcagaataaagaccccaaggcaccagtcccttcagtaagcaaagaaagacaacctaatagaaaagagacttacaatattaaaaaaacttatacaagagaaaaagcttttcaaaaaattaaaatacctagaacgcc

SEQ ID NO: 10281 - DNA, 364 bp, Homo sapiens
taggagtagtggaaagctgtgttccactcagtaccacagtgagatggtgaacttcagagtttcatggtttgttgggtgctccagaggaaacctgcacctcaacactgagtcttccagaaaaggcaaagacctccaagcttggaaccccctcctacaagggccccctcagacttggcagtgaagataatagcaacgacccagatagactgaagagtagaggtctttacccatttttccaggtcattcatgagtgtcctaaatgcttgcaagaccctaagaaggggaaaggacaccccagggaccacagaattaatttctgcttgcagtgcagcagagtgaggccaaatggacttaatttgctttg

SEQ ID NO: 10282 - DNA, 6927 bp, Homo sapiens
  misc_feature (4599)..(4599): n equals a,t,g, or c
ccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggccagggcccacctcagcccagtcatgtgactgtctgggttcagacttgtcagtcaatagacgtttgctgagcacagaataaggatcaggaatcaggcctgcagccttacatagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctgggggttgaaggggaggctgggaggcttcctggcttcaaccaggcagctctgctctcaccaactttcatctgatggattttgtggcttcaagaaaaagaaagcctggaaaatgtggcttacagagatggaaattcaatgtgatgggggaaccccatgggggagatgtttgccaggcacctgtttactgagctgcctgccactctgtggctggctctgtacaggggactgggggtgatgaagatggacacgcccctgtccccaaagacctcacagagatgaaaacacagcagtgtgatgaggctctgaggggacatgcaggtagctttgggactggggaggacacttaatccggacgaaggtggggaggatcagggaaaacttctctggagttggtgacatttgagctgactctttaaaggacctttggaatttgcccagaagggatgtgggaagggcaccttccatctcgtctgtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggtgggctgggctccctcccctcacccagggaggtcctcaggtgacatgagcccaggtggtacagatcacccggaacttgccctttcagggaggagcctcccccataaggaagggtagcccctttccaggctacccttggacactgtctcttctggagggctccagtacagattgggggctgaggagtccctggtgggggtggggggtggcacggtaccctcaggctaaggtgccagttttgcccctgcaggcctgggaacttcacctaccacatccctgtcagtagtggcaccccactgcacctcagcctgactctgcaaataaagtgagtgccggtgtggggaagtgggaggcaggagaggagccagggagaatctcccgcagagcttcagaacagccgagtctgaggacagccggagagtctctggtatttcctgcatggtgggataagtgctgacttcattgcctacttcgtggttaactggctaaatgacctggcctcatgggctgaggaccacatgggatggtcgatgggaaaggttttgttcgagggccctggttattatgcggtgtttcaggctgggtggagattcagaggcgtgtggcaggctggctgggagggggctggggttgagggactctagaacctcatttctctgctaactgggcctgtctacagctcctcctcccccgtgtctgtggtgctgtgcagcctgaggtcaaaggaggaaccatgtgaggaggggagccttccacagagtctccacacccaccaggacacccaggtaggtgggactgggaagctgcgggccggccaggcccgagctgcttctctcctggcacaactgggccccaaaatgggcaaggagcagaagctgggagttatagagtaaagccttctccacaagggacactctggggcctgggcctctgtgtcccagggaggggcacgcgtgcccgtgtttgttcattgcactctgctgagcatctcccagccctgccgtgctggagacgtggggaagacagcagatcacaggtgctaatgtggatgagtgcaatgatggaaacaggcaggtgtctgggagcccatggcggggagggctgtggctcactggaggtgtctgcagaagcaggaaggagccgacctcatgctcaggttggggaagtggcacagctagatgtacagcatcagagggcccctcaggttccatgtttggccacctcttctgggagaactggatggtgagctcctccctggccaggtaaccggaagttatgactgtccctggggctgatggacccccagtttcttcttgagcctaagaggccatgggagaagacgctcaggacaaatgaagggaagtagtgattattttttcttgcccattcatgtgtttactcagaaaatattgattggggccccatctgtcccaggccctgtgctgggtgggcctagctgcaggggagagaggtggagtagacacaggttttgacttccaagaacgtactctatagtgagggagaaaagacgtgcagaaagcacctgcaacagaggtgggggtgcttctgagggaggcccgagccctgtcgccctgcagaagagacagggtccaagacagagggagagcccagctagacacacagcagacatggtgctcgggcctgaaaccacatcacagacgcacagccaaagcctcaggtagatgggcaagctgcctgcagccaggctgcatgccaccctgtgagggagacagccagacagacctgggtttgaatcccagctgtgtgattttgccacactgtgtgatttttaggaagtggctcagtttcctcatccagaagatggggctagtagcagcactgtgtcactggattgtactgaggatggggctaatgaaatactttgatgtgcccagagcatagtgggtgaggaacccaccacaacaggactgggaaggaggcagggcccacgtggaggtggctgtggacctgccagtcccgggcacggtctgcatggagtagctgccattgctccttctgccaaagcagaacatgctccttcctatctcttcaaagttctctgcttttttccttcataaaactccccacagaccccaggactgcgacggccgtggtgagagatgctggttgggataagggcagcagtctgtcctgacccctctctcccttctctccagggcacctctcaccggtggccaataaccatcctgtccttccgtgaattcacctaccacttccgggtggcactgctggtgagcaggggcatcccacctaccctggaggtctgggcacccctgtctgcgacgtggggcttgaggaatggggggtttgcacagtatgtggtagggctgggggcacagtgtcaagcaatgtcagcagggagtgccatctgccccgcacccccagagccacctcaccttcccactgccttccacccagggtcaggccaactgcagttcagaggctctcgcccagccagccacagactaccacttccacttctaccgcctgtgtgactgagctgccctcctgaggcagcaccacaccagggaccaggggtgcccangcaccccccaacactggatgcaatggtgttacactggagcccgctgcaggccagctctgctgttcactggccctacccgagactggtgaaactggaagtcttcacactggagttgctgttccagctggtcgcccctcacggctcagaaggaacctgagagccagagacttcttgggccttcctgcctgccaccccctaggggccaggacaggaccagtttacctctttccaaatatggtggttggagggctggttcaggtgccctggaaggaaggggaagcctgtggccctgatttgttcacaacccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcacggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaacaggcttcacggaaagtaagtgggccacctgctggaagctgccactgcccggctggcaatggtgtgagtgtcttggccctgtccctgccctggggttcagcaggtcatcccaccctacatctctctcctttggcgtttgttcctgtagtcactgcgctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 10283 - DNA, 6930 bp, Homo sapiens
ccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggccagggcccacctcagcccagtcatgtgactgtctgggttcagacttgtcagtcaatagacgtttgctgagcacagaataaggatcaggaatcaggcctgcagccttacatagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctgggggttgaaggggaggctgggaggcttcctggcttcaaccaggcagctctgctctcaccaactttcatctgatggattttgtggcttcaagaaaaagaaagcctggaaaatgtggcttacagagatggaaattcaatgtgatgggggaaccccatgggggagatgtttgccaggcacctgtttactgagctgcctgccactctgtggctggctctgtacaggggactgggggtgatgaagatggacacgcccctgtccccaaagacctcacagagatgaaaacacagcagtgtgatgaggctctgaggggacatgcaggtagctttgggactggggaggacacttaatccggacgaaggtggggaggatcagggaaaacttctctggagttggtgacatttgagctgactctttaaaggacctttggaatttgcccagaagggatgtgggaagggcaccttccatctcgtctgtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggtgggctgggctccctcccctcacccagggaggtcctcaggtgacatgagcccaggtggtacagatcacccggaacttgccctttcagggaggagcctcccccataaggaagggtagcccctttccaggctacccttggacactgtctcttctggagggctccagtacagattgggggctgaggagtccctggtgggggtggggggtggcagggtaccctcaggctaaggtgccagttttgcccctgcaggcctgggaacttcacctaccacatccctgtcagtagtggcaccccactgcacctcagcctgactctgcagatgaagtgagtgccggtgtggggaagtgggaggcaggaggggagccagggagaatctcccgcagagcctcagaacagccgagtctgaggacagccggagagtctctggtatttcctgcatggtgggataagtgctgacttcattgcctacttcgtggttaactggctaaatgacctggcctcatgggctgaggaccacatgggatggtcgatgggaaaggttttgttcgagggccctggttattatgcggtgtttcaggctgggtggagattcagaggcgtgtggcaggctggctgggagggggctggggttgagggactctagaacctcatttctctgctaactgggcctgtctacagctcctcctcccccgtgtctgtggtgctgtgcagcctgaggtcaaaggaggaaccatgtgaggaggggagccttccacagagtctccacacccaccaggacacccaggtaggtgggactgggaagctgcgggccggccaggcccgagctgcttctctcctggcacaactgggccccaaaatgggcaaggagcagaagctgggagttatagagtaaagccttctccacaagggacactctggggcctgggcctctgtgtcccagggaggggcacgcgtgcccgtgtttgttcattgcactctgctgagcatctcccagccctgccgtgctggagacgtggggaagacagcagatcacaggtgctaatgtggatgagtgcaatgatggaaacaggcaggtgtctgggagcccatggcggggagggctgtggctcactggaggtgtctgcagaagcaggaaggagccgacctcatgctcaggttggggaagtggcacagctagatgtacagcatcagagggcccctcaggttccatgtttggccacctcttctgggagaactggatggtgagctcctccctggccaggtaaccggaagttatgactgtccctggggctgatggacccccagtttcttcttgagcctaagaggccatgggagaagacgctcaggacaaatgaagggaagtagtgattattttttcttgcccattcatgtgtttactcagaaaatattgattggggccccatctgtcccaggccctgtgctgggtgggcctagctgcaggggagagaggtggagtagacacaggttttgacttccaagaacgtactctatagtgagggagaaaagacgtgcagaaagcacctgcaacagaggtgggggtgcttctgagggaggcccgagccctgtcgccctgcagaagagacagggtccaagacagagggagagcccagctagacacacagcagacatggtgctcgggcctgaaaccacatcacagacgcacagccaaagcctcaggtagatgggcaagctgcctgcagccaggctgcatgccaccctgtgagggagacagccagacagacctgggtttgaatcccagctgtgtgattttgccacactgtgtgatttttaggaagtggctcagtttcctcatccagaagatggggctagtagcagcactgtgtcactggattgtactgaggatggggctaatgaaatactttgatgtgcccagagcatagtgggtgagggaacccagcacaacaggactgggaaggaggcaggggccaggtggaggtggctgtggacctgccagtcccgggcacggtctgcatggagtagctgccattgctccttctgccaaagcagaacatgctccttcctatctcttcaaagttctctgcttttttccttcataaaactccccacagaccccaggactgcgacggccgtggtgagagatgctggttgggataagggcagcagtctgtcctgacccctctctcccttctctccagggcacctctcaccggtggccaataaccatcctgtccttccgtgaattcacctaccacttccgggtggcactgctggtgagcaggggcatcccacctaccctggaggtctgggcacccctgtctgcgacgtggggcttgaggaatggggggtttgcacagtatgtggtagggctgggggcacagtgtcaagcaatgtcagcagggagtgccatctgccccgcacccccagagccacctcaccttcccactgcccttccacccagggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 10284 - DNA, 6930 bp, Homo sapiens
ccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggccagggcccacctcagcccagtcatgtgactgtctgggttcagacttgtcagtcaatagacgtttgctgagcacagaataaggatcaggaatcaggcctgcagccttacgtagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctgggggttgaaggggaggctgggaggcttcctggcttcaaccaggcagctctgctctcaccaactttcatctgatggattttgtggcttcaagaaaaagaaagcctggaaaatgtggcttacagagatggaaattcaatgtgatgggggaaccccatgggggagatgtttgccaggcacctgtttactgagctgcctgccactctgtggctggctctgtacaggggactgggggtgatgaagatggacacgcccctgtccccaaagacctcacagagatgaaaacacagcagtgtgatgaggctctgaggggacatgcaggtagctttgggactggggaggacacttaatccggacgaaggtggggaggatcagggaaaacttctctggagttggtgacatttgagctgactctttaaaggacctttggaatttgcccagaagggatgtgggaagggcaccttccatctcgtctgtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggtgggctgggctccctcccctcacccagggaggtcctcaggtgacatgagcccaggtggtacagatcacccggaacttgccctttcagggaggagcctcccccataaggaagggtagcccctttccaggctacccttggacactgtctcttctggagggctccagtacagattgggggctgaggagtccctggtgggggtggggggtggcagggtaccctcaggctaaggtgccagttttgcccctgcaggcctgggaacttcacctaccacatccctgtcagcagtggcaccccactgcacctcagcctgactctgcagatgaagtgagtgccggtgtggggaagtgggaggcaggaggggagccagggagaatctcccgcagagcctcagaacagccgagtctgaggacagccggagagtctctggtatttcctgcatggtgggataagtgctgacttcattgcctacttcgtggttaactggctaaatgacctggcctcatgggctgaggaccacatgggatggtcgatgggaaaggttttgttcgagggccctggttattatgcggtgtttcaggctgggtggagattcagaggcgtgtggcaggctggctgggagggggctggggttgagggactctagaacctcatttctctgctaactgggcctgtctacagctcctcctcccccgtgtctgtggtgctgtgcagcctgaggtcaaaggaggaaccatgtgaggaggggagccttccacagagtctccacacccaccaggacacccaggtaggtgggactgggaagctgcgggccggccaggcccgagctgcttctctcctggcacaactgggcccccaaatgggcaaggagcagaagctgggagttatagagtaaagccttctccacaagggacactctggggcctgggcctctgtgtcccagggaggggcacgcgtgcccgtgtttgttcattgcactctgctgagcatctcccagccctgccgtgctggagacgtggggaagacagcagatcacaggtgctaatgtggatgagtgcaatgatggaaacaggcaggtgtctgggagcccatggcggggagggctgtggctcactggaggtgtctgcagaagcaggaaggagccgacctcatgctcaggttggggaagtggcacagctagatgtacagcatcagagggcccctcaggttccatgtttggccacctcttctgggagaactggatggtgagctcctccctggccaggtaaccggaagttatgactgtccctggggctgatggacccccagtttcttcttgagcctaagaggccatgggagaagacgctcaggacaaatgaagggaagtagtgattattttttcttgcccattcatgtgtttactcagaaaatattgattggggccccatctgtcccaggccctgtgctgggtgggcctagctgcaggggagagaggtggagtagacacaggttttgacttccaagaacgtactctatagtgagggagaaaagacgtgcagaaagcacctgcaacagaggtgggggtgcttctgagggaggcccgagccctgtcgccctgcagaagagacagtgtccaagacagagggagagcccagctagacacacagcagacatggtgctcgggcctgaaaccacatcacagacgcacagccaaagcctcaggtagatgggcaagctgcctgcagccaggctgcatgccaccctgtgagggagacagccagacagacctgggtttgaatcccagctgtgtgattttgccacactgtgtgatttttaggaagtggctcagtttcctcatccagaagatggggctagtagcagcactgtgtcactggattgtactgaggatggggctaatgaaatactttgatgtgcccagagcatagtgggtgagggaacccagcacaacaggactgggaaggaggcaggggccaggtggaggtggctgtggacctgccagtcccgggcacggtctgcatggagtagctgccattgctccttctgccaaagcagaacatgctccttcctatctcttcaaagttctctgcttttttccttcataaaactccccacagaccccaggactgcgacggccgtggtgagagatgctggttgggataagggcagcagtctgtcctgacccctctctcccttctctccagggcacctctcaccggtggccaataaccatcctgtccttccgtgaattcacctaccacttccgggtggcactgctggtgagcaggggcatcccacctaccctggaggtctgggcacccctgtctgcgacgtggggcttgaggaatggggggtttgcacagtatgtggtagggctgggggcacagtgtcaagcaatgtcagcagggagtgccatctgccccgcacccccagagccacctcaccttcccactgcccttccacccagggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 10285 - DNA, 131 bp, Homo sapiens
ggggcacccccttaaccgctcctccgacctccagcagagcccactggggacagcctcagcctggccctctttgcatttgcacttttcctcttggtcctcagtcatcgtccgtggttccggaccaggcctgc

SEQ ID NO: 10286 - DNA, 3562 bp, Homo sapiens
  misc_feature (184)..(184): n equals a,t,g, or c
actgctatacatctgcatttattatgagcagcaggtgggacacttccagcaacagtaaaaaaaagtaatttacaaaagcaggtttcagtgaagccatctggttgttacctaaaagaggagaggggtatcaaaataagaccaatggcccttctttcctccttctctccctgcacccctgtgctcntggggcaagggctattgagcacacacctctgaggatgagccaccagagctgattcctactggcctgtttggtggattgtctgcagcaagttttaagccctggatcttgaccccttttcagccagctgacttcccagcagcctctccaagtcactggggtctgacttctaagaatgtaaatgtacagccatgggatgcctgcgtccacactctaggtggtacatcccaaaggcagatcgaggccttgggccatgtgagctcagaactgagagtcacatttggctcaaatccgtatgaggggcagggaaagaggcacaaatgtctagtgtccctacccattccactgagtctgtctccatcaaccaaggggtcatgctggtaagagctttaaggaccctgctgacctgactctggggaggcttccctgggctgtgccttggaggctcacgcatccatcccattgcagctcttacccttgggtgctcacacgtagatgccaacccagagcagcaggaagaggactccaaagcccatgaagagtgaggccactaaggagatgaggagctctttatagatatcacgagtgtacttggtagaggtgacctcgtaactgggcacagcagttaaggcaaagcgaaggggtggactgtggagtgcagagagcccagcccacggcaatctgaggagaaaagcattggctcaatgccttctgggaggcctatctggctcagaacagccaggcagaagggcctaagagatgccttggactctggtgctccactgccatgaagaaaatgagacccagaggagttaggtcacttgccccaggtcacacagctcatgagggccggagctgggactagccctcagacctcctgacacctgagtgcacccttccttataccacctttccaactgtagcacccctattccccacctccactccagccaggtcccctgctcactgtcctggaaatccaaagaacaaactgagctcacctgaacttgggaaataaggctataacctgcccctgggcatcactagccctcctctcctccttaccttctctcagccccaatccaatgtacaaaaccggcggggtccatgtacctagcgtggtttctccctgagcttcccacatcactaatgctggtcctctggctgctcagtgaaaggatacacgaagaaccaggcggtgaagaacatgccaatggccaaaagcaccacggtcagatgggggaagacagctgggttcactgggctggtatatctgctcatggcctcgagctcctagaggagggaaagagatcagagctatcaaagaatcccacgatttcagcctggagagaacatgcggttatcaaggagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatggcacgggttcggcagaagaactttcccaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttc

SEQ ID NO: 10287 - DNA, 3564 bp, Homo sapiens
actgctatacatctgcatttattatgagcagcaggtgggacacttccagcaacagtaaaaaaaagtaatttacaaaagcaggtttcagtgaagccatctggttgttacctaaaagaggagaggggtatcaaaataagaccaatggcccttctttcctccttctctccctgcacccctgtgctcctggggcaagggctattgagcacacacctctgaggatgagccaccagagctgattcctagtggcctgtttggtggattgtctgcagcaagttttaagccctggatcttgaccccctttcagccagctgacttcccagcagcctctccaagtcactggggtctgacttctaagaatgtaaatgtacagccatgggatgcctgcgtccacacttctaggtggtacatcccaaaggcagatcgaggccttgggccatgtgagctcagaactgagagtcacatttggctcaaatccgtatgaggggcagggaaagaggcacaaatgtctagtgtccctacccattccactgagtctgtctccatcaaccaaggggtcatgctggtaagagctttaaggaccctgctgacctgactctggggaggcttccctgggctgtgccttggaggctcacgcatccatcccattgcagctcttacccttgggtgctcacacgtagatgccaacccagagcagcaggaagaggactccaaagcccatgaagagtgaggccactaaggagatgaggagctctttatagatatcacgagtgtacttggtagaggtgacctcgtaactgggcacagcagttaaggcaaagcgaaggggtggactgtggagtgcagagagcccagcccacggcaatctgaggagaaaagcattggctcaatgccttctgggaggcctatctggctcagagcagccaggcagaggggcctaagagatgccttggactctggtgctccactgccatgaagaaaatgagacccagaggagttaggtcacttgccccaggtcacacagctcatgagggccggagctgggactagccctcagacctcctgacacctgagtgcacccttccttataccacctttccaactgtagcacccctattccccacctccactccagccaggtcccctgctcactgtcctggaaatccaaagaacaaactgagctcacctgaacttgggaaataaggctataacctgcccctgggcatcactagccctcctctcctccttaccttctctcagccccaatccaatgtacaaaaccggcggggtccatgtacctagcgtggtttctccctgagcttcccacatcactaatgctggtcctctggctgctcagtgaaaggatacacgaagaaccaggcggtgaagaacatgccaatggccaaaagcaccacggtcagatgggggaagacagctgggttcactgggctggtatatctgctcatggcctcgagctcctagaggagggaaagagatcagagctatcaaagaatcccacgatttcagcctggagagaacatgcggttatcaaggagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttc

SEQ ID NO: 10288 - DNA, 131 bp, Homo sapiens; identical to SEQ ID NO: 10285

SEQ ID NO: 10289 - DNA, 131 bp, Homo sapiens
ggggcacccccttaaccgctcctctgacctccagcagagcccactggggacagcctcagcctggccctctttgcatttgcacttttcctcttggtcctcagtcatcgtccgtggttccggaccaggcctgc

SEQ ID NO: 10290 - DNA, 3564 bp, Homo sapiens
actgctatacatctgcatttattatgagcagcaggtgggacacttccagcaacagtaaaaaaaagtaatttacaaaagcaggtttcagtgaagccatctggttgttacctaaaagaggagaggggtatcaaaataagaccaatggcccttctttcctccttctctccctgcacccctgtgctcctggggcaagggctattgagcacacacctctgaggatgagccaccagagctgattcctagtggcctgtttggtggattgtctgcagcaagttttaagccctggatcttgaccccctttcagccagctgacttcccagcagcctctccaagtcactggggtctgacttctaagaatgtaaatgtacagccatgggatgcctgcgtccacacttctaggtggtacatcccaaaggcagatcgaggccttgggccatgtgagctcagaactgagagtcacatttggctcaaatccgtatgaggggcagggaaagaggcacaaatgtctagtgtccctacccattccactgagtctgtctccatcaaccaaggggtcatgctggtaagagctttaaggaccctgctgacctgactctggggaggcttccctgggctgtgccttggaggctcacgcatccatcccattgcagctcttacccttgggtgctcacacgtagatgccaacccagagcagcaggaagaggactccaaagcccatgaagagtgaggccactaaggagatgaggagctctttatagatatcacgagtgtacttggtagaggtgacctcgtaactgggcacagcagttaaggcaaagcgaaggggtggactgtggagtgcagagagcccagcccacggcaatctgaggagaaaagcattggctcaatgccttctgggaggcctatctggctcagagcagccaggcagaggggcctaagagatgccttggactctggtgctccactgccatgaagaaaatgagacccagaggagttaggtcacttgccccaggtcacacagctcatgagggccggagctgggactagccctcagacctcctgacacctgagtgcacccttccttataccacctttccaactgtagcacccctattccccacctccactccagccaggtcccctgctcactgtcctggaaatccaaagaacaaactgagctcacctgaacttgggaaataaggccataacctgcccctgggcatcaccagccctcctctcctccttaccttctctcagccccaatccaatgtacaaaaccggcggggtccatgtacctagcgtggtttctccctgagcttcccacatcactaatgctggtcctctggctgctcagtgaaaggatacacgaagaaccaggcggtgaagaacatgccaatggccaaaagcaccacggtcagatgggggaagacagctgggttcactgggctggtatatctgctcatggcctcgagctcctagaggagggaaagagatcagagctatcaaagaatcccacgatttcagcctggagagaacatgcggttatcaaggagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcgacaggagcaggcgcctagcacaaccggaaaaggaagtgcctccggcgcaagtggcattgagggacttgtagtcctgcgatttc

SEQ ID NO: 10291 - DNA, 1075 bp, Homo sapiens
taaataagatatggcttaggtttctggttacctgagacatactataccttctcagatactctcagacctgaatcatttaacaaactaaggcagaaatactaaaaatatctggttcaataacataggggcatggagtagacatgcagaaaatgcttgttcacttgccttgaaatggctccaggtggcctgaaggaatcaatgaaacttctcaagtatctacattacaaccactggtccccactacacatttatttctaaataaaggaggagaaactctagcaaagtaatatttaacattttcattgcttccaggataaatcttattgaatatggaggatctgatagtggtaggtctatcaggaatatcacggaaaatgcttttgatgttgttggcaaagtcaattcctatcatttgtacttgacaccagctacctagcaggctcattgtgaacttcaggtttcgcccacgttatttatataaagtatctcagtgtaatatagggagttgctggttatttgaaaatagtaacaaaaaataacccaaacgagaaactccatttccataattagctttcctgaaagtcaggcatgtctttgaggacaggttttggcagtattatttttgtgcacaggaggaaaattgttagtaggtttatagatgttatttttataatagaatgttaaacccctgaaaaacatcaaaaattgtctcctagaactaattctatgttttaaaaacttgttttaaaaaggattctaaatagcaatagggtctttcctcctttctccactccaatggtttaatgggatagaggaatcaatgtttatatttttaaacctgtaaatattttattttgggtattttgtatatttgttgatataattccattttgtgcatatgtaccattgtgcatgttgctgtttttgatagtcactcttttaatgaatgtaagaagcttgggctaatagcacttttcttgttccattcaaacatctgaaaatgaaattacaacactgccattttactgttgtgtttaattcagtcaataaattttgttgctcctttgcatttaaa

SEQ ID NO: 10292 - DNA, 119 bp, Homo sapiens
gaagatgagtatttcatattgaattctactaacatatcctgtatgtttactatgttgccagagaggatgctgtgtgctttttttacattgttatctttactcttcacaagaaccatgta

SEQ ID NO: 10293 - DNA, 2730 bp, Homo sapiens
ctgtggagggctgctgcccccagatagagctgcctctctgctgaggctgccaccagccaccagcaatcccttttcatgtgacctgcagttgtgcatgatgatctctatcaatcctttttccccaggctcctggtagtgcatagcattgcaccaggtgcttcaggagaaaagctgcctccactgctaatctgaaaagcactttgcctggaaagacacctgagacgtgtaagatattaatagctgcagaagtttcatccctgtgtaatttaaatccctttcccgaggaacactcttacggtgggggtggaagagaaggagagaaaagcctagaataattatgagaggttgtgggaaaaatttttttggggatgactgaaatattctagtttaatcatccaccctggtgcttgctggatttggtaatgaacatttttactttctccttaaagtcagaggctattttgacagctacagatgctgtaaattacaagtgttctgatatggtcctgtgagaagctcttgaaaaagtgttccactaaataagtttgggaagggctgtaaataccatctgcctcctagtgagccccagtgcacatcggcatttgaggggatgagagatccttcctacagaaacctcttatgctctggttatccttggatttaccatattgatgtgaagatagatttcctcaaatgtattgccctatctctgataggttgctaataatgttcaagggtaaaaactttgttgaaggggaatggaatgttatggaaattgaagtgtagactgtgtagttgttggggtagatgggggagggtctcaggcttattttggtaagagagggagactgcctcctagcacctttttctgtgctctggcccttaggcagtgggatatacagatgtcaggtattccaggatttgttgaaatctctcctttggagagatttgaggtggtctgttccatgcatggagtctaaagttgagacaagtcaaggcagttatcacacagagtgcagtgggagagccatgcagagggtaagatcaggtggctttgtaaaggaatccatgcagaacagtgtgttttagggcggacagactttaggctttaagggcaggccctttgctggacccattgacaaagtcactgacagctgtttggaacaattgcctaggaaagcctgtccccacaagactcttgtcttaacacaggcatcctaggtggtgatattgttactccatggacttctctggggccatcagaagtcctgaatgaactgggggtcaagctcatgaagcatctggctcctactcaggaaagcatggcagcctgtacttaggcttctctggcagcaccagggtgtgtccagaaagcatcaatcagggaagaacagtgtgagtgcctaatgaggatggatcccagtgagcaaagagacccaaatcaatagagggaaaacaaatgcaggtgaaaacctttggagtaacacgaatatagggttaaaacccagctctactttcatacctttgcacaaattacttaagctctctaggcctcatttttctcatctgtaagatgagaataataaataccactttgctaggcattgggaggatgaaatgatttcacacatggaatactccagcactgtgataaattccatccattcattctgctgccacagatcaagaggagttgaatgatagtgagaccatcattcacttgagccaatccttcccctagtgctacgattctgatcctgttcacttttaccccactttttcaagggtgagtctcacagagcttttaagtttggcctctcacactctcccacacctgctaaatccttataaatgtttcttctcttccctcaaacttccctcactgtcttatttgtttcttgccctgtggaaggcagtagggtacacattcttcttagtgtaaatatgccttgaatttgcacaagggcaggacaatgtgttcttttttccaacagctgttttgatgatgcttggcaacatgttggtatttttggcccgagtagcacatattgagaccacatcctcaaggaatactttttgatctctcccaagtctcttttctagactgaatggtttggattttccattgatgaaaaacattccccttttcttgcccacatgagagtttatctgcccgtttttctgatcatctctctcctcttgtttacagcacatgcaaaagtctcttgggctcttcctatagtttataacttttgttttagttttatattacctggaatagcttaggatcatctcagagggactctggcatagtccctcttggagatcagggatgccaggaggggcattaaggatggagagatcaggtgaatagtgaaggagtgatactggacaaattgtaaagctctaaagctccaccaggtggaggagggcacaggtgctgaaagacaagagaggtaagggaaagcctagaatcaagtcagaggcacagcaaacagaagtaccccaagcaagccagttagaccaagagagaggctcattgtcctgtcttttctttcttatgggtgcgtggccctgaagcaggagattctgctcttgaatgggaaagggttttcaagagactctttgaccagttctccatccatgagaatacatctcaattaccatggagacttccatcttaaaaatagccattgagtggaatcttagtgcaaaaaaaaaaaaaaaaaa

SEQ ID NO: 10294 - DNA, 2265 bp, Homo sapiens
cagctacagatgctgtaaattacaagtgttctgatatggtcctgtgagaagctcttgaaaaagtgttccactaaataagtttgggaagggctgtaaataccatctgcctcctagtgagccccagtgcacatcggcatttgaggggatgagagatccttcctacagaaacctcttatgctctggttatccttggatttaccatattgatgtgaagatagatttcctcaaatgtattgccctatctctgataggttgctaataatgttcaagggtaaaaactttgttgaaggggaatggaatgttatggaaattgaagtgtagactgtgtagttgttggggtagatgggggagggtctcaggcttattttggtaagagagggagactgcctcctagcacctttttctgtgctctggcccttaggcagtgggatatacagatgtcaggtattccaggatttgttgaaatctctcctttggagagatttgaggtggtctgttccatgcatggagtctaaagttgagacaagtcaaggcagttatcacacagagtgcagtgggagagccatgcagagggtaagatcaggtggctttgtaaaggaatccatgcagaacagtgtgttttagggcggacagactttaggctttaagggcaggccctttgctggacccattgacaaagtcactgacagctgtttggaacaattgcctaggaaagcctgtccccacaagactcttgtcttaacacaggcatcctaggtggtgatattgttactccatggacttctctggggccatcagaagtcctgaatgaactgggggtcaagctcatgaagcatctggctcctactcaggaaagcatggcagcctgtacttaggcttctctggcagcaccagggtgtgtccagaaagcatcaatcagggaagaacagtgtgagtgcctaatgaggatggatcccagtgagcaaagagacccaaatcaatagagggaaaacaaatgcaggtgaaaacctttggagtaacacgaatatagggttaaaacccagctctactttcatacctttgcacaaattacttaagctctctaggcctcatttttctcatctgtaagatgagaataataaataccactttgctaggcattgggaggatgaaatgatttcacacatggaatactccagcactgtgataaattccatccattcattctgctgccacagatcaagaggagttgaatgatagtgagaccatcattcacttgagccaatccttcccctagtgctacgattctgatcctgttcacttttaccccactttttcaagggtgagtctcacagagcttttaagtttggcctctcacactctcccacacctgctaaatccttataaatgtttcttctcttccctcaaacttccctcactgtcttatttgtttcttgccctgtggaaggcagtagggtacacattcttcttagtgtaaatatgccttgaatttgcacaagggcaggacaatgtgttcttttttccaacagctgttttgatgatgcttggcaacatgttggtatttttggcccgagtagcacatattgagaccacatcctcaaggaatactttttgatctctcccaagtctcttttctagactgaatggtttggattttccattgatgaaaaacattccccttttcttgcccacatgagagtttatctgcccgtttttctgatcatctctctcctcttgtttacagcacatgcaaaagtctcttgggctcttcctatagtttataacttttgttttagttttatattacctggaatagcttaggatcatctcagagggactctggcatagtccctcttggagatcagggatgccaggaggggcattaaggatggagagatcaggtgaatagtgaaggagtgatactggacaaattgtaaagctctaaagctccaccaggtggaggagggcacaggtgctgaaagacaagagaggtaagggaaagcctagaatcaagtcagaggcacagcaaacagaagtaccccaagcaagccagttagaccaagagagaggctcattgtcctgtcttttctttcttatgggtgcgtggccctgaagcaggagattctgctcttgaatgggaaagggttttcaagagactctttgaccagttctccatccatgagaatacatctcaattaccatggagacttccatcttaaaaatagccattgagtggaatcttagtgcaaaaaaaaaaaaaaaaaa

SEQ ID NO: 10295 - DNA, 1934 bp, Homo sapiens
ggagaccgagagtctgaactatcagaagtcccagaggcaggcggggaggggctgacaacccaggacgcgggatgtggaactgaggagggagaggcgtctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgccccctttcctgcaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtaggcacagggcaactcagctggggtggggaagagaccgcgggcacctgggaacctgttctcacgggcctgacttccgcctccaggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacgtaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaa

SEQ ID NO: 10296 - DNA, 1934 bp, Homo sapiens
ggagaccgagagtctgaactatcagaagtcccagaggcaggcggggaggggctgacaacccaggacgcgggatgtggaactgaggagggagaggcatctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgccccctttcctgcaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtaggcacagggcaactcagctggggtggggaagagaccgcgggcacctgggaacctgttctcacgggcctgacttccgcctccaggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaa

SEQ ID NO: 10297 - DNA, 1931 bp, Homo sapiens
ggagaccgagagtctgaactatcagaagtcccagaggcaggcggggaggggctgacaacccaggacgcgggatgtggaactgaggagggagaggcatctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggtgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccactctgagggaaaggcaccatagctccttgagcacaggtctcatggtgaccaggggccggaggcacatgccaagagactgaaccataaagcctggaacatgtcaggggccaagaagagcagccaacacaccatgcccctgcagaagctgcgcctgagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgccccctttcctgcaggccccgctccccgggtcccttctagacgtctctgtcccaaggagtcgcgtgcacctctcgagaagctcctcacagcgtcgctcccggccctcttttcgtcggactccggcttgggagcagcaggaggagcccccagcccccaaccctcttgaggaggagctgtcagctcttgagcagagacccctccagctggaggaacccctggagccaagccttctgaggcatgatgggaccccggtgccagccaggagaaggcccttgggacacgggtaggcacagggcaactcagctggggtggggaagagaccgcgggcacctgggaacctgttctcacgggcctgacttccgcctccaggtttggccctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaa

SEQ ID NO: 10298 - DNA, 1934 bp, Homo sapiens; identical to SEQ ID NO: 10295

SEQ ID NO: 10299 - DNA, 866 bp, Homo sapiens
ggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcggggaggctgggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacaggcccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtg

SEQ ID NO: 10300 - DNA, 348 bp, Homo sapiens
tggatgagagtgctttattgggcacccagcatgggggcttggcccgaggaggaccatcgggccccaagacaataaataaaccatcatctccctaaacaataaataaatatccaagaaataaatagctggcgaggaccagaggggctttcagttactgggtagggcctggggcagggggctggaagagccctcccttgtccaaggctgatgatgcgaaggctgccctgatgccaagactccagtcctaaagttctaaagggtggggggcagggggctaagaagccaccgatcagggctgggggctcaatgttgggaaccccaagggccagactgagtgcccagccttgg

SEQ ID NO: 10301 - DNA, 348 bp, Homo sapiens
tggatgagagtgctttattgggcacccagcatgggggcttggcccgaggaggaccatcgggccccaagacaataaataaaccatcatctccctaaacaataaataaatatccaagaaataaatagctggcgaggaccagaggggctttcagttactgggtagagcctggggcagggggctggaagagccctcccttgtccaaggctgatgatgcgaaggctgccctgatgccaagactccagtcctaaagttctaaagggtggggggcagggggctaagaagccaccgatcagggctgggggctcaatgttgggaaccccaagggccagactgagtgcccagccttgg

SEQ ID NO: 10302 - DNA, 893 bp, Homo sapiens
ggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcggggaggctgggacagcctcaggaggggaggaggccgggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagccccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtg

SEQ ID NO: 10303 - DNA, 349 bp, Homo sapiens
tggatgagagtgctttattgggcacccagcatgggggcttggcccgaggaggaccatcgggccccaagacaataaataaaccatcatctccctaaacaataaataaatatccccgacataaatagctggcgaggaccagagggggctttcagttactgggtagagcctggggcacggggctggaagagccctcccttgtccaaggctgatgatgcgaatgctgccctgatgccaagactccagtcctaaagttctaaagggtggggggcagggggctaagaagccaccgatcaaggctgggggctcaatgttgggaaccccaagggccagactgagtgcccagccttgg

SEQ ID NO: 10304 - DNA, 348 bp, Homo sapiens; identical to SEQ ID NO: 10300

SEQ ID NO: 10305 - DNA, 893 bp, Homo sapiens; identical to SEQ ID NO: 10302

SEQ ID NO: 10306 - DNA, 1546 bp, Homo sapiens
attgttattccaataggaaaagcattttatctcttcactttagcctttgctgagtattgtacaaaaagaatgatgctgcactaaataatgaacttctttttgaagaatttaataactagatgcattttgccttcctggaatccttttgtctgtctctttgcatcgttgactcttgcttatccagagatctcagcttaaatatttccttaaaggtacctttcctgagattccagctggaattgagtccccttagtatactctgccatatcacctcttgcagtttataattacccagctgtttgtatgaatgttatgtctgtgtctcacatcacactttgaatttcagagagagcagtggccatgtctgtttcggtcactgctctataactccagtgtctctcataacagtctgggaaataataagtactaattaagtatttgttaagtggaaatactgctgttagagcttctcctaattagagtgttaaaaatgagataatgtgtgcatgggggaaggggaaggagagggagaggaagtagataaacttgtgatattaccgtgagataatcctcaagtaagtcctctcacctccagggcctttgtttcaccttgtctgtaaaataggacagactgggttcaagatgccattaatatcctatattttgattccagtaacaatgatgacagattatgtaagctcatttgaatggaatatgtgacagctagctccccaaaagaatatttgacaagttctaaataaacatattagaaatgcttgccaactagatgatattatttagagcctcgtacccctgttagaaacaagcatatataattggtatatagtttgtaaattaataagatgtactcttctttcagttttctaattgaagcgtaaagacaaaattaagcagcatatcaaggttcatgtaagttacagttattaggtttaatatttagttttaatatttttcacccaacatcttgttgcatcttccagagtaaatctggggtccataaaccaaaccaggagagggaaaatggaaagagtgggcagaaatctgacagctcttaggtttcttctatttgtgttaatactgagacttttaaaaatcatttttatatgtagtgtttattatgaatagttgtaatttgttctgataaattagttgtattaaacactgttatttggctaatattactaggtataataaaatgatatttagtgggaagacattcatcaaagtagaagtagttaatttgggccaggtgcagtggctcacgcctgtaatcccagcactttgggaggccgagatgggcggatcacttgaggtcaggagttccagaccagcctggccaacatgatgaaaccccgtctctactaaaaatccaaaaatgagccaggtatggtgatgtgcacctgtaatcccagctactggggcggctgaggcacaagaatcgcttgaacccgggaggcggaggctgcaatcagtcaagatcgcgccactgtactccagcctaggcaacagagcaagtctctgtctc

SEQ ID NO: 10307 - DNA, 349 bp, Homo sapiens
gcttctccagccgccagaacttgaaaccgctctacaaatctccaggccatgattatatctgtctttttgagctctttctccaagattgcaggagtcagctttgtgattacatttgtgaattgctttagtagtatggaatggactgcatctggacccagagactcaaactcatgtaaagttgttatagtcttagtcatttgtctcaggtttcagttctcaatgcctttctgcagttttagtttaaaactgtggagaagataagcaaaatacaagttgagcagtctgtctttctgtgcgatttctcaaccttagcaacatcctctgagcagtgattcttagttccttgttc

SEQ ID NO: 10308 - DNA, 10198 bp, Homo sapiens
ttgcaaagaagattgctttgtattttatttacaacagaatgtaagaaaaagtaagttattaacaataataaataactaggaagaaaaacacagaacagccacaaaatgacacagaaggatggcatatgtaaggatcaacttttgtttgctttgcttatagtctgtaatgctgtgtattccaacacctggtccttcagcagtggcagtggtatgtggattaatttaaccaatcaagatcccagcttgaatgtaaacactacaaattacacttgagctacatgtgagtggtacaggtacaacaccaactcagagaccctctcctgggtgatatatagaaactgaagggagacttgcaatttgacagacatgctttcaatttaaagcaaaaaacatcaagaggcttatcctaaagtccttgttaatttaacaacaaaattacaattattaatggcatctgaaaatttcccaacatattcacattctcttattacactaactcctaaaaagcttaaacacttatatttcaaatgcaaacagattgttttgaaggtagaacacaaaagaacccaatgttttgcctcagcatgccaacagtgtgctattgtgtacacttcagtttcagcaagaatgaatagttaaaatagtttattcataatcagattgcagtcactggacagactttttaaatctcaagaactatggctcagatgacagattgtctcctagcctactgagtcagatgatcagaaaggtactaaaactatttggacaattcctctctattggattatctgattacacattatatgtagagtcagctatacactggcccttcttaagagtaaaattcctatcgacgtaagccagccaatgacctattactttgttgtcgctgagccatgaagagatgccaaagaaagtagaatttaaaaatacacataaatacattagccctgaaacttttgcagagaatgatttatcgagatgtatcagaatctattctcttagttcactgtttattacagtgtcttgaaagaaaaccacagttacttttgcaggtattgtggtaagtgtctgcataatatacccacaactgtgctacttagagatttattttcaggaccaacaacatggctaataaatacttccaaataaattaaaattttcctcacacacagatgcaaaaccgtaacagaagccttgataaatcagttcaccaacaaacccatattgtttgagttacaacggtggcaactaaaaatgtcacggcctccttcattgtgttccttttcctttgctttgtcttgcaacaacccaaagtgagaaaatgaaatgatcttcagaggtgatttctaacaaagcttatgtgttaaatacaccaagatcttctcatcccaggaaagcacagctaaagcaagaatgccgtgctatggccaagaaaatgcacaggggcacttcacatttgaaatcttcccagagttatgaaatgtacagtcattttgatggtctccactaacttcagagatgaagatggagtgaacgtatgtgatattctatggattatttatttaagtttggctaccagagacttaaaactgatggtgtctgattcactatactatatttatatttatatatatatatatatatatatatacacaggtataatacaattttggtgaacaaagttgaaggtttccatatcgcagacagaggcactgagttaaggattctatttccccccaaacatgcttagcaaattcaagtttctgctttttttttcttctaatttccatcatgcagccatttggcttccatccttctaagaattattaatgttctgtatatatacatccattgcaggcttgtattccacaataacaaagtcatgtatagagaatgtgaaatgatacttgaaaaccaagatatataaaatattgaagtcatttatgccttttgatgactgggttaaatatgcaaagcagctaaaggaatatttacaccacccaccccctttttaactcacacaaagcatatgtagacagaaaaactgaacatactttaagagcacacgcttttttttcggctaagaatcacactatcatcgtagctttgcaactgatgtctgtggtaacatactggttataaaagaaatgaaactcacaaaaggaaattagaacttagcttcctaaagcatatagaattgttaaccttgacagcagaagctactttataaaaagggaaaatagcaatgctcttaatggaaaaactaggtgccagatgtgtttaacagcctgcacaaaataaatacattctatgtgaaaataatgaccccatcccaccttgattttagcttgcaaatggtaagcaaatacatatactatttcagtgtcttctgaaagtagcattttgctctctaaagcaaaacattttcattaagtactactgtgtggagagggagggattgagaagtccgaggggtctgataaaatattaggttttcccacaagcaaaaatcatgcttccataccatgcatagaaggtgtcttactaagatactatcattcttagggaagagatacactgttgatctaagctatttgcaacaggtttcctttgagttctaggtttattctttttttttaagctaaatatcaacctatagataaagaaatgatcttgacagtctgacctatgacttagaaaactttggtgctgggctcatggggccagcgcctgcaccttgggagagtgtatcaacctgaaagacactacacagagtgctgagcactgagagggaagcaggcagggtccactggcagagaggctgtgtgagagaagcagattatgctccttggtctattttgtttcctttgggatctgtgttttgggaaggtccctttcctgaggttggaggttacgatcaggaaggctagctggggcgtgggcctccaagttgcccaattacttcttctcttcctctcttggaggacaaaagtcaatgctgagatttggcctgccctcccgtctgtgtttaaaggcagtgaggtgcaaaggtgacagatttctctctttggagcaaaggagaattgtctttctgtcacttcagtgagtgaccttgcctcctgtcaaccttgattctaatcttgcattaccactagttgaagaaaggaaagctagacagaagggcatctattatcactcctccttttcactctacaaataggagtcagcaattctgctcattctctcctcccacttgacagtagttgcttgatgtctgtgacattcccaatatttgtatttcaagtaaggagcaagagaatgacagtcttttctaaggtctggtggtaggcaatctgttccagggaattctggatgttactaagagtaaaacaaggaaggggatgggagacagttctcttttttatagttcatgcaccagacattctgaccatgttaaagcccagttagcttactctacccttgtacttctttgagtgggcagatagtaaatgaattctattcaattaattgcaaattctgagaatcttaattgatgatggaagctgacaagtcaaggtttgttggtacctgtagagaaaaaagatgttgcctcacctgggcctcttggttcctaaactgaaccattccaaaatcagttatggtcacattcatccatgcaattcttaaggatttctgaggccacaagggcacaaaaggggaaagttattaaaagacagaaacaagtagaatctttattaaattctgtggaaggtataaatgagttattattaattgcacttggagcctctatagcttgatgattaaaattttcaaaagtttagagttaattaggctccaaatcctgagtcagactaaccacaaaataggaatctcagtaactattggtattcaagtattagtaattagcagttcaaaatttaacagctaagtatgttatgcctgagagtattttggagaattttagatttgatgagaggaaactgacttcactattttctaccgtaccttgtaacaaaagtggtgcaaagttttcattcatttatccttgaagtccatgccaaacctcatcaaatgcccaataacaaggcttcctctctggcatacagctatgtggttacagaagattccttctgtcctttgcaagtcttacatcttacatctaatatgatgctgtgtagcatacttagggaatcatattctatgtgaagttactgagtcacatgcacactgaaaggtcgaaggaacatgtttgagtgacaaagcagtctttttctctatcagaagattcttaaaaaaaaacaacaacaacaaatgaaaatataaaaccccatgagatatttatataaagttactcagatttgggccgacatggcttatctgaagagtgcatgccgggtaaattcagggtggcttttttctcagggtctggaagtgtgagagtttctggggcagactttttccggggccgatctttgggaacggacagaaattcgggtgcgtctgtggagagaggggtggatggagcactagaaggcgcactgcggacggaagaaggcagcagggggatgctggagatagaaattgcaggtgggaaaatgccgattttcttgttggtggcttcctgagtggctcgttcaaattctcggacttcatccattgtcatgtcttcaaggagaaaaacagaaagaaaaacgagcagttatttataagagaggcaaatagattcatcactacccttgtttttacaggaactatgggaaccctatcataaaggggcctctcccgattatacacccaaagtatcattgaaataccaaacccccaattttttctattggaagctacaccctgaaaacaatatccctttatgattatccatttaagattttccaaagcactcttcacagtgagtattttaagtattctcaataaggacttaacagtagaatacagaactagacgggggaaatatgtgcctgtgtgtgtgtatgtgtgtgcacccgtgtgcatctgtgttgttgtgggtctggtgtggggtatttggagctataattaactggtcatatttttcataaagagaaggtaattaaaacaatcaatggccctgaaatgacacatattattgtcattattgtcaactttagatcatgaaagtatacctttatagggtaaacaggtaaatcatcaggatttttcaacatactatcttcttttttttttttctttctgagacgggatctcactgcatcacccaggctggagtgcagtggtgcgatcatgactcacggcagtctcgacctcctgggctcaagtgatcctcctgcattagggccccgtgaggctgaaaccacaggtgcatgccataatgcctggtttaatttttttgtattttctgtagagacagggtctcgctatgttgcctaggctggtcttgaattcctcacctcaagtgatccgcctgcctaagcctcccaaagtgttgggattacaggcgtgagccactgtactcaggccaacatgctatcttcttaatcaatacatatacttttttattctgaggggccacaaagatgctgttgtttctggtttcctgactgtgtgtcgatcctaagaaggttcagagattgtgttttaataaattcagtttcaaaaacacgtaaatcaacaatttcaccacaccctgctaatcattccaaagccaagaaaataaaaccatttcttgaggaaacttaaaaagaatagagaatgaaaggagaggatcatttaatagtgaggattctatttaaaagaaaaaaaagcatgacttggaattcaacaaataagacagtgataccactgttaataatcattgttggataatgtaggttttccaaatacctgaaatgttcttatttaagtgagaaagtaaaaacagtatttaaaaaatgtaaatctttccctaatgtgtttaatgtattatacatacttcctacatttgagacataatatgttgaagatatatcactgtgcaaaaatacagttccttagttccttctcagggtctatttgctctttatggcttgatatctcttctctcatgctcagaaactctattattactgttattatttatttatttatttatttatttatttgagatagagtcttgctctgttgcacaggccggagtgcaatggcgtgatcttggctcactgcaacctccacctcctgggttcaagtaattctcctgcctcagcctcctgaatagctgggactacaggcacgtgccaccatgccctgctaatttttgtacttttagcagagacagggtttcaccatgttggccaggctggtctcgaactcctaacctcgtgatccacctgcctcagactcccaaagtgctgggattacagacctgagccaccgtgcccagccttattactgttattattaattattgttaccctggctatccctggtatcctttgccatttttacttgctgggaacagggaaaagaggaacctgggcttattaaagactgagtcaaggcccaaggcttatcctggagcaaaatgcaaaatttagtgcccgcggattttctgtatctgttttggccccccagagacccatttttcattgtttcttgtccactgccatgtacttagcagttgaaacttcattagataatattggagggaataaccagcaggaaacaatatagccactttggaaatactgagtatgtaatgaatattcataacacagtattaatccttaggacttttctttttctttttttttttttttgagacagagttttgctcttgtctcccaggctggagtgcaacggcgagatctcggctcactgcaacttccgcctccggggttcaagcgattctcctgcctcagcctcccgagtagctgggattacaggcgtctgccaccacgcccggctaatttttgtgttattagtagagatggggtttcaccatgttggccaggctggtctcgaactcctgacctcaggtcatccgtccacctcagcctcccaaagtgctgggattataggcatgagccaccgtgcccagcttaatctttaggttttataacatctgagcaaaccagaagtatttttcacaaaatgaaatccttaagaggatttcctgggaacaattattaaaattttctgaaagggaaagtttttacaaaggatataagtcattatgactatgtggataagatataaaattcagcatatatcaagaaaaattgtacctataaacttaccaatttttaaaaacatggaagactattaaatgagctaagaagtgagattaaggttatataaaaagaggcatttatttcacaataaagttgagactgagaaaaattttagtgtatcagggtatgttatgtttttgctatgataaatggatattatctttgaaaaagcagactttcttaatcaagtggctgaatacattgttctactccacatagccagcagggggcagaaataatctaaagcacagaattttgattttccactcccagaggctcttagaagttcccgtccttgaaggctttgaacctgctcaattgaaaagacttatttcctcactgctgtgttcatggatgttaattttgcctaatttcaatctaatttgtccctgcttgggttgatgatctaaaattcatttagcacccatgcagtttttatttgtgacaaagagccacctcctgattttcactgcttttcattatgatacaggagaaagactaaggaaaaataaatgtgctccaatttcacggaattccaaaggataatggaaatgtcataagcattcaaaataaccactttgtgtaacttctccggtggcaggcatctttcaccctgaagtcacgggaacaacgctgaggggcagccagagattatgtgggcttttccatgggaagaaccactctacgttatcaccttctacatagtaagtggactttattttttattttactttatttatttattttactttatttatttatttatttatttgagatggagttgcactcttgttgcccaggctggagtgcagtggcacaatctctgctcactgcaacctccatctcctgggttcaaacgattctcctgcctcagcctcccgagtagctgggattacaggcatgcgccaccacgcccagctaattttgtatttttagtagagacggggtttcttcatgttggtcaggctggtcttgaactcccgacctcaggtgatacgcccgccttggcatcccaaagtgctgggattacaggcgtgagccaccgcacccagccatggactttaattataaagtaataatcacagtaaaactgaaagaaagccaagccaaggggcttataagctgtgagaaaatcactgagcttagcatcttttagccatctggtgtctcctctttacctgtggcttcttcctttgtttgcctggtcatatttatagtgaatggctttcagagtggctgagggggaactggggcccaacatttctaaaagaaaaggtaattgaaagtgatagaaattcaaggagagtttccttaaagagcacttctagggggaagtcctactggaattggtctgtgcatagagaggaaacgcctcttgctccaacagtttcctgcaaatcagatcactgcatgcaaaatgggagaagagttagggcccttgcaacctcaagggcaatcacatgcaaccagttgcagcacatgagacttgcagggcacattccaaagacatgctccaaaaatttaactaaaaatttccaaagtgcaatcagaaggtcttcacaattctaaaggatccatttatgacaacagccacatctaaatttcctagaactacagcattgatttttttttttttgagacagaattttgctcttgttgcccaggctggagtgcaatggcgcgatcttggctcactgcaacctctgcctcccaggttcaagcaattctcctgccttagcctcctgagtagctaggattacaggcatgcgccaccacacccagctaattttgtattttaagtagagacgaggtttctccatgttggtcaggcttgtctcgaacccccgacctcaggtgatccacctgcctcggcctcccaaagtgctgggcttacaggcatgagccaccgcgcccagctgatttttttttttttttttaacacctactatgtattattctggagactgggctaatggacatgaggactcaaggcggaacccaaagagatcacagctctggctgaagatgcaaagaaatgatttggtgattacacttttctttgttatctctagctacccttcattagcatgaatgattgagagattacgatacttaaaatgctggcatacaatatacagtcagctctcaatttccagtgtgcaacgaaataactgaggctctctaaggcttaccctaagtcccagggatctgctaggcagctcagcacatccccagctcacaccccttcactgctcagcctgtgtgtctgcacagactgcagcccatcttgagattatcctaagtaaaaaggaactgattgggtaaaacagctataaagagccacagaaagcttttcaaagcaaatgtaaagaaacctaaaatagctgatgagccagaagccctcccttgaatgaataagtgagtgttagctatgtttttaaaagttactgacatgttattctagtttacatatgacatcgattttcactcctctgctcttttatggtgcaggccgttttactagtcccacaaaagtgtttccactctccatgttcttggttttatgaccgaaataacctccacgtcaagcaactttaagggatcgaaatgtctggaagagagaggtgacactgcccaatttagatccagctcaggttctgcagcaacagggtctgggtgacgacatgtttctatggaaggttgcgaaccgggcatctgcagtatttcccagatcagtttacatgtgcatttgtgaaagggtgggcaacatgttttaaaaattctacgtacacttgtttgggcatgactctctatgtcatccacaggggaggaatgctgattgcaaacttttatgttggtttgttcatgcatgtttttctcgtattcccgaacatcatccattgtcatat

SEQ ID NO: 10309 - DNA, 10198 bp, Homo sapiens; identical to SEQ ID NO: 10308

SEQ ID NO: 10310 - DNA, 659 bp, Homo sapiens
tcttgtaaagtgagctaggtttgggtagaaagtattagcatgtgggcagtaccatagcctgagatctcctaaagcatcattagaagatcccattggggacagagggtcagttttgcttggtttaatacttaccttccacatagctttcaaaatagatttagaggttgtttaaatcaatgcattcaacaacagaaaggacactttcattgctgttataggaggcaggatgtagaaggcagagcaatgatattcactggtacaattgagatttggtgcaacttgcacacagatgtaaatttgcacagaatgcatggcgtcagagagtgcaggtctatactgaacctcaagtcttggctaacagcttgaagatggctggcactacttccacccacactgatctaaaaataaaatggcacatgacatgatttttggcccaagtctgcagtttttcagtatttcaggataatgatctcttaatctagtggttctcaacgggggacaattttgtgacatttttggttgttagaactagggaaggggtgctactggcatctagtgtgcagattccagggacactatggagcatcctacaatgcacaggacccccagcccccaacaaaaaattatctggtccaaaatgtcaatagtaccaaagttga

SEQ ID NO: 10311 - DNA, 272 bp, Homo sapiens
tttttttttttttgagacggagtctcgctctgtcactggagtgcagtgatgtgacctcggctcactgcaagctccgcctcccgggttcacgccattctcctgcctcagcctcccgagtagctaggactacaggcgaccgccaccgcgcccggctaattttttgtacttttagtagagacggggtttcaccgtgttagccaggatggtctcgatctcctgacctcgtgatctgcccgcctcggcttcccaaagtgctgagattacaggtgtga

SEQ ID NO: 10312 - DNA, 264 bp, Homo sapiens
ttttttttttgagacggagtctcgctctgtcactggagtgcagtgatgtgacctcggctcactgcaagctccgcctcccgggttcacgccattctcctgcctcagcctcccgagtagctaggactacaggcgaccgccaccgcgcccggctaattttttgtacttttagtagagacggggtttcaccgtgttagccaggatggtctcgatctcctgacctcgtgatctgcccgcctcggcttcccaaagtgctgagattacagg

SEQ ID NO: 10313 - DNA, 659 bp, Homo sapiens; identical to SEQ ID NO: 10310

SEQ ID NO: 10314 - DNA, 21799 bp, Homo sapiens
tcacctgctcaggataggagactccgctggactggcttccctgcttgtgaataggaaggtgctgtgaacagtcagtatctacagaacctcactgtgtttaactctgccctccagccttccattgtggtttttaattcaacttggtttctcctccctcctttctctcctcagccattgatctgatgtacggaggcatctactgttttctgtgccaggactacatctatgacaaagacatggaaataatcgccaaggaggagcagcgaaaagcttggaaaatgcaaggtttggttccacctcagtttacctgcttgatcctgcagttccctcatgtccatcaagggcagacccagtaggagaaagagaagtacctaggtgggaagtggcaggctggtgggaagaggccgtccccaccttcccctaaggcccacagtggagtcagctgaagctctgcatgacaggggaggtggctagtgtcgaggcatgcatagctgcccgtgtgcttgggaccacttccagggtgcttcccttgcaggtcccccatgggcctgcagctgggccaagggaacaaccccagcattacttaagctctcccagggcgcacctgcagatgtggggctgaacgagtgtggcgaggtcacacctctcggggacaggtgactccgtatctggacatccctgagtggtttgccctcagctctgccgaattctagcaagcgatctctttgcagtaatgttatatgtaaacatacctccttcctcccaggagagcagactattttcggatcaagttgtggtagaatctcttttaaaactctggactgtttgggtgatgttaaatccatgtcaacagcgtgcacccaccagatggaaactagacccaccagatggaaactagacccaccagaaggaaactaggagagtctcccagcagccccactgcacagtcagatccttgccatcttgtgagctgccctcacggctctcgcaccagtgtgggttttgcacttgccgtcgccaccgtgtggccacacacactggttattggctacacagagtgagaggagcaaacatgcagtcattttctttattttttatttcttcttggcttccctgagttttttttcctttttttttttttttttttttttttggtttttgattctgacagatgctcatagtggttgacagtgatagtgacatagtgacaggtgtggtttaccccagttgacaggtgagcatctgatctccctggtagcaaagccatcactgtttgcaaaggaaacatatgaacctgacacctgttttacattcttgccttgattactctccattgaaaacaccccagtgttttgagaagggaagaatagcaacaggggctctttcagtgagcagaattatttgtgtttaacaagtcttctctggagagcaatctctgacttgtgttcgctgttcttttccctctcagaaatttaataacattgtgactaagtgtgggtgtattattctgtgcagagcacttaaagcacgggcctaagaaatgtatgtccaggattaaaatggaattcttctagaatcattttataattctgtctatccaacatgctgtgtcttttaaagtattttgaagtattcagaaatgttggttggcatggaacaagtacttctgagcgcatagggtgtgcgttgaatggaatactatgccaattagcatttaccaccactctctgaatattttgtggcacacacgtttttaactgttggatctatcttagtttggtaactcgacgctgagtttatgctatttcagtttgctgaaaagtgcaagctctctccttcaatttcacttgtttgcgggagaatccttcatgtaagttcccattggtgctgatgctgccatctctgtgctgaaggatggaagacatttgaaaaacaactgttttggcattggcgttggggtagttttgactggaggtgctgcttttcttgcaggaaacgtagctcacatcctcataccctctgtgagaagctcctttaagtgttgtgtgtagcccctctcagcacagtagagtttgagaaagccctggtgctgtggatgttgctcactgaaatgcaccctgacagacagcatagcgccacagcttttatgtgtaaacacacttgatgtgaaaatctagctaatagcgcttggaactgtccttcatctgcttaggcgttggagagaagttttcaacttgggaaccaaccaaacgggagcttgaactgctgaagcacaacccgaaaaggagaaagatcacctcgaactgcaccataggtgggtggagcgtgtcgtcactctcagctaggcttctttccagggtttaaaagtaaatacagaattgtgggtttcttaagtccacatgattctgttgaagccctgcataactgtcactcatcaatgtgctcagcaaccagctcttgagcacctgttctctgcagggacctgcagtgggcttggggcgcagagtgatgcgtagcaacagccctgccctcacagccttcagcgtctgtgtgggtaaagggactcaagttgattttggccagggtgaggctgggcacagtaatcttcagggagagaaatgatgtgtgtgagtgtaagtgttcgctgaattttctacaaattgagggaataccctttaaaactttttctttttcttttttgagacagagtcttgctctgttgcccaggctggagcacagttcactgcaccctctgtctcctgggcccaagcgatccttccacctcagcctcccaagtagctgggattgcaggtgcacaccaccatgtttggataatttttgtgttttgcgtagagacatctcaccatgttgcccaggctggtctcgaactcctgggctccagtgatcctcatgccttggcttcccagagtgctgggttacaagtatgagcccctgccctggccctagaacatttttaaaaacctgttttgtttgttcattaggcttcactctgacctggcctgttgtcgtagaaactatatttgtgtaattctgtcaaagcatacaatggctgaagtgggaggggtccatggtggtggacattcttcaataccgttcatgtaaaagtggcataaaaactagcagaatgcgatatctcatcgtgttctggcttgaatgaatgaataaaagaaaatgagtatgtagaggtagaggaagccgctgggatccagcgacacctgtggttcagcacacaggtaactcctgctctctggtgatttgtgtccaggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggaggtgagcgccattgacttctgcaggggaacatttctgttactttgttttcaccttcaaaaaaaaaatttaaggtggaccatgataaaggaagatacatttagaaccttttgtagtaagttaatgtttaatatacatgtctattatggaaaacacagttttccaaaaagggaagacctggcgtgatttttggggacgcactgctgactcagaacaaggagaagccctttgagaggcttgtggcagagacttccctggtgggtgacatttgtctctaaagacgggtgattctcccccttcctcttcctccatggtctaccttcctggctcagaaaggcacgcatgtgtcaccctcctgtgtcctcctggtatgcgagtctcctccaccgccaggtctctctaagcatgccccatcagagcctctgtcctcatgagctacgcgctgcacgttggctgttcctgtgggctgcacgtgtggcgttcctgtccacttctgtccccggcatcagagcatggcagcgttcagagcaaggcgttcacggctgccgcctcagccctcaccggctccgtgacctagacatgcttctcagagctgaagcagctcagttacctcaactaataagcaggctggtgcctgttcttcaggtgccttgcacaggagccagccaacagccctggcctgttcccattcgtaacctctgcgagagatgcagccacgccagctcactcatgtctgtctggtcactggtcgcttttgtgggacagccacagagttgagcagttggacagaggctatccaacctgcaaagctgaaattatttactgtccaagcctttcaaaaacagattgccagcctctggtcgagcctaaccgatttcctcaaagtacctgcaatgtgccataactgctggggacacggcccaaataggagaaaggagggtgcagctgggaagttggtgggtggttgtatcactgactttagtgataagctcacttgtgttagattgtttttagactccggcttgttaaggtgtaaattacagtcacacccaccttctagcctatagatagatgagtttcgacgaatgcatagttgtgtaactgctgctactcaagatgaagaactgttacctctccgaactccctcgtgcccctccgaagtcaacccccagtccccagaccctggtagctgccgatctgtcttcggtcccttgagtgtcctttaccagcgcatcatacggatggatgcatgcaggaagtagcctttctgaatctggctgtccctacttaatgtaatactgggtggattcacccgtgtcttgcgtgcatccatgatgtgtgctttcgatgtctgagttgggttccattatgtagatgggttatggtttagttgtctgtttcccagttcagacacatttgggtggtctgtggttttgggttttttgatgagaaataaaactgccctgaattctgtatttgcacaggcaagacccctctgtgggttctgacctggggaggaagccgtgggatggaaggtgtgctgctgggtctgcggctggagttgagctgttggagaggactggctggcaagccctcagctaattgccattagcctcagaggcagagaatcctgtggctgatgctggtgaattctgcataatcacagtgatgtgcttccctttgcggaggtgctggtgtccatgggcctgagtggtttggctagtgctttgaggaaactagtattgggcaaatcgagtcacttttatttgcatgtgatctcatagtagcaagtcataattcattttttaggcttatatgtggaaaactagatggtagaaaggaaaaaattcatatgaggactcgaaaagtccagtgagcccagataaaaatagactttgcaaaaagtagaaaagtaaaatccaaacatttgtgtcaaatgagccacagccaatggtaggcatctgataaaggttttgattgtgtgtactctgtgttcagagtctacatttattcctgacaaggtttccttccccgccctctggcagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgggccctgggctctgcaccctccaccagggcaggatgttttccttgaaggggaaggaagcaaagcgagtgtatgactcgtgcaaaaaggggcacaggtgacacattccattgttttgtcatcatagcccttgtcgtcatttgtttctgaagtcaccataactaatgacctcagagaggctcctcctagtttatttttaagaggcgaggaagtagttccagcagtatgacaggtcctcagtgaccgatcacagtgaacagcaaactcttggagccctcttgggcctgtgctttgaggcccctgcctgccctggcatttctgggaccctgtgggttatcaggcctgaggcttctggacatcccccaaacacaacttaatcacccaactgtctccttcccattggggactctccaaaaggactgatggttgctctgaaatagccagagagctgggacacaggacgagcaaagcttctcttggggtctcattggacctgggccatctcccccaacatagtcccacagcctggccccagggtggtaccctgatgatttttcagagttgtgtggtgttggtagttggcaggggcagctcttagcgctggaggtgggaggctgggaatgaatgacttgagccaagatcggctcctccccactcctcatggtggagatcccagtgtgagggacctgcagctgaagtctatccatacaggcagagagactgagaggtgattctcagatgagtgtgggctggtcacttgcaggtcttcctaaagcccgtgctggcgtttctgattcagcagatctgtggggggcaggggcttcttcactcttaatcagttcccagctgatgttgatgccgctggttcagatgccatactctgagaacccatgcgctcaggtcacagggcacctggctgcttgtgagtttcctgtggtctctgggctggcacagctagttgtagccgatatcctatcagttaattttaacttggagtcttttagagaacagagtcctgttctgacggttcaccgagttgaacagcttggtgggctggccttcccatcgcttctcatccgtctcaaggctgtgcacccgggccctaggcgcttacgtacaacctatgggttctgagatcacagcccagaaacaacccacagttgagctaaaatggctggttttggtcaaatgtgactttgggttctgttttcttttggtacttactttttttcctctgaaaaactacgtgatccttttaattcttacctagaaatcaaaggaaagttacttagtagcttaggtagaatttcatgtcctagtatgatttataagagaggaaagagccactgtggaagtgactatgctgttaccccaagcacctagtgagaataacgaagagccttctgtaagcagcagaaagatgttctaaaaatcacttgttcaaaaatgcattgctgttaaatgttcacatgacaaaatgtgacctctgacgtgcttctgacagaattcccttggaaatgtctgaaaagaaatgtaaggttcttctgtttagaaacctggttgccagagctgttcagcgaggtggcctggccacatggccttggttacgtgcattttgtccttgtggccttcacggcatctttctgttcatcttttgttttgttttgttttgtttttgagtcagagtctcgctctgtcgccaggctggagtgcagtggtgcgatctcagctcactgcaacctccgcctcccaggttcaagtgattcttctgcctcagcctcctgagtagctgggactacaggcgcccgccaccatgcccagctaattttttgtatttttagtagagacggggtttcaccgtgttagccaggatggtctcggtctcctaacctcgtgatccgcccgccttggcctcccaaagtgctgggattacaggcgtgagccaccgcgcctggccattctgttcatcattctttgcgccttcctgtatggatattcttgtcctctgaattttgtcccatgaatttgagatccctctgggaagcatttttctctctaatcttaaaccttctgctctcagaagacttagtggcccttctctattcctctgtcatgattcaacgtctttgaactgtgatgtatatacaggtgtcctcgtgccctgtccccactgtctagtgaagttatgtagaatatgtattccacacacgaattaagttctgctacttaagtttctttttcacagatctgcacacatggatatgaatgaagtgtgtattgaatagagagggtgggagtggcacttccagatgcaactgactggaagacacgctgtcccctgggggctctagctgatgaggacagcctgtgtcctgcggtgtcactttctgaacttggggcaccatgatacctactcagggagggaggttgctggggcttccccgggtgtacctggcccaccatatgttcagctgtctcactggaacaatattgattcagtcattctttatatgataatgggaatcgattattctgctcagtcactgggcattaggtgggttttcttggcaagactgaagctgtggggctcttgttagggaatgagaaaaaggagcattgaaaatccaagtgctgtgatttctcgtcatattaaaataacaaggacaccctctgctaaaatgaggagtgtcctcacatggccttttaaagcgttggccctggctcccccaggcttctgcagggtgaactgctcttcccttagagactccccatatttggggagacactaatcccagagccgtggtctgtctccaggtgatgacaatgggaagaaggccaacaaccccaaccactgcaactgcatcatagaccagatcttcacaggcgggttgcagtcagacgtcacctgccaagtctgccagtaagtgagaggctgcgtgctcggcaatatcaaaccctctggggccgtactgacatcctcccagtctccagagctgtgtgtgctctgagaggtctttaaggaggctatgagataaatgattaatagacgccatgagagcgaaggttgtggggtgggggtgcttcctcttggggaggtcgtagggcaggtgtcccctcgggatgcgagcccttcgtgttgaggtcttggctgttgtctacagccagcagtgtgttcttggaagcttcccctaccattttgcatcttacagtccttgaccagggaccaagtgaaagagccctcttcaagaaggcgtggatcatgcatggtggattgtttttctacgtgcttcgaagtgtgttagttttcattattttatggtttctggttccattttctgatgtagtggccctaattcttctcagatgtggtctctgcttagagcctcaagtgttgagtgcagggagaatccattgctttgttaggtcaggggaccctctcacccaacctcagtgcatgctacaggttttttgtttttgtttttgtttttttcaggcatggggtcttgtgtatgttgcccaggctggccttgaacccatgggctcaagcgatcctccctccttagcctcccaagtagctgggactacaggcatgggccaccgtgcctggctctgttctttacttcagttgaagtttaaaaaccctggacatgatccaccgaaattatttcagaacccgaaatggactgtcacttctaaactgcataagacgagcaaatatcgggaaaggccagtgctgcctgtgtcacgggggccattttctataaggagcatagaccgtttggggccttgtctctgagtattagaaaccgagtttgctctgagcaatttggacctcctcgctgtcccttaactactgaattccattagtaggagattgtctcaagatttaaatcctgtataaatatcgagagtaaatttcccagtctgcaagttttcattttttatattgttaaataaatttctagcaaggaactggccttgtgaaatgcagcattgactgtccagtgcaggccaccgggcctggcctgggcacgctctgtgaaatgtgcaggggtctccagtgttgcctagggtcacaggccccaagttctagatgcagctgagatagacctgtggattcagagcctctgacagggcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacggtgagaggcctgcacccacacggcgggggcgtgtctcctggccagaaggctgtgctccatcaggaccaaagcagggctctttcacatgcccaggacagagcctgggcaaaggtgcagcatgagcctggattggctgcagtctcttgtgctagtttgtcctttgttttggccagatgactcaatatttctgtcccccagcttcgcacagcaccaggtgtcagtgtcagcagctgctactccaacctccgcatgtaaatgaacccagagccaaactggctgctcccttagcccttgcactaatcacctaccccggagtgtgagctgagatgcgcccgggcctctccccatggtccacggccttctctgcacatgattaaaacttagttgtgatgttctgtactcttagggctgtttttgaaattgtgcatgtactgcttcatttgggataagtaataatatttacaaagtgatttttttttttttttttgagacagagttgtgctctgtcgaccaggctggaatgcagtggtgcgatttctgctcactgcagcctctgcctttcaggttcaagtgattctcctgagtagctgggactacaggtgtgcaccaccacgcctggctaatttttgtatttttagtagagcgggggttttaccatgttggccaggctagtctcgaactcgtgatatcaggtgattcacccacctcggcctcccaaagtgctcacaggcatgagccaccacacctgtgagtgatttttaaaaaaaaatgtatttaagtagctgtagcatacaattgtaaagacagcagaaaaccttcctaaaatttgtctattattttatagcctttgttttatttgcatcaattaaaggtaatgcagaagagtccttgttgagtggaagtatcccttagaagaggtacgagcctttggtttctgtctggctgcatagtcagcacgaccaaagttgcatgtttattttgttttttgagatagggtcttgctctttcatgcaggctggagtgcagtggtgccatcatagctcactgcaacctcgatctcctgggctcagcctcagtgtccagggctcagccttggtctcctgtctcggcctcctgagtagttgggactataggtgtgtgccaccatgcccagctgattttgtgatttttttttttttaattttttttttttgagacggagtctcgctctttctagagtgcaggctggagtgcagtggcgcgatcttggctcactgcaacctccacctcccaggttcacgtgattctccggcctcaacctcccgagtggctgggattacaggtgcttgctaccatatccggctaacttttgtatttttagtagagactaggtttcgccacattggccagggtagtcccaaactcctgaccttaggtgatccgcctgccttggcctcccaaagtgctgggattacaggtgtgagccagcatgcccggccaaccaaaacctttttaaagaaagtctttgcagctaaattaaatttaatcataaattccaataaaatgaaagctttgccaaaacagcaggccatgaggtagaaaccacacttcacaaactacaatgtgtgggaagcctgtgttgttaggagagacatgatgtggtgctgactcccgggaaggtggaggagaggtagagtgcacccgggtccccactttgtattgcaagcaaaggctccttttcgagtcctttggagagcagatcacaaagctagcaacgaaacaggtgcagctttgcccagaggccccctcgtcttgccctagttaagatggcagaatttccagagcataaataagggctttccatacctgcttgtgaaaagagtgaattttttgctggtgtttcagcttcaaaatttggcgtgtgctttgttgaatcatctgttctgcaggttttgtcagtggcagctgacacctgtgccagacacgcttctgatgcagccctcctacctcctgcctctgcacggtcaggaaattacctttcccagtcctcttgcctttttttttttttttttttttttttgaaatggagtcttgctcttgttgcccaggctggagtgcagtggcacaatctcggctcactgcaacctccatctcccaggttcaagcggttctcctgcctcagcctcctgagtagctgggattataggcatgcaccacctcgcccggctaattttgtatttttagtacagacggaatttctcttatgttggtcaggttggtcttgaacttccaacctcaggtgatccacctgcctcagcctcccaaagtggtgggattacaggtgtgagctgccgcacctggccgacctctcacctctctacattaaactgcttatgttgagatcattgtagattcacatgcagttgtaagaagcctttaggtaccctttaccccggtcccccgatggtgacctcctcagcactgtggtgcgacgccctggccaggattcagacattcatgcggaaagtacccagcatctccagtgcctcctccctcaccacccactctgtaaccgcagtcaccctggactcctgcatttccatacgcctgacaattccagaatgtcatgtcaactgaatgatataacggaaccctttgagattggcttttcttgcacatcctaattctctggggacgcatccagggtacagcttgggatcagtagttccttccttttttgctgctgtctcatactccatggtacagtgttccacagtttctttaattattcagccatgggaagaaacggggtgtttccagttttgtgactctcgtgagtaacattctggtgcacatttgtggacagtttgtgtgtgaacattagttttcatttctctggctcaaattcaactgctgggtcatatggtacttagaaaattattaccatttccccaggcctttcctggaaaaaaaatatttaagataaatattctgtagagacaggcagcaaaggtggacaacattttctctttttttcattgtttcatttttagttgtaagtgtatgtttttggtagggaaatcaacccaatgaaagagataaaatacctctttcctctcatttttctgtctcttgcatctcccttaccgctcctgtcttttttgaacgcctgtagattcaccagaccagagcacttgggcagcagcgccaagatcaagtgcagcggttgccatagctaccaggagtccacaaagcagctcactatgaagaaactgcccatcgtagcctgttttcatctcaaagtaagttttccagaaagccaactctaatggcagacttagtttttagtccacagtacggtcctcagccttttggtttgctgtgcagttacattttttataattgcagcaagcaggaagaacaccgaggaagggagggtgtgagggaattgtcctcccatctgtgaattgtccttttgtctgtgctgcggtaaacaaaatcagtggcttcgcagtgaaagtagaatgtgagttttcttgggagcagagtggttgtgaagtttttattacttctaccattcctccagctaccccctcctcaggttttctgttttattttaagacaaaggccctcagcatgcagatctggtccaggagttggcaagctctttctctaaaggcccagataactgaagatgtcgagctccacaggctgcgtgcgatcatacgattctctgttacatgttctttgtttcatttcaccaccctttaaacatggaaaacgcccattcctagcttgctggctggaatgggtgactcctgatctaggcaaaggactgtcttctgtctggtgaaaggaacaatttgttcatttttgctgccatgggccacggatctttgttttgttttctgtgctttgctgggtttgctgtaagattactttttgtacccttggtgttaccactgaacagtcccatcatttgaagacttgaaccctgtaaatgaggacttgggtggattgccactgtgtttttgaatctgtaattctagatgtagctacaaggcagttcaataaaatacaaaagagataacacagacacctgtcatcagaagaaggccctgaagcttccagtgacatttctgatcttctttcctcttccctctgtccccttcctatttctgcagcgatttgaacactcagccaagctgcggcggaagatcaccacgtatgtgtccttccccctggagctggacatgacccctttcatggcctccaggtatgtggggttgtaggcccgttctgtgtcctgaggggctgtgatcctatcaggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccaggaggtggaggttgcagtgagccaagatcgcgccactgcactccagcctggtgacagaacgagactacgtctaaaaaaaaaaaaaaaaatgactgtcgatactaatataaaccccaccttccccaaatctgtttatcctgatcttaagatacagcacatgttaatgagttgtttttcatcagataccctgtttttgttttgaatttctcaacaattatcaatccactttcaaaccggcaaagtcctcaaggtgggatcacagcgagaaggcaacattttagttcgtggaacagatgttgaagtacaggcagacatagttggttttgcagttgtagattgcattttccttttcaaatctgcctattctggggtacttggaattcagctgcttactaatgcatgagacacataggagtttcctgtggttctgtgacaaatgaccaaaaacctggcggcttaaaattaatttcctcacagttctagaggttggaaatctgaaatcaaggtgttggcagggctccatgtcctacaagggtcttggggattccattcctcaccgcctccagctgctggtggttccacgtgttccttctgtggctgtcactcccctggcttccgggtcacatggccagctcccctgactctgtgtccagttccctctgcttctctgtcatgaccgtggtcattggctttaggacctaggcagatcatccaggaggatctcatctcaacatctttactttgagtctctgcaaagactggttttacaaatgaggtcccagtctcaggttctgagggttgagacgtggatgttgttatttgcagggtgttattttttggtggccacagtcccagccccagcaccgtggaaagcatgttgctttttggtagttagcggcctcttcctggtgtcctctcatggctgtcccacccctgtggcacacagatgacctcctgaataaaacaagaccagagtcagagctccatatcatcagtctgaccacgatggtcacgtactgagggaggtgacagtactgttctaaggtcagggtctcaaagatcttggtgtttcctgccaaacacagctgtaggaaaatgcagtaaataatgtgcatggcttcctgttcccagcactcctctcccccatctcaccaggggaggtgctggtcatgaaataatgagcagcaatctttgtcccttttgaggaggcacctgcctaggttgtagaatggattcagcgtaccctttcaagctaaccctttacatgtgggaggaagagcaccttcaccatctgctttgtcacaaaccaaactcacattcctccagatccagctcccattaccagccctattcaggacccaccttggaagaaccaggggccacgccaggtggcctcaggacccaggtgtgctctgaggcaggggcctccacagcttgagcgtcagtgtcctcacgaaacatggggagatttctgcctgaagcataaagtgcacctcggtgcagcatctgcatggtcaagcttggataagtgttggtttcacgagagccttgtgtctctgggcctgatgattttaatgatgctgaatcctgccgttgtctgttacagcaaagagagcaggatgaatggacagtaccagcagcccacggacagtctcaacaatgacaacaagtaagtggtgcttagcggtgtgggtgtccagggcctctggccaagagctgggggtgggctcctgtctgccttgtagggcgcccagggatcccccgccactgacctgcttcccgcttggctgcccgcagctccactattggtgcccgcagctccactaggaaaggccgctccacgtggtgccacaaatgctccctcctgttggaggagcccagccccactcttgcctctggcaggagggaggttccatctggaaagctcggtgttcattcttcttgccttggggttgtagaaagtatgaaaggctggggtgttccaggatccccactgctgactgcagtcaccactcccactagatggagttccaggaagcgcctggacccggctagagccaaggggggtgaccaggctcccttagttcctgcagcctcctgtgcatcagcctgaggccctgggggttgacagcccacaggcctcccgctccctgcctgggctgcctggtttctgatggtgatgacctcaagtgacggcatcaagtcacctgcgccctccctctcctttgctcctgcactaggtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtgcgtcctgtggggtgggaggaaggccctacggtggctacggtgcttcccctccggtatagctgagactagcccatgtctgagcctagaaccactcgaaggtgttgaccttcatttgccgaagtaatgaagcctgttctggataggatgccagcctcgatgggtgctcaggtgggagaagaggtgcctgagcaaaggccctctctggaggcattcccttagcacagagaacgtcagagcagttgttttttaactgcgtgaactgaacacatcagttctttttttttttttttttttttttgagacggagtttcgctcttgttgcccaggctggagtgcaatggcatgatctcagctcactgcaccctctgcctcccaggttcaagtcagtctcctgcctcagcctcccaagtagctgggattataggcatgcaccatcacgcctgcctacttttgtattttagtagagatggggtttcaccatgttgaccaggctggtttcaaactcctgacttcaggcaatcctcctgccttggcctcccaaagtgttagaattacaggcatgagccaccgggcccggcccacatcagttctttatcagctcctctcctttccagtttcattccttcatggcatagagaaacctgttgaccctccaggggtcagggggaccccagctgccatgaactccctgagggctttgcacttcacattctgagcaacacggaagccaagccctcttgagaggttttatttggaagaatctgggataaaggacagccttcagggcgatgaggtggatctggacggagccacttgaaaacagtgggctctgcacaagggtggggctgtcacaagtgggggagaggctgtgggaggttgggtgaggcaatgggtgacctcgtggcaggtgggggtggtggtcgggctgcagagatgggcagggccagtgccaccagccagtgaagcactctttcctccttgcggactaaaaagccaaaaccatcaactcgggcctggccgacctgtgcagagcgcagagcacgtaggcttttgtgtagggtgggttgttctggctcctgtcttaggagttagaggtgagcctcctccctctctctgcctccacaggtacttgctgttctatcacaaacagttcctggaatacgagtagccttatctgcagctggtcagaaaaacaaaggcaatgcattggcaagcctcacaaagtgatcctccctggcccccccctcccccaagtctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaa

SEQ ID NO: 10315 - DNA, 232 bp, Homo sapiens
tttttttttttttttgagacggagtctcgctctgttgcccaggctggagtgcagtggtgagatctcagctcatagcaagctccgcctcccaggttcacgccattctcctgcctcagcctcctgagtagctgggactataggtgcctgccaccatgcctggctaattttttgtacttttagtagagacggggtttcaccatgttagccaggatggtctcaatctcctgacctc

SEQ ID NO: 10316 - DNA, 371 bp, Homo sapiens
ggctggtctcgaactcctgacctcaagtgatccacctgcctcggcctcccaaaatgctgggattacaggcatgagccactgcgtctggtccttggctgtttcttagccccactcctggcagtgtctcttctcttcagctatgactggggagtagatgaccgtgcttgtttctgacacacagcacagtgtcctctctgtacacaagctggtggttcaagggccaatggttccagagagatagtggttcccttccttccctcctcaccaataggcagcctcaggccttttctgtgtataactgtgtatatagacataaaaacctacaaatgtgaaataaatctatgctatctttcatagtgttaccacacaaa

SEQ ID NO: 10317 - DNA, 145 bp, Homo sapiens
ctttttttttctttttttgagatggagtcttgctctgtcgcccaggctggagtgcagtggtgtgatcttggctcactgcaacctctgcctcctgggttcaagcaattctcctgcctcagcctcctgagtagctgggattacaggc

SEQ ID NO: 10318 - DNA, 415 bp, Homo sapiens
aaaaaagccccagatgggctggatttttttttttttctgatattttcttcctcaaagtccagttgctctccaagttcctacccctcccctgcccttgcctcagacctttaagaccaaagactgcaaaaccacagtgctgtacctgccacctccaaggactggcgtcgaggcccaacccaggaatgttggcttatttacctcctgggggaagcagtttaggcctcatcagagctggggagcacatcccttcagagcccatgggtttcccattccctcctgtcagccctggccatgaaatcctggggatctggagggagggaggatagttagagagtgagaggggcgagggctagccttttcctaatacccctgggtttgagtttaatttgcaataaaatggaatcccagcacatca

SEQ ID NO: 10319 - DNA, 364 bp, Homo sapiens; identical to SEQ ID NO: 7112

SEQ ID NO: 10320 - DNA, 364 bp, Homo sapiens; identical to SEQ ID NO: 7112

SEQ ID NO: 10321 - DNA, 288 bp, Homo sapiens; identical to SEQ ID NO: 7116

SEQ ID NO: 10322 - DNA, 288 bp, Homo sapiens; identical to SEQ ID NO: 7116

SEQ ID NO: 10323 - DNA, 2350 bp, Homo sapiens
cggccgccatggcgaccccggccaggcccggcgaggccgaggacgcggccgagcggcccctccaggatgagccggcggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttatccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 10324 - DNA, 2350 bp, Homo sapiens; identical to SEQ ID NO: 10323

SEQ ID NO: 10325 - DNA, 823 bp, Homo sapiens
ggaagattccatgtaataaagtctgaagtgtgcttaacacagtactgggaacttaagcagcactcacacttcatcctaaatacgacgaaagtcttttcaaaaaaataaaaattaatgcaatatgacttacttggaaatgtatcaaaaaataaagaccgatgaatggatcgaggcgtagtgtgacagagtaaaattttaatgataaaaagttaatggtaaaatgttcactgtaaaactttcaacttttcttcttgaaaacgtgcataatccgacgtgggaaaaaaaataacgcattgcagtcagttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaaga

SEQ ID NO: 10326 - DNA, 823 bp, Homo sapiens; identical to SEQ ID NO: 10325

SEQ ID NO: 10327 - DNA, 1169 bp, Homo sapiens
gattgttatattctcttgctcagttgacctctttattattatatagtgaccttatttttctcttcttacagtttttgtcttgaaatctattttgactgatacaagtgtagctactccagctcttttttgcttttgtcgccatggaatatctttttttcatctgcttattttcagcctatgtgtgtctttataagtgaaatgtgtttcttgtagacaacagataattgggtcttgtttttttatccattcagagccactctgtgtcttttgatttgagagtttagtgcgtttccattgttattaagaagtaaggatatgttctgccattgtattgtttgtcttttgcttgttttgtggtcttctcttcctttcttcattccttcatttcttttattgaaggtgattttgtcttgtggtatgatttaatttcttcctttttattttttaggtatatgttatatggtttttgatttgaggttatgatgagtcttgcaaatattatcttacaacctattattttaagctgataaccacttaacattgcataggcaaaaacacacagaggcaaaaagaaaaccaataaaagctctacactttagcctcttgctttttaactttttgttgtctctgtttatatctcattataatttctatgtcttgaaaagttgtcattattagttttggttggttcatcttttagtctttctccttaagatcagagtattttatatatcacatttacagtgttataatatgctgcatttttttgtgtacttactattaccagtgagttttggaccttcagttgatttcttattactcatcaacttccttttctttctgattgaaaaactcccaggctggacacggtggcccatgcctgtaatcccagcactctgggaggctgaggtgggctgatcccttgaggtcaggagttcgagaccatcctggaaaatgtggcaaagctccatctgtactaaaaatataaaaaattagttgggtgttgtggcgagcacctgtaatcccagctacctgtgaggctgaggcaggagatcgcttgaacccgggagacgaaggttgcagtgagccgagatcgcaccgctgtactccagcctgggtgacagagcgagacgccatctcaagaaaaaaaaaaaaaagaaacagaaaaa

SEQ ID NO: 10328 - DNA, 1169 bp, Homo sapiens
gattgttatattctcttgctcagttgacctctttattattatatagtgaccttatttttctcttcttacagtttttgtcttgaaatctattttgactgatacaagtgtagctactccagctcttttttgcttttgtcgccatggaatatctttttttcatctgcttattttcagcctatgtgtgtctttataagtgaaatgtgtttcttgtagacaacagataattgggtcttgtttttttatccattcagagccactctgtgtcttttgatttgagagtttagtgcgtttccattgttattaagaagtaaggatatgttctgccattgtattgtttgtcttttgcttgttttgtggtcttctcttcctttcttcattccttcatttcttttattgaaggtgattttgtcttgtggtatgatttaatttcttcctttttattttttaggtatatgttatatggtttttgatttgaggttatgatgagtcttgcaaatattatcttacaacctattattttaagctgacaaccacttaacattgcataggcaaaaacacacagaggcaaaaagaaaaccaataaaagctctacactttagcctcttgctttttaactttttgttgtctctgtttatatctcattataatttctatgtcttgaaaagttgtcattattagttttggttggttcatcttttagtctttctccttaagatcagagtattttatatatcacatttacagtgttataatatgctgcatttttttgtgtacttactattaccagtgagttttggaccttcagttgatttcttattactcatcaacttccttttctttctgattgaaaaactcccaggctggacacggtggcccatgcctgtaatcccagcactctgggaggctgaggtgggctgatcccttgaggtcaggagttcgagaccatcctggaaaatgtggcaaagctccatctgtactaaaaatataaaaaattagttgggtgttgtggcgagcacctgtaatcccagctacctgtgaggctgaggcaggagatcgcttgaacccgggagacgaaggttgcagtgagccgagatcgcaccgctgtactccagcctgggtgacagagcgagacgccatctcaagaaaaaaaaaaaaaagaaacagaaaaa

SEQ ID NO: 10329 - DNA, 702 bp, Homo sapiens
tttttttttgaatttttaaaattattattatactttaagttttagggtacatgtgcacaatgtgaggtttgttacatatgtatacatgtgccatgttggtgtgctgcacccattaacctgtcatttagcattaggtatatcacctaatgctatccctcccccgtccccccaccccacaacagtccctggagtgtgatgttccccttcctgtgtccatgtgttctcattgttcaattcccacctgtgagtgagaacatgtggtgtttggttttctgttcttgcaatactttgctgagaatgatggtttccagcttcatccatgtccctgcaaagggcatgaactcatcattttttatggctgcatagtattccatggtgtatatgtgccacattttcttaatccagtctaccattgttggacatttgggttgattccaagtctttgctattgtgaatagtgctgcaataaacatacgtgtgcatgtgtctttatagcagcatgatttataatcctttgggtatatatccagtaatgggatggctgggtcaaatggtatttgtagttctagatccctgaggaatcgccacaccaacttccacagtggttgaactagtttacagtcccaccaacagtgtaaaagtgttcctatttctccacatcctctccagcacctgttgtttcgtgacttttaatgttttctt

SEQ ID NO: 10330 - DNA, 702 bp, Homo sapiens; identical to SEQ ID NO: 10329

SEQ ID NO: 10331 - DNA, 361 bp, Homo sapiens
gtgaacacagagaaatgaatttattccccatatgggtatgtttgccccctggcaatgcatttccatactctttaacttggggactgaaatgttataaattgacagttctactcagaagacctttcaagcatcttgtgtttatgagaatacaggggcatctgcggaatgaattcgaacacatggatgaattaaatttgaaaacacacagaccgagaggcagacagttcctaggctgtggtcgttgcatggattttacaaaactgttaacctacacctttggctttgctgtgttcattgtcctgggaagaattgtgggtttaagaattactctttgattaaactacttaaaaaaaaaaaaaaa

SEQ ID NO: 10332 - DNA, 4203 bp, Homo sapiens
cgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaaccggtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgttagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaagtggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacactacactg

SEQ ID NO: 10333 - DNA, 505 bp, Homo sapiens
cattcctaagaaagtgaataccattgttctcagggtcttaattgggttttatgagtgtgaccatcctttctgggacatagtactgctttgccagctacacccttcctaatgaggggaagtgggtggcacagaggggacccaggtatcccaaccgaggcaatagctgtctgcctccatttggtctgatagaaaatcagggatataagccaggtgtggtggctcatgcctgtaatcccagctcccagcactttgggaggctgagggaggggtggatcacctgaggtcaggagttcgagaccagcctgaccaacatggtgaaaccctgtctctactagaaatacaaaaaaattagctaggcatggtggcacacacctgtaatcccagctatttgggaggctgaggcaggagaatcgcttgaacctggaggtggaggttgcagtgagccaagatcgcgccactgcagtccagcctgggcgacagacagcaagactctgtctcaaaaaaa

SEQ ID NO: 10334 - DNA, 8048 bp, Homo sapiens
atttcagcctggagtcagtcaaaaaatcttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaagcctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgtgagttttgctgttgccattggagggggagtggggggagtgtggggagtgctagggtcaggtcctggctggtgtaaagaacactgaattaaaggaattgtcagaataactcaaaggcatttagataatcaacagtccatttcagtgtttttattcagagatcgatcgatcagtgggatgttgtccaacaaaagcaaaaatagactgtatagagaaggaaggaaaaactgcataatttaggaacagtatatcttgtttgcacattctttggttaaatcaattagcctgctgttaggaaggaagtctgggcattttatccttgagtaaaccaactagggatatcagagaaaacagtttccaatgcttttggattctccagaaaacagacagtttagcatatatgacaggctgcttctgcgtattgtctacctttcatttcattaacaacttcactttagaagcctggtctgcaccatttccctcatcacaatactttagcatcctggcactagctgtgcaggatttgtcgtacgtcttcctttccctgatgatcatgtttctcatttccttccctctctcccttacaccctcaaaagagagagacataatatacattctcaaggtcatataagctatataatgaaagctacctttttctccccagtgatgttatttcctcagtggctcacaccatctgtagtcatagttcccaaatttggccatgcggtctatccctgaactccagcctcaatctattcaattagtcgccctgaggatggggcccaggtctctgaatttttaaagacttgtatagataagtcacatttagccagtctgggaaccagtgttgggaaattgaatagaatttcatcctactatttcctttatatgcccatcctttctcgtgatgtattattttgccacagtcctgtgacacaggaagggccagtggccttggtcatcttagatttgcccttgttgatcttctcagggtaaatgtctttcctttcccctgatggtgttcttatactgtcttctgatcatcatttctgactttgttttcagcatctaaaagtttccataactataaggcttacttcttccctgcagtcttccgtgtttttagttattcatttatgggcactctccttggaaagtcagtgatcaaaatagcactagtgtgtaggatgagcactggaagagctcaagcagagaagacataggagtttctgcagggctgtcctggggtggttcttgatgaggccagttggggaaaaagctaggtggcagatgttggcacactataagaaaaagcatcttgtgaaaacctttaagttagatggacttcatcaagagatgatgaacctcccacctccaggaatgttcaggcaaatgccagatgcatgcattggaatcgttggaccagatgacatgtgaggccttggtcaactctagacttgtttatataggcttggaaagattttaaagttttctcctcagtaggtcacttaggtgggccaggtttgacacttcactgagctcctcttaggagcatcataatttggttttgttcccttctccaggtacttttgggagggaaaaatagaagccactaacatcctgttagtgaggatgtgagtgtagggagtctttttttttttcttttttttttgagacggagtctcactctgttgtccaggctggaatgcagcggcatgatctcagctcactacagcctctgtgtcccgggttaaagcgattctcctgtttcagcctcccaagtagttgggattacaggtgcccgccaccatgcccggcttattattttttttgtctttattttttggtagagacagagttttgctatgttggccaggctggtcttcaactcctggactcaagtgatccacctgcctcgccctcctacagtgctgggatataggcatgagccaccacacccagcctgttgtttgttttttcttttcttttcttttttttttttttaaccattagtgcaaatgtcaacatagtaaaaggataaataataaaataatattgttatgaaagtagttttgaccccatggaccccctagagtcctggagatccccatgggtcagtggaccttcactttgagaacctctagtataaacctttatcattcagaagtggaatttttggaattggcatcacctgggagctttcaagaactgtagaatctcctgctcaccccagacctaccgaatcaaattatagtttaacaagacccccaggggatttctgtgcacattaaatcttgagaagcactggtctaaaccagtgtttctcaccgctggctgctatgtattagcatcacttggaaacatttttcaaactaccaatttaggccccacctcacagatttcgacttaatttggccagggcggggatcaagtatagtggtactaaaaagcacctttctttttagatgactctaacgtggtcacctgaaccttctgaggttgactctaacgtagggccagagatgcaaaccacctatatggatgatgaaaccttttctttactccttagggaactaagattctgtgaatacaccgttcccctgggtctcaaactagctctagaggaggccctcatgataccacctcagcagaggtgagagagtaaggaaccattggtagagccagtactgtggagaaattaaaatttaactggtgagggacagcttcagggttaagagagttggacctcctaccttgaaacctggctccccacctgccactgttccatagtgcttggaaaatatgaatattttatgtgcctcagttgccccttctgtaaaattgggattatactaatgggttgttatgcatatggaaattaatatgtgaaacctgtacatgaaatgctttatcagtctcagctcttattcctaatgtgttaaaaatgtctttgaattctgtatgtctgcttataaaaacacataagttaacaaaattcattatcctcaggcacccaacgtacagaatatttaagcatacatttgaagcaacatgtgaatgtatacatatgctgtgatttattaagcatgttacgggaactttaaaacacctcattcagcagaaaggaggcagaggattataatcctcatttgacagatgggacactgaggcccaagtcctcatgttccttcagtctagaaagtgaagagaacttgcactgtgtgacaagggccaggcgaaagacacaggagaggaagatagattcctgtagaccttgtttgtcagggaagatcccttgggaaaggtcagtggttgaattggaccttgagggacagagaagtttttttttttttaagcaagaataggcttttgattgatcagcaggagcaggtggaatctaggtgggcaaaagaatacagagatactgggggaggggggattgttttgggaagtgatgtgtataggataataataaaaagagtagctcacatgtaatgaatgcatacagtgccagctggtatactgggtaagtgctttgtataccttgtgttaattaatcctcagcagtccagtcatgtagggccttttttttttttttaaaaataggagcatttaaagaaaactaagtgacttgtccatagtcagacagctagtaggggcaaagttagaatttgaacccatgtctgtgagactctaaagctatctggcctaactggccacttattgacagatgggaaacataggctagggagtgacaggccgtgggcctggacaggtggggtgcggcaggttgcagagggcctcccttgaggctggccagttgggttttatcacgagttgattctaatcatagtcacttatagggctttgctttctctccaaaggctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataagttaacagtctggacacgattgattctatattctgtttaccttgctctaggctattcaaatgttatatttatttgaacactatccaatatatgttccctggcatcttcctgtcttttaaatattctctgtacgctacagttctttgtaagtaaaaataagcttaatatgtctacttagcaaacaaagtttttccagata

SEQ ID NO: 10335 - DNA, 532 bp, Homo sapiens
ttggaactttccaaaggaacgatgatggtggcggtaatgtcacattagtatggagcccttaaattcagcagtgttcaacctgagggaagacagagtaggtcaattctcttggcagcagctgagggaaggagagagcagggagcagggctcagataaggtttgtttggcagggtccaagcacttcatggaatggagacctttggctgtcagagatctgaggaagatttgtcagggcctgctacactctgagggcttgcagtttggatggttgggaacacttcttccttgcactgatggtgctcctatttctatgacacgtgtactagttcagacacaatttattgtgttcaccaattctatgcacagcaatcagactgagattgaaatccagtataatattaaaggtgatctgggccaggcgcagtggctcatacttgtaatcccagcactttgggacgctgagttagggggatcacttgaggccaggagtttgggaccagcctgggccagaaaatgagaccccatctgtaaa

SEQ ID NO: 10336 - DNA, 2620 bp, Homo sapiens
tgattgttcaaagggaggttttaaatcataaatcagacacattaattataactttaacaaatgttattaaaagcagcaattaaaaaccatgaatctttttgaaggtgcagagggttataaggtcagttggcagtaatgcagctattatctggtatgaatgaaatgctggggtggggagtcagggtgacctcattaggccttgtgctatcttcccaggtggtgcagacaccccctccctccttttccctctccaggcccacagcctccccagagcccaggtagggaaggtccagatgtactataacaggattgctcatcccaggctatctcagaagtctggaaagcaggcctagaaggttgctgggctctctgaagccaggcaggaagctacaaattggatcccagttcccacagcacccctgggctaggggttggcttctcagctccccttccacctggccctagttggcccctgtggcagcagctgtggggctgaaaagggggaagaactgggtccaacgccagctcgtctatgcctgggctgtgccagggaagcagaggaaagtgggtgggctgtgcacaggaggtgaggtcccccttaaaaggcactgtgggagctgaggtctaagatgggggggcatctaaactatctcagggaccccctgaacgctcacaggtagagaggggtcaggcctagcaatggaaaaacagctcctgcaggcctgctgccccgccagtgcctcttgctgtactaccaccttcgccttcctgctggcggcctgcaaaaccagccaagctggaggccacagcagcagttggcaaggctggtccccatctggtgcccaccctccacgtcaaggcacttttgtccattttccaatcaagtgagtcagtttctaatatctctggaagcagcaaaacatcaggggtcctcttccccctcccaattttggtttccctccagatgaggcagaatttgaatgttggttccaaaaattctctttcaaacccccactggcaagggcttccctttgagggaaccaaatgatgcaggctctttaaaaatttcaacctatcccaaaaagtgattgtccatttcagggcagggcaagggatatgaaagagggtgagtcccctgtgcttccctatgggaccaatgctggttgatgggctgaaagaaggagcggccactgagctttcacatttagttgcagcacctgggccctggaagtgggccaagggaaagccaagggaggagccagcaggcccagagggacggtgtggctctgtgtgtgtacacttgggcatgtggtggtgtggccgtgtggggttgtctgcatgcctagagctgaaagtacaacacatgtggatggaagcttgtgcgagtgggtgtgtattgtctgctgtgtggtgtctggtgggtctggggatgggaggcaccagaaacaggtttagcaagacatggttttccctcccaccactaccaccccccacccccgtcccccaggtttggaaggatgcctccattccagcaaggccaggcccagctctatggcgactgagggggtgaggccagagaacagaagacttctgggacctccaaagctgacattggcagccttcactctcagccttaatacctgggccctggtgctggtgccttctgaggcagacccagccctttactcttcagatcctcacaggctttcacaggggctctctcccatcccaccacctctctccgagggtagtggggagtggcaggaaagtggaagagaaaagcactgagcagcatcctcttatccaccttctcccatgctctctcaaaggtgcctgttatgtagtccctgggaggactggctgccccacgggtcacgtgtgaaggggatccagtggagggacagctgtgcacacacaggatgtgcgaacacacccagaaaggggcgagagaggtcaaggcacacaactggggacaaagacctgggcctcaggaggaagggtcccagcgcaggggacacaaggtcagagaacagataaacagagtttgagggggtgtggagtgtgtagagacacaggcacaggggtaacgagcctgaggaggccctggaacagagctggtacagcagagagacgcaggccttggcctggcaggcaggcaggcagggcattctgccaggcacttgcagctctgtcctgcttccttctcccaccccagcctggagaaagctggggagcctatggcttctgctgctcctcctttggttttcaggacccctggcacccccgggggctagtcagtaaggggtggtcccttcccactccaccaggtactgaaccttgccctcaggtgtgaccctccgagccaacacctggtacttctccccacaggccaaccgcccagctgcaccaaagtagttggtgatagatgacttgaggtgggacagggatgagtcatcttcactgatgctctcaaatgtgtggctgtcaatgccttcgtctggccgctcggggactgaagccccctctgcactgctgtccgaggggcagcgtccatccagctcagctgcccaccgctttgcccgcaggggcatgtatgccttggctgccagcttcctctttc

SEQ ID NO: 10337 - DNA, 1528 bp, Homo sapiens
gaactggggtaagtttcccttgttcctcaagtaagacaggatatactttgcaataatctaaaaaatctagatgtgacctggacaaagagagagagacaaagtataaaatgctttcttagggataactcatactcttggtgacaagaaatgttaatggtgtcctgaaaccttttggtcagtgattgctccattatgtgggaaaaacataggaaaataaacataggaaaaacaaaggaaaataaaagactcatagtacttcaataaaagttgtcaccaaatcccaagaaaatgattgcattggaaggaatattctttttgttttaattgatagtattttaggaagtagctaacacttgttcttatttcctagcttaaaaagtgaatatatgcacacacatatataactagaaagtgatatattaacattttctattaacaagttttttatctcataaaagatattctttggctttcgaagagagaagccaaaataaatatcacataggcatttcagatatcccttcctttaaatgtttatagtgatacataaaatagaaattgcaaatatttgatattttaatattatttttgctttacaatagcatttttagtgctccattttaatttattttatctctccaggttaataatctatcataatgtccaaattacacagtattgtattggtcagctttaagtgcccagatcaatgacactgaacctggcaaatgcaatgcacatgcacaacgcctagcttctaacatcatggctgttgaaactgtctcctctccaaagcattttcccagccccatctctgccatttgggtctcatctgataaggtttaaccatgagttgttatactccatgcatggcctctgcatttgtgtgtattgtgattcttacgtcaaatggtaaagaataacattagattattcgcttttattttgacagagttcaaatagcaaaataaattagatatactgtcacagcttaagaaatttaaaatgaaatatgttgtagtcaggtggaagtttctgccggggaaatattaacacctaatttcccagaatacttatttcatgcattgcaaatatctatctcctgtcatgacactgagatgaaaaggatcggttaaaagtttgctaactgaactatttcccacagtgtaaataactaagtgttggtatagactagtatggaaacatactaattacactgggtgtaagctatgtgagttgccttatcttttcacataacatttatatgtattgcatttcccatatcgtttccttttgttttgctgataacaactaatgaggaaaagaaaggaagcattaaaaaaaaagaaaaaaaaagtcttccaacaaaactgctagagagagaaagccaactattataaaatataagcacaattctattgaaatatcagctccagattcaagtaattttgggcatgtgtattatgtgccaggagatttcacttacatatgttatggaacgcagtgatttaaaaaacaaaacaaaaaa

SEQ ID NO: 10338 - DNA, 1528 bp, Homo sapiens; identical to SEQ ID NO: 10337

SEQ ID NO: 10339 - DNA, 9974 bp, Homo sapiens
  misc_feature (235)..(235): n equals a,t,g, or c
  misc_feature (265)..(265): n equals a,t,g, or c
  misc_feature (275)..(275): n equals a,t,g, or c
  misc_feature (325)..(325): n equals a,t,g, or c
cgctggaggctgcagtgagctacgatcgctctagcctgggcgacaggatgagaccttgtctcaaatagagatagacagacagacagacttcagaatttattagggtttgtaatttccaggttccaaagcacagcaagggaaagggcctggctgggtagtacgttacacccggaagtaaagagacgcctacaccgttgggtgcacttatgagtctggctggcaaacaagcgacacngacgcgcagagttaagtgctgggacttccnaagcctgganagcagactgtgtctctgcaactacgcggctgccacgagcgctgagcggcngggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagaggtgggctcgagggaaagatctgggtcccaccactacttcctggagacgccggggaaagcaggccatccttcgagccacccatctcttctccgattggttaactgccttcttattgcgctccgctggctggtgattggttgggatgcaccgtctatcacctgcttccttgtgagaatctaggtctctaagggaagcgttacttgaggctcggttgggaagaggttggttgggcctcttgagcccactttatttatcgtagtggggatcgtcccccggcgcgagcttccgtcgcaacggccgggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaaggtaggggccttgcgggaggttttcgtgacctaattgtatggggatctaattttctagatgtgtctaacaaaatccactggagaatttgctttggctttgcagcagagtggggagactaccacccgttcctggcctttaaagaaacagtttattgaattattcaactctcttttattgcttcagatgggcagctctcaaaaaaggcacaaacaattgaaggatggataccatggcatatgttaaaagcgtgttgaaaggaaaataaggtattcgctttgttttcattgtgattaactgtataagaaaattacctttaaggagaagctcaagttttaaataatattagggtaacttgattttatgataggcttcaacttgtaaaattatttattacaaaaatcctattattgctgtacctacgaaatatgctctttgctaattatggtcttaatctgaagatagagatcttgagtttttagtagtgttaattcatatttgagtggataatgttactaggtcatttgttcaaaatgacataataaaataaccacagtgaaaaaaatccttgaatttgtaatttagtgttacaggtgaaattgaatagttgcttactccaacagtattttagacttgtaggctaatttcaccttatatttaaagcagcttgcttattaaatacctagtgtatttcgagaggcagagttgcacagttgcttcactggtagcctagccatttgagcctccagcctctactgagtcaggtgctgtattactcataccctttagtgacatgccagaaattgtcgaggaatagtttatttcatctgcagaacacccaaattagctcttaacagcagacctggtcctaccctggaaaactctaatcaaggattggggatgagatttgggcatctagatttttaaaaatacccttaagtgagtttgagaaccattgctttagtgtgacttactgaatagatgtatttaagaaattctaaaatatttgtgaaacaaacatctttctctcttgatttccatgtaatttaaaagtgagcttctcaggagtgacacttaaatataatccaaaaatagtggtttcttaggcaaagtcaggaagtttcactggcattctgaaactcctgggactaaccattccaggcttaaggatgaggcttgatatggggtgatacaaagtgctctgatgcactttcacaatccttgagccatacatgatgtcttgtttcctgttgggtttcaaagtcttcctggtaagctttaataagagaccaccttccagtttgttcagtagatattaattaggctaaatgattttcacctcatcaaagtgcagtgggggataatattacattcatgagccttattttggaaagaataccttgctgaaaacaaatgtaaattatatcatcccagtatccctttgctcattaagtgaagaatgtgcataattcaagcctaaaatttgtaattaatgtgaagtacccagatcctgaaacataaatgaggacttctggatcaacttttccagatcgtcaacatggtcaaaaatgagataatcactatggtattcaggcatgagcattgtgtggtaaacccaaatccagtctgacttaatggctttaggcaaagaagtaagtgccaattgtgttgtatttcctagaagctgtttttcattttatatgtaagcttctcactgcaagatttggcaaatacagtatttgggtaggggacaacatttaaaaattaagaaaaactgcaagttaaaaatacaaagccaaatgtggtccatgacttaacaccttgaatgttgtttatattgtttgaacagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggtaagagatgggtaaaagaggaaacacccttttttcatcatttagatggaaggatttcaagataaggagaattggtattctttttccttgcttctctttatgaaaatatagtatattgtttttgtgagtttaagaactttttagtataataaagtagaaaatcactggcttctgtattttataaggtgaaaataggggacatggagcactattatacaaatgccaaactaagaaacaggttaatgtacataatggtgttaagtatttacatatatggtcctatttgtaatttttatacaaataaaatatgacttaaaacccaatttgaactcatttggggtattataatttatttattcagctgaattaatagctccccccaaagcccaatgtgttccataaagtttttacaaatgaactaatggaaatttgtatgtttatatattgtgtgtttgtatattgatgacccatataatgaagtatttgggataaaattcaagtaaatatttgaagttttctctataaatgctcccttaatttctttttaactgacaaaaatccacagttatagcttatagattcctaagtgtatcaactggcagcactttaccaactattcaaattaaatcttattttaataatttttaataaaagattaataaatgaagcacaaccgaattgatgcacatttgtaccagttgaatatttttaactgtcttcaatttacagaacatatgaaagtaataagacatttgtcttctataggttactaaagattagtcttacccttcatgaggtctcataaaacttaattcagaattcttaaatgagcagtttttcattgttttaggagaaataacatcagaagaactgcaacagcggttagatggcgtcaaggaacaactagcatctcagcctgacttgagagatggaacgaattacagaggtactatggagtcctttccataaggaacaggcttgattggagcacttgcagaaatgaaattcttagaccttgtatagtatgtttgtcttcaattttttccagttttaatgtgatactcattcagataatatatatatgagtagtaaagcagtatggttaagcagtataggacagaggaatgaatgcaaagatgtcttaaacacacagattgccttcagagagctttatgtaataatatacaattaagttaattcccagcatgcttctttttaatcttggaatgtacacattactttttctaaagtgatattacttagcttctaaaaatttatatacagaaccgtgtagaaagactgagttaggaaacctgtttttgtttctttgttctgtttgatggtttacatataaaaagttcttataaggaaagtactgtaaaagaacttcaaactaaatgaagtatgtagagttaaaaggaaaagccacttttgtgttcctcttaaccagttctacttccctcctcagaggtatttattagtagtttcacatattatatcaaaatcattgtattagttaccatgaagtctatgtaaaaaccccaaaatgcaatggctcaataagctagaagtttcttacttacgttaacagtccagggaaggaaatcctcttggaacccactcagctaacagaatgattctacaactgtgctgttcagtacagtagctgctagccacatgtgactatttaaatggaaattaattaaaatcaaattaaatttaaaatttagctcattcatactagccacattcaggtgcttaatagtcacatttggctagtggcttctgtattggacagcacaaatacagaacatactcattacttcagaaagatttatggggcatcactgctccagggtaccatttgtatgatcaaggtaagtcgcaaccatatctaggttctagctggtaggaaggaggtccacgcactagcgtgagagtaggatgtatcgcttactctcccattccattcatgagaacttagtctcatggtcacacctaactgccaggctgtccacgagccaatttccgatgcttttacaatggaagaagagtagggtagctttgagtaggtacttggcaaactctttcacatgcaccatcatcactacacttaatcaaatgttaatcaaagaaggaagtagcatttaaaataattcatgttcacctgccttttactcattctttttccaaacaaatgggaagtggacattaacacattttattatttgtgtttagatatgtaagttgtactatatagatgcaataattaatactgatcttttgaatatgtttcagtggaaaatgtactcatcaaatataaaatagctcatcatctctggaatatggctcagttgctgtttattttattggcatcaacagctgattaatagcttcaacttcagcatttaaaaaagtcttacgagagagattgcaggaatgaaatgaaatcagaatgatgtcatataatagctattttatttatttgtttatttattttttgagacagagtcctgttctgtcacccaggctgtagtacagtggcacaatcttggctcactgcaacctctgcctcccgggttcaagcaattctcctgcctcagcctcctgagtagctgggattacaggcgcacgccaccatgcctggctaatttctttgtatttttaggagagacaggtttttaccatgtcagtcaggctggtctcgaactcctgacttcatgatctgcctgccttggcctcccaaagtgctgggattacaggtgtgagccaccgcgcccggcctataatagctatttttgagtagaacaaactttaaagttgaagtttgtgtagttaatgtgttgatgctttttattaagttttgtactttatataatatctactggttataaatggaaaatttaagcttggcacagtggcagtatcttagtcaaaaaagtttatgggtgacacatttctaaattgattaattgagcaatattaattgaaagtctgatttatactagatactgctgtagaggctggagatgtaacagtgactaaaactacaaaaatctttgttttcctggagcttacgttctaaatgaatagaaaatgtattttattatgtataacagctaacatttatggggtggctttttatgtgccagatattatgctaattatgttatatatagcgtcttattttatcctcaggataaccctatgagattgattctattattaactccagtttatagacaaggatcagccatagagaccttaagtaacttgcctggtttctcagcttcacacaaagacaaatacagtaatgtggttttaatgttatattcagaaactcacatttcttgatgtgtacatttttggcagcacctgagaaataggaaaaatttctaagattacagaaatacctagttgcaaaaatgactgagttggcttttccagaaagattccacaaatacaggacaaattttacataaagtttgtctttgtattttattgatattactatattgataaagcaatttaaatgtaaacttttggtagtggacatgtttctcatttgccttagtattttgctagtaatgggcagatagaaagtaagaatgaggatttctccatagcgttgcataaatagtatttaaagctttgtaactatgtaaatagtaatttaatttttataatatgcttatagtagatatacttttcttttagaaagttgtctttttgccatctttcattcattaaaatccacagatgttctttaatttattacaaactttgtttttcttacaagttttcaataaagctgtaaggtgtgtcttaggaattgatcttaagttgatttgctttgctttctagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgcattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtatgtgaa

SEQ ID NO: 10340 - DNA, 9974 bp, Homo sapiens
cgctggaggctgcagtgagctacgatcgctctagcctgggcgacaggatgagaccttgtctcaaatagagatagacagacagacagacttcagaatttattagggtttgtaatttccaggttccaaagcacagcaagggaaagggcctggctgggtagtacgttacacccggaagtaaagagacgcatacaccgttgggtgcactttatagtctggctggcaaacgagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagaggtgggctcgagggaaagatctgggtcccaccactacttcctggagacgccggggaaagcaggccatccttcgagccacccatctcttctccgattggttaactgccttcttattgcgctccgctggctggtgattggttgggatgcaccgtctatcacctgcttccttgtgagaatctaggtctctaagggaagcgttacttgaggctcggttgggaagaggttggttgggcctcttgagcccactttatttatcgtagtggggatcgtcccccggcgcgagcttccgtcgcaacggccgggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaaggtaggggccttgcgggaggttttcgtgacctaattgtatggggatctaattttctagatgtgtctaacaaaatccactggagaatttgctttggctttgcagcagagtggggagactaccacccgttcctggcctttaaagaaacagtttattgaattattcaactctcttttattgcttcagatgggcagctctcaaaaaaggcacaaacaattgaaggatggataccatggcatatgttaaaagcgtgttgaaaggaaaataaggtattcgctttgttttcattgtgattaactgtataagaaaattacctttaaggagaagctcaagttttaaataatattagggtaacttgattttatgataggcttcaacttgtaaaattatttattacaaaaatcctattattgctgtacctacgaaatatgctctttgctaattatggtcttaatctgaagatagagatcttgagtttttagtagtgttaattcatatttgagtggataatgttactaggtcatttgttcaaaatgacataataaaataaccacagtgaaaaaaatccttgaatttgtaatttagtgttacaggtgaaattgaatagttgcttactccaacagtattttagacttgtaggctaatttcaccttatatttaaagcagcttgcttattaaatacctagtgtatttcgagaggcagagttgcacagttgcttcactggtagcctagccatttgagcctccagcctctactgagtcaggtgctgtattactcataccctttagtgacatgccagaaattgtcgaggaatagtttatttcatctgcagaacacccaaattagctcttaacagcagacctggtcctaccctggaaaactctaatcaaggattggggatgagatttgggcatctagatttttaaaaatacccttaagtgagtttgagaaccattgctttagtgtgacttactgaatagatgtatttaagaaattctaaaatatttgtgaaacaaacatctttctctcttgatttccatgtaatttaaaagtgagcttctcaggagtgacacttaaatataatccaaaaatagtggtttcttaggcaaagtcaggaagtttcactggcattctgaaactcctgggactaaccattccaggcttaaggatgaggcttgatatggggtgatacaaagtgctctgatgcactttcacaatccttgagccatacatgatgtcttgtttcctgttgggtttcaaagtcttcctggtaagctttaataagagaccaccttccagtttgttcagtagatattaattaggctaaatgattttcacctcatcaaagtgcagtgggggataatattacattcatgagccttattttggaaagaataccttgctgaaaacaaatgtaaattatatcatcccagtatccctttgctcattaagtgaagaatgtgcataattcaagcctaaaatttgtaattaatgtgaagtacccagatcctgaaacataaatgaggacttctggatcaacttttccagatcgtcaacatggtcaaaaatgagataatcactatggtattcaggcatgagcattgtgtggtaaacccaaatccagtctgacttaatggctttaggcaaagaagtaagtgccaattgtgttgtatttcctagaagctgtttttcattttatatgtaagcttctcactgcaagatttggcaaatacagtatttgggtaggggacaacatttaaaaattaagaaaaactgcaagttaaaaatacaaagccaaatgtggtccatgacttaacaccttgaatgttgtttatattgtttgaacagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggtaagagatgggtaaaagaggaaacacccttttttcatcatttagatggaaggatttcaagataaggagaattggtattctttttccttgcttctctttatgaaaatatagtatattgtttttgtgagtttaagaactttttagtataataaagtagaaaatcactggcttctgtattttataaggtgaaaataggggacatggagcactattatacaaatgccaaactaagaaacaggttaatgtacataatggtgttaagtatttacatatatggtcctatttgtaatttttatacaaataaaatatgacttaaaacccaatttgaactcatttggggtattataatttatttattcagctgaattaatagctccccccaaagcccaatgtgttccataaagtttttacaaatgaactaatggaaatttgtatgtttatatattgtgtgtttgtatattgatgacccatataatgaagtatttgggataaaattcaagtaaatatttgaagttttctctataaatgctcccttaatttctttttaactgacaaaaatccacagttatagcttatagattcctaagtgtatcaactggcagcactttaccaactattcaaattaaatcttattttaataatttttaataaaagattaataaatgaagcacaaccgaattgatgcacatttgtaccagttgaatatttttaactgtcttcaatttacagaacatatgaaagtaataagacatttgtcttctataggttactaaagattagtcttacccttcatgaggtctcataaaacttaattcagaattcttaaatgagcagtttttcattgttttaggagaaataacatcagaagaactgcaacagcggttagatggcgtcaaggaacaactagcatctcagcctgacttgagagatggaacgaattacagaggtactatggagtcctttccataaggaacaggcttgattggagcacttgcagaaatgaaattcttagaccttgtatagtatgtttgtcttcaattttttccagttttaatgtgatactcattcagataatatatatatgagtagtaaagcagtatggttaagcagtataggacagaggaatgaatgcaaagatgtcttaaacacacagattgccttcagagagctttatgtaataatatacaattaagttaattcccagcatgcttctttttaatcttggaatgtacacattactttttctaaagtgatattacttagcttctaaaaatttatatacagaaccgtgtagaaagactgagttaggaaacctgtttttgtttctttgttctgtttgatggtttacatataaaaagttcttataaggaaagtactataaaagaacttcaaactaaatgaagtatgtagagttaaaaggaaaagccacttttgtgttcctcttaaccagttctacttccctcctcagaggtatttattagtagtttcacatattatatcaaaatcattgtattagttaccatgaagtctatgtaaaaaccccaaaatgcaatggctcaataagctagaagtttcttacttacgttaacagtccagggaaggaaatcctcttggaacccactcagctaacagaatgattctacaactgtgctgttcagtacagtagctgctagccacatgtgactatttaaatggaaattaattaaaatcaaattaaatttaaaatttagctcattcatactagccacattcaggtgcttaatagtcacatttggctagtggcttctgtattggacagcacaaatacagaacatactcattacttcagaaagatttatggggcatcactgctccagggtaccatttgtatgatcaaggtaagtcgcaaccatatctaggttctagctggtaggaaggaggtccacgcactagcgtgagagtaggatgtatcgcttactctcccattccattcatgagaacttagtctcatggtcacacctaactgccaggctgtccacgagccaatttccgatgcttttacaatggaagaagagtagggtagctttgagtaggtacttggcaaactctttcacatgcaccatcatcactacacttaatcaaatgttaatcaaagaaggaagtagcatttaaaataattcatgttcacctgccttttactcattctttttccaaacaaatgggaagtggacattaacacattttattatttgtgtttagatatgtaagttgtactatatagatgcaataattaatactgatcttttgaatatgtttcagtggaaaatgtactcatcaaatataaaatagctcatcatctctggaatatggctcagttgctgtttattttattggcatcaacagctgattaatagcttcaacttcagcatttaaaaaagtcttacgagagagattgcaggaatgaaatgaaatcagaatgatgtcatataatagctattttatttatttgtttatttattttttgagacagagtcctgttctgtcacccaggctgtagtacagtggcacaatcttggctcactgcaacctctgcctcccgggttcaagcaattctcctgcctcagcctcctgagtagctgggattacaggcgcacgccaccatgcctggctaatttctttgtatttttaggagagacaggtttttaccatgtcagtcaggctggtctcgaactcctgacttcatgatctgcctgccttggcctcccaaagtgctgggattacaggtgtgagccaccgcgcccggcctataatagctatttttgagtagaacaaactttaaagttgaagtttgtgtagttaatgtgttgatgctttttattaagttttgtactttatataatatctactggttataaatggaaaatttaagcttggcacagtggcagtatcttagtcaaaaaagtttatgggtgacacatttctaaattgattaattgagcaatattaattgaaagtctgatttatactagatactgctgtagaggctggagatgtaacagtgactaaaactacaaaaatctttgttttcctggagcttacgttctaaatgaatagaaaatgtattttattatgtataacagctaacatttatggggtggctttttatgtgccagatattatgctaattatgttatatatagcgtcttattttatcctcaggataaccctatgagattgattctattattaactccagtttatagacaaggatcagccatagagaccttaagtaacttgcctggtttctcagcttcacacaaagacaaatacagtaatgtggttttaatgttatattcagaaactcacatttcttgatgtgtacatttttggcagcacctgagaaataggaaaaatttctaagattacagaaatacctagttgcaaaaatgactgagttggcttttccagaaagattccacaaatacaggacaaattttacataaagtttgtctttgtattttattgatattactatattgataaagcaatttaaatgtaaacttttggtagtggacatgtttctcatttgccttagtattttgctagtaatgggcagatagaaagtaagaatgaggatttctccatagcgttgcataaatagtatttaaagctttgtaactatgtaaatagtaatttaatttttataatatgcttatagtagatatacttttcttttagaaagttgtctttttgccatctttcattcattaaaatccacagatgttctttaatttattacaaactttgtttttcttacaagttttcaataaagctgtaaggtgtgtcttaggaattgatcttaagttgatttgctttgctttctagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtatgtgaa

SEQ ID NO: 10341 - DNA, 10292 bp, Homo sapiens; identical to SEQ ID NO: 6827
  misc_feature (2498)..(2498): n equals a,t,g, or c
  misc_feature (9168)..(9168): n equals a,t,g, or c

SEQ ID NO: 10342 - DNA, 14150 bp, Homo sapiens; identical to SEQ ID NO: 6828

SEQ ID NO: 10343 - DNA, 303 bp, Homo sapiens; identical to SEQ ID NO: 6829

SEQ ID NO: 10344 - DNA, 13334 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccaggtgagcggcacaggctggtgggccgtggcggtcgggcggagaggactggggtgggggtccgagtcggagtgggcctggggtcggcggagggatgaggggagggtggaggaggccaagggtaggggcagggcggggtggccgagtgcccggggtctgagaaggctggtgtccgagtcagaggcggggcggggtggggagggcccggggtctgctgtccgggcttggtctcctataatggaatctggccgtggactctacctttgaggaaccaacattagctctttaagagcttataccattctagaatatagttctctactcagtgtttttcaaatttctgtcgtgtaaaaattttaaggagactgtgaagtagtgcagatttccaagcttcatgccaagatgttctgaattagtagattgaggcctcggtatttatattttagaccaacacttcccacccagtgattctgactctgggagcttgggtgccgcatcttgagagccatattttgattttcttgcggggcttcccaacaattctgtatgagagatagtgatatacttttttttgtttgtttttaatgggtgaagtcactgaggtaccaagaggttatatcacaaccagctagaactgaaagccaggtttaacgctttttagttggacactagtggtacaaaaggattccacacggaagatgcaaatgaagcatgggatctgtagggcttacaggcttttacttgtttctggggcgctttaattgctggaacgtgttagaagtaacacagacacttccagaccattcgtgggagggattggggtgactcaggcacgaaagaaggaggaccctacatggtcggtatctatggtcatcttgtctcaaaatctgatggaatctgccgtttggattctgttttccctgcttcagtgcagctggttcttgatgagagttctttgccaaggacttgctggatgtaaaaaaaaaaaaatgttattttgttgaaactttctgcttctttgagttcttttaaaaaaatatttttaattgtggtaaaatggtacacaaaatttatcttcactatctttaagcgtgtagtgagtgcattgatatgaaatagattgatagtgttgtgcagccatcactgtcaatcgtctccagaactcctttttatcaaattcgtgtctattaaacacattcccttctcccccagcccatggcaactgccattctaatttgtctctgtgattttgacttttctggcgaccttagataaatggaatcatatagtttttgtgtgtctggcttatttcatgtagcataatgtcctcaaggctcatgcatcttgttgcatatatcagaatttctttcctttttaaggctgaataatccattgtattattcaccacattttgcttatctgttcatctgtcagtggacacctgggttgcttccacatttcagccattgtgaatgatactgctatgaacatggatgtacaaatatctcttcaagaccctgctcgcatttttttggtatttacccagaagcggaattgctgcattatcttttagctccttcttggggttcttggtctttgcagtctttaccatggcctacattcactgctctgtgttgttgcttttctcagatggaacttttggtgccaacttggctctgattctttttcctttttccttcccattagtacttaagattctcagagatttcacttgtaggacttatacctcacctgcttgggatgcccacactagtttccaatgactaacagctgcaacactaaagggacatctctactaatatgtcttaaaacaacacatgtcccagctgatttatttatttatttattttattttagatggagtcttgctctgtcacccaggctggagtgcagtggcacagtgtcagctcactgcaacctccgcctcctgggttcaagtgattctcctgcctcagcctcccaagtagctgggattacaggcgcgcaccaccacacccggctaatttttgtatttttagtagagatggggttttaccatgttagccaggctggtctcgaactcctgagctcaagtgatccgcctgccttggcctcccaaagtgctaggattacaggcttgagccaccacgtccggcctgagcttgttttcttataagaccgctttacttacgtcctttgtgccctataattacccgattccaaagttgaaaaagtagtttcccagcttttttggtctttgtatacatgctgtcacaatgcagttcttcctttgtctctttatagccgtgtctcaaatgctgtctctaggtttactgcaaagccttccttgtttgaggtcttcttttctgaggggttattttgatcacttcagtccctcaagatattaacaagtaatactgtgtgtgcaggcattgttccaagtgctttacacgtattacctcgtttaactgttgcacaaatcttgatttttttaatgtggaggcacagcacacaggcccagagtcaggccttcagttacctatatggctctgctggagcctgctgcagactcccatttgagcaccctgctttgatggccctggttgccctttatatcacatcctcagttggaggctccttgtcagcacctcttcctctggctgtaccatctcctgtgactgttctgttctggatagatctctctgttgagcccatgatggaccttctccctttcaccctttgtatgagccatttcccacttctttgtcttggatgagcagttttccttttgttccatccagagtgtcttgcgctcgttctgtggacgagccccagcagacctgagccagcactcactatgggtgtatgtggcattgcgagggtctgtcatgtggacacagccataaatggttgtgcatttctgcctgacagtttttgcacactattcttctagtgcagttcttataaatgtcctgcttcttggaagttattgggaccttgagagcaggacctgcctcttgtttttccattgcattccaaattatgcattcaccaaaatgtaaaattgactgtatcctgtggaaaaaccccccagaaaattcacctgttttggtgagccaggtagcaaacagatggagctttcatggtgatgataattcataattatcagtatttgtgctcatttatagagtgtttgttactagggatgggagggaaaggaatgaaaccaagaagcaatgtctacttaatgtataagcccagaggtcactttccactgtgttggggacaaggtgataagaagtaggcaataaatacattttgtgtttcttagcgttcaggaattcatgaccttcacgagtcaactgattgtggagcgctcatcgaaaggcactagagcttctgtcaaagaacaaggtaagaagaccctccaacttctgtgcgtgtgctggcctggctgccatgcctcacctcacatagcacccagctttctcctttctactgggaccctactcctcctctagcttgttctctctttcccacctcttccttttcctatttatgcagaattctgtgcccactgttgaagtctgagcttcccagataaaattgccctcaaacttagactcatttaagattagggtctgactcttttggagcagtaagcagccttcatatcgtattcttccctatcctcttcagagttgcagacccctcaaaaaaggatttccagctagcactgttgaggtactatatgtattctgtgcatcgtagattttttgatcaggaatctgaaaaaactattttttctttctgataattcaggtttaggcatttatttagatgtgtatgttatacagacagatcaggaaagagttacatgagtttcatcaggtagggacaaagatcatctcacacttatgctaacctcaagtcacgtgacatagagttactgaattgatgatataaatgtcagttatgatacaggcaggattgactatatacactttatgtgggatctctgtgctattaacatcatagaagtgaaatcgcatcacaaatatttcagtgttcttgctctgttcttcaaactgtgcctgcccttcccacgtttattacttaaagacaattcctccactgaccaggttctcagtttctttggagggtatgcactttgaccccatgtttgaatcttaattggggatggtatacaaaatctggagagcattggtgacaaccccctgtcctcttcctcctcctcattcttgttctcatttatctctgctcttttctgatttcaggggctcaccatcattccctcctcttttatttgtttttctgttgtttagcattggaatcttctgggtcagatccttaaggacaagaaggttcttatttgtaagctgtaatccttacatttctctttccttggggatatggttagctgtatcaactctgaatcctttcaaagtgatggaaatgaacaatcctgtggattgtgaatattttgcggaagacctgtacaactgtacctttcaatcatatgaggattttagcacagtgctctggaggccttagctggcagtagctaatctttttctagactaacccccctactcccagtcacccaccagagtggagcaaacccagcaggttgctataatatggaagactgaggccctggggggtaatttcctgtcttttggctgctctgaaaagattttttaagaaagcagaggcctcttggcttgtccagggttccctaagtttgggagcagcacagagccccaagggctccagatccctaagatatagcttggcctgacccgagcttaaggaatacacttggaaatgctcctggggccatgttgtcaagggtgtgttttctgcaccactggctgtttctttaagccctggctttgcatactgggcctctgggtatttactggtcctaaagcaggcgttgggccaagctcctgtgtgtggcccattgggctgtgctgctaagcctctccacaagacttgcccagagctattgagcttccgagtggcttcatttggcctaacattggatgctttgatttggggggattaaaagaagtctgaagccctcatgtcagcatccatgtgtctgatctcttgtctccttagactatctgtgccacgtctacgtccggaatgatagtcttgcaggtgtggtcattgctgacaatgaatacccatcccgggtggcctttaccttgctggagaaggtgagttttttatttgcctctcctggacttggatgatgaatgggcacatttatggactgggacaggggttgatggcagtccctgagacataagggatgaaatgatgtgtccaaagtcaacacatttttcagcccccttccctgcaacccaagagacaatttggcatccctgtatgggtttcctccccggtgctgtccctcatgtgagctgggtctaggccactgagtcatagcatctattctctgggatgggaccctcggagacagctgtgccttgtgttctcgccccctgtgcttctgctcaaggagtctccctcttgaatgccttcactctccccattgcctcctgcagttgctgcatccctctaccttgatgtcagtcagttgcaccacagagcttagcacctaagcattctttaaatttttttgcgtacggtgctaattactaatattaactctttgaagtcagaggcttcatcctataccccagagcaccaaaatacctccaaacacatggaatctggtggtttcttaaatctaggggacctaattctcttttttaaaaaattgctttggaaaattagaggaccagtgccccttttttctggaaatctgtagtttaaaattcaaatacctttattactccccaagtgaggttcatctcgggctgggcatacttttgattctcagaatatttaggatatgttttaatgataaaaatttggaaagaactttagcctagattttctctgttgccattatatgtccccctcattcctccttcctgggctgtgaaggccaaggagcctcattcagggtgaggtgctcaggggtgaagccctgtcattgagaccactggtgagtgcacagtgggaggcttgttgagtctcctttgtcttgcaggtactagatgaattctccaagcaagtcgacaggatagactggccagtaggatcccctgctacaatccattacccagccctggatggtcacctcagtagataccaggtagggttaaaggaagcttcagcagacaccatgtggcccagaatccatgtgaaactgaaaaagccaactgccctgatagttctggtctaattacttctgacagcttctgatgctggtgtcctctctcaagccttactgtttggaaaacagagaatctacgttcagaccggggaacccaagctctaggcaggctttgggtttctgttacatgttaaacaggctgtgggtttttttttttgttttttgttttttgagttggagtctcactctgtttcccaggctggagtgcagtggcgcaatctcggctcactcaacctgcacctcctgggttcaagcgattctcctgcctcagcctcccgagtagctgggattacaggcatgtgccaccacgcctggctaatttttgtatttttagtagagacggtttcaccatgttggtcaggctggtctcgaactcttgatctctggtgatccacccgcctcatcctcccaaaatgctgggattacaggcgtgagccactgtgcccggcccaggctgtggtttttaacctgtgaaagtttgtccagcttcctcagttttaggttttgtttgcaggtagccactccagtcctgactttattatttttcactctttcctagaacccacgagaagctgatcccatgactaaagtgcaggccgaactagatgagaccaaaatcattctggtaagcaggaagatggagagcaagcccaagaactgaggcgggggtgcgatttccactggccaggcatgcacagatccatcctcgttttaatataatagtaaccacggcactctccagcaagtgggattgcccaccccttcccccaccccgggcatcagactgtctttcctatacccttctcttggttaatggcacccattgtttctaggggaccaagctgggaaccagtggaaccctcaagtctcccttcctcatggctactgcctgtctgaccatttactgggttcctagggtttggcttctgaagacctggattcccaccctggtgcctttgttagggtttcgggtgcctccacaccccacaggtgcctccccttgcagcgtttgcattgaaggtgaacagattgaagcaccgtgcactgaccacagggcagcttctggaatatgggcccagggttgtcacataggcccctttgaaaagagccagaaccctgcattttgagctgaaatctcctgatttgtaactgttgcttcaactctttttttttaaatttttgcatacaagtggaatgtaagcagctatctgtttttctcaggtttttctcttacagcctttgcctctaagtggtccccttgcctcctgctcacctccagtctgtccaccagagagtagtcattgatctgcacaacttagaacccttcagcagctctcagatccgccccaggataaagtgcaaactaactcacagtctcctgactgggccctgttctctcttataccctttcttgcccagctcacacacaggcgcctgaaggttgggcctttctgaccagatgtcacagttttgtcactgcttgtttacatgtctccctgaccagcgtatgagcactgggacatctttccatcctgctcatgatacagtgcctagtttataccatgctcagcagttgatagatacctggagtggattgaaacccacatacaaagctttaccatttacacaggcatagctttagtgtgtacatcagcgtctcctggggttggagttgttggcctgcgatggagcctgggaacctgcattttataaaaagcatcccaggggcttcaaacacaggtgtgctgactgcactccaaataacgtggctttggaatgaacgatagatgtgaaagtctcatggtatctgtgtcttttgaaaccttgtgagctttcttaccacctaggtggcatttctccgttttctcctcaagccatctctttctgttgctcaagtcctagtctgagtaccatgacacctgggacacccgctgtttctcctctccccacggtggggagtggatgagtcctattcacccagcctcatctagctgcagttgtaaaatctagatgattggtgtgcatatctgaatcagttaactttctgtgttaaaaatttgagtcgctcagctgtgtgtagggatgaaggacattcttgctggctccttgttctatggcgcttcatgtgtgcatctagctgctgcagcagtggccatctgaggagagaagcgagctgctgcttcctgagggccctggcagcagagctgctggctcttgtgaggtctccatctctagaccccttcccatggggtcagtgttttcatttcctaagtcagagtttgtagtgatgacatttaggacatagcccatttagaaggcaggacatgttctgtcatagtgctgtctggtatatatttggggcatgtgtgtaacttagaattttctaggagccatattttaaaatgataaaaggaaaataggtagaatttaatttaattatatattttacttaacgcagtatatccaaatacaatttttccaacatgtaatcggtataaaacttgtttttttttcagtataaaacttactaatgaagcatgtgtgagtttgcatctgaaatctggtgtgtctgtactcagagcgctgctcagtttggacttgcctcacatcaagtgctcaatagccatttcccaccgccttttgtttcctgtggctgctgtcaacagaaaccctcaaatatttgcttttaacagatagctctgtgggcctggctggtgtcttttggggctctgagtgtctgtcccaggcctctctccagcctctggtggctgctggccatccttggcattccttggattagaggtgcatcacttcaggctctgcctctgccgtcacgtgaccttctgtgtgtgtgtttccgtttcttaccaggacatcagtcatggaattagatgccaccctaatccagtattacctcttcctaactagttacatctgccaagaccctatttctaaatatggtcacattcagagattctggggatgttaatttctgggatgcggttggggttggggggtgcggtgtgggtcactctccaacccagtacaatcatatagtgcccagctactcttttttccaaagctccatgcacacgcacatgtgcgtgcacacacacacacacacacaaatgtatatataaatgtgtgtgtatatatatatatgagttttcctggagtgctggttatctaagcctgtgctggggacagctttttgggaagtctgctacatcccagttagatcttctagatttcacgggaatgtcaccaggttctgttccatccacttggacagtaactattcttggaccgagtctcgacacctagaggtgaagtttgtgtgtgttggagaggaacccaggtaaggcactttcccccatgactgaaatatgaggggctcatgtcagggcacgtactgaacagagctggattctcttttcttttttgtccagcacaacaccatggagtctctgttagagcgaggtgagaagctagatgacttggtgtccaaatccgaggtgctgggaacacagtctaaagccttctataaaactgtgagtacccagcacctgctgcctcctgggtgttctctctagagagcagtcgcagcttgctgcttctggcactctccactatgaacgggtctttcttagactgttgaatcatggtggatgattccttgtgcggcaagagcctaaggtgagcgcctcaggcccaggtggttggaggcagttcacttgggcgccgttggagtcgatgcgggccgaggccttgttccactcctgcctctgctctgccctctgctgctctggctgatttctgaactcctactcccagtccaggaaggctggttcaagttctgatcaccagagatttactgttgaatcttattcctctttctgctgagtagacataagtctttaagatgcaagcaattcagccttcctgaagaggttcttaagcttttaatttccctttgacagaaaatatttaattgacaaggatgggtgctgctgactgccgctttctctcaggtcagtgctcatgtcttcctatgtggagatggcactgttggcccatggttggatagtcatagggacaaatttacttggtctgtccacacacatttgctttcatgtgcacattggagggagatggctaggtgggattaggaagatagtctgtgaccagaaagcaagagagaaggtggcaacagtggtccccacaaaccacatcccaagtgggaaccacatctgttgtcctcaggaccatcttctaggaagaaacaccaccgtggtggtcagatagcattgtgtgaagacaggagtggggcaaagttaagatattctgccaatcccatttgtattattggtcctttgtttgtacctggcctaactgtaggaattttactcactttttgatagcattaatggggtgtgagaaaagaaaggaaaaaggatcccagactagttttggaagccggggcccgccttgtgcttggtgatgggaattgcttgtggacagcttccctcaaggcctccacccccaccctgttctagtgctagtttctctgcctggctgtgtcctgtggagctccctctgccacgcctgccaggattggggcttcccttacttcgtcagtcctccttctcagctcctctttgtttttttccaaggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttcacagtggt

SEQ ID NO: 10345 - DNA, 2558 bp, Homo sapiens
catttgggttggttccaagtctttgctattgtgaacagtgccacaataaacatacgtgtgcatgtgtccttatagcagcatgatttataatcctttgggtatatacctagtaatgggatggctgggtcaaatggtatttccagttctagatccctgaggaatcgccacactgacttccacaatggttgaactagtttacagtcccacgaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgttttttggctacataaatgtcttcttttgagaagtgtctgttcatatccttcgcccatttgttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatgcttgtagatatgcggcattatttctgagggctctgttctgttccattgctctatatctctgttttggtaccagtagcatgctgttttggttactgtagccttgtagtatagttagaagtcaggtagtgtgatgcctccagctttgttcttttggcttaggattgacttggcaatgcgggctcttttttggttccatatgaactttagttttttccaattctgtgaagaaagtcattggtagcttgatagggatggcattgaatctataaattaccttgggcagtatggccattttcacgatactgattcttcctacccatgagcatggaatgttcttccatttgtttgtatcctcttttatttcattgagcagtcgtttgtagttctccttgaagaggtccttcacatcccttgtaagttggattcctaggtattttattctctttgaagcaattgtgaatgggagttcactcatgatttggctctctgtctgttattggtgtataagactgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcttaattgaataccctttatttccttctcctacctgattgccctggccagaacttccaacactatgttgaaaaggagtggtgagagagggcatcccagtcttgtgccagttttcaaagggaatgcttccagtttttgtccattcagtatgatattggctgtgggtttgtcatagatagctcttattattttgagatacgtcccatcaatacctaatttattgagagtttttagcatgagggttgttgaattttgtcaaaggccttttctgcatctattgagataatcatgtggtttttgtctttggttctgtttatatgctggattacgtttactgattttcgtatgttgaaccagccttgcatcccagggatgaagcccacttgatcatggtggataagctttttgatgtgttgctggattcggtttgccagtattttactgaggatttttgcttcaatgttcatcaaggatattggtctaaaattctttttttgttgtgtctctctctgccaccctttggtatcaggatgatgctggcctcataaaatgagttagggaggattctctctttttcttttgattggaatagtttcagaaggaatggtacaagctcctcctaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaataagaacacatggacacaggaaggcgaacatcacacaccggggactgttgtggggtggggggaggggggagggatagcattaggagatatacttaatgctaaatgacgagttaatgggtgcagcacaccaacatggcacatgtatacatatgtaacaaacctgcacgttgtgcacatgtaccctaaaacttaaagtataataataaaaaaaa

SEQ ID NO: 10346 - DNA, 8498 bp, Homo sapiens
  misc_feature (4979)..(4980): n equals a,t,g, or c
  misc_feature (8440)..(8440): n equals a,t,g, or c
ttcagtttcagatcagtttagtgtagaatttgaagttgaatctctcgactcagaagattatagccctagtgaagaaggacaagaactctcagatgaagatgatgaggtagtattttttttcccctctaattatattggaaaattattaaatattttctatgttcattgactttgagattgaaataatattattcagatttcacttgaaatctttacctcttgatttgtttaaactaacacattggtttgtggacttgaggatttcatagttctttatcatctgatttatattattatattactactaattgccaagaagtcaatagacctcaatgaacatgcttattataatggtctgttcacttttaaaaacatataattcaactactgttttaatattaacttactttctataaaagtaaaacatgcatacagttaaagtcaagtagtacccttagagatctgtttcccagaagtgactgcctttaacatttctagctatttccctattatttaatatctccatattagttatttatgaagtaaaaccacctagctgaatgttttgttttattcatcctaaacatcctttgtattgacttttaccattgtgggtaaggatttctctctcctccattttttccccctttacactcacttactctatttgatattgtctaaggctttctcatatattgtagtacatgatatttgtttaggacttattactaggaagccttctgattgaaggaaatagggcgatgaattgatgctaatgaatgtgttttattaggtatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctcctgagtagctggaattacaggcatgcaccactataccccactaatttttttatttttagtagagatggggtttcaccatgttggccaggctggtcatgaactcctgacctcaagtgatctgcccaccttggtctctcaaagtgctgggattacaagcatgagtcactgcccagctgaatttgtacattttgatgttattttggaaaatttcagtgtatctccagtatactcatcacccagctttaactattaccaacattttgccaaccttgtcaaacgtaaacttttttttttttcaattgagatagggtcctgccctgtcttccaggctggagtgcagtgatgtgatcatggctcactgcagcccccacctcccaggctcaagtgatcctcccacctcagcctcctgagtagctggaataacaggtgcatgccatcacaccccagctaatttttgtattttttgtagaaatgtcaccatgttgcccaggatggtcttgaactcctgggctcaagtgatccacctgcctcagtctcccaaagtgcaaggattacaggtgtgagccatcacacccagccaaatgtaaacatttttattactgatttgtattatagaatgtggtaggatttgccattaaagaaattaacacttaaatgtttacatctcatgcatacttcactgagttcctgaggtattataggtttttttaaaactattgtgctttagtttttgttcttaatattgcctttattatatttgaataggaaataaattccattttttctgagttatagacagttactaattattcaagtgcaaaaaaggatgaaaattcaagagtttccaaaatttttactgtattagaaaataaataactaattgaatcatttgatgtcaagttgagtaaaatattttagatacttttaattttttaaatctattttaagactcaaattattttagatattcatcttggaatttattggactttttgatgcacttttactcccatattgcaagacctttttctttggttttatgagctgtgaaaaacccccttctataacttgaaaaaagaagaatgaatagtctatctttattgctcctgtcttaacatcatttgtgaggcaatctcaaaatggttacggaaatacctcttacttaagagttttcacttgttaaatgtcctcaggcaagaaccatgcttcagctaaggcaagaagataggttatgtaaaaaggctggggatgtgggagagtttgttatccaaattgcatggtggaaaggtttgtgggataaaacgttgggaaaaggaagaagcattgagcagttacaaagatgagaacacaggaaaggatagacaggtaaaggaaaggatattacggttagtgaccaaggatgataggttttagcagcaatacttgctgtgaaaaatgttttagcatttctcttgtggatggagttagggaatactcagttaagccatggttttagagtacttctaaggtagttctagtcactggtggattaggaagtctttctcgaggaggcaggtttcatctagattgatgggatggactcttggaatagcgcctagggttgagcctttaagggagtggatataggctgcatgacagagtaaaagatcccatagacttgcttcaactaaaggaagcaactgcatttgtatcctgaaacagataactttataggtacatgattaatatcacatcacagttaatatatttttagtttagaatttttcaggatggtaagggtgaaaaaaatgggtgtacttactctactttaggagagactgttacatattgacctttaaaaatctgttttgtgtataattgagacatataacgtgatgttttgacacacatgtaaatagtgaaatgatcactacagtcaagcaaattaatgtaatccattatcttgaatagttaacctttcttgtgtgtatggttaaaatacctaaaatctattcttttagtaaatttccagtataccaatatataactaactatagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttcttttttttttttttttnntttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttacaacctctaaattattgacttattttttatataagggcactccgatgaaaggtgattacaaaatcatctacattgctgtctacaaaacagattatatggatgtttgatcgcatctcattgttaactctttactgatatgtttgtaaatacaaaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaatggcctgatttcttaggttctttatagtacacgtgttgaaaatatatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactntagaaatacaaatatcacttgggcagcttgaagcagtggagcctcaatgagaccacct

SEQ ID NO: 10347 - DNA, 882 bp, Homo sapiens
gtaagattgtactggcctgtttagttttcggcctcttcttggaaagttcccccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagca

SEQ ID NO: 10348 - DNA, 594 bp, Homo sapiens
attatacaagtagtaaggataattaaaggtggaagagccttttcagttatggtattgacaaaggcttagtcaaagaaggatgaataggattttgaaactgaaattattctagttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatggctggctggggggcctagtcttctgcccgccgatctccctcgggaagtcccggatcagagcagcaggcccatcccccaactgttacaccctgctggcagcagcagaggcacagggatgagttaggaaacagatacagaggtcaagaggtgatgtttattaagttatatatttttttcttgtttt

SEQ ID NO: 10349 - DNA, 5295 bp, Homo sapiens
caccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggaaccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttgccttctgt

SEQ ID NO: 10350 - DNA, 5141 bp, Homo sapiens
tttttaggttggtcttcctgcaaaatctggagttgctgggggcattcttttagttgtccccaatgttatgggtatgatgtgctggtctcctcctctggataagatgggcaacagtgttaagggaattcacttttgtcacgtaagcatattttcttaatgtaaataatggtgttacaagttgagccatccaatgattcttttttttaacccattttccatagttcattaactcttggccctccgcctatagtgtgccagttactagggagccgtggaaatactcccagaggagcttcaagttgtctctgtcagacagctcccatttaattattcccacagattatatttgttagatgctaatattttaattttcatggttataattagtatgaattttcaaaagctcaacaaaaggtattaaacttggagaagtaatttaaaagccagtatatcttaagaattattttggtttattatatctttaatctgcatggttaaatatctttatccattgactacctttaaacatttttttgaggaaataagcactgaaaattaaaaaaagattaaaccatttttaaactgttactgctcttgatagttctgtattttgttgttacccagttcctgctaatgtttgagcttctagttttagttacattgattacttgcttgagttcatattaagtaccatactcaattaaaattgttttattttccagtcttttatattttacaaaaactagagtatgaccttggagtgcatataaaatatagtagattgtaaccagagtacttatttatattttaatgtggctttacacttatttgatagaagaattctttcatggggccggttataaaccctattttgtagaagatgaaagatgatttgattggctgagccctaggatcatgttagtaagcagtgttcttaaaacttatatccatatcttactctgattttagttctcttcttgatgcattatactactttattagcatgtagtgatgatttctaggctggacgatataagcagagtttgttaaaatatggatatatataaccaatgaatagccaatttcttatacctgctctgtataactgtttacaggatcttgtttctctgtgtaatttccataactatgataatttgagacactttgcaaaaaaacttgatcctcgaagagaaggtggtgatcaaagggtaagcaaaattcttatttagataagtatataaaatttttaagaagagaaaaagtgagatttgcctgtataaataaaatcttagtttgttagtggcctcgggtctttgctaatcataaatgagtgtaaacaaattgttgacatataaatccgggatcaccagtattaaatacttaaagattgtttaatagatagttaatagatacagatatttaaatattgctgttttgttatttaaattgaaactagttagcctagtgtcagggatttccccttccattttctgctattttaagcaagatttttagaattgattctgttaaaaaaagaacaaaacaaaacattggaatgtgctgcatgctataaagaaagcatcgttttaatatttgttcgtcctaaattgaagtttaacttcttgcatactgtgtagatggatatgtaaatggaaaaggattatcatattagtgagagaccgtatgaagcctcaaaagttttataagtcactgtagatgaaatatttttttccaccgtgtttaatgcaatattcctaataatcttacggtcctatttgtttgttacgagtttatttggcttcatactattgtacacatatattcctttttttagaagtagtattaagagtcaggacttaacttttttggtctatatagtttttcactgtaccaaggggcttgtgctgagaattttgattcagtttctttgcgtaccatattgaaaatgtttgtagtaaaattacctaattagacctcaagataatatgaagaacttctaagtagaaaatatttttaatacatactaagtacattttctgtagtgctaaactaaatttttgttagtttttatcaaattaatttctgttactatgtaagaattatgcaaaaccaacagaatagaaacttccatgggagtcgacctgagtaacatgaagcaaaatgtcagaggtggtggtttaaaatgttaacattttaataatgctcattgaaaaataccattttatagcttggacctttcttcactcaagtgcactaataaattatgtatgttgcttgaacaactagcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgattttattgttttttttgttttgttttgttttgtttttataaaagcaacttcaacattttaagtacaaatacagttgggattttaacttagaaaaaattattctttatgaagatactgttaaagtgtttgctattctgaagctgcctcaaagtaaactagaaatattcaaaagggctttatttgattttttaaaatgcaatatagcattagtggtttttttgggaggaggacttttcttattggttgtactagaagtatttgaataaaaacttttctctcaa

SEQ ID NO: 10351 - DNA, 102 bp, Homo sapiens
aggctggagtgcagtggtgcgatcttggctcactgcaacctctgcctcccaggttcaagcgattctcctgccgcagcctcccgagtagctgggattacaggt

SEQ ID NO: 10352 - DNA, 6823 bp, Homo sapiens
gggtcgtctgtgaagagggacttcctggtgaccttgtacctttctgggcagatggaggctggacagtaattcagaggcgccacgatggctcagtggacttcaaccggccctgggaagcctacaaggcggggtttggggatccccacggtaggtgtttctagtggggacagaggcaggggaggaagagggaccctcagaagtggccctgcctcatggagtggcctctcccactccaggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggtgagcaggccctgccatgccacacccagccagcagcttccctccttatctttctgctgctctgtcctgccttcaaccccacattgcatctgtttcctgcccccacctcttccttacatgccgtgtgtgtgattgggccactaacttagcctatctggcctcagttttcccatcctgaaaagggtcttgaccgtctttacttttatttacttatgtgtttgtttatttatttatttatgtatttattttttgagacggagtctcactttgtcacccaggctggagtgctttgtggcacgatcttggctcactgcaagctccacctcctgagttcacaccattctcctgcctcagcctcccgagtagctgggactataggtgcccaccaccacgcctggctaatttttttgtatttttagtagagatggggtttcaccgtgttagccaggatggtctcgatctcctgacctcgtgatctgcctgcctcagcctcccaaagtgctgggattacaggcgtgagccaccgcgcccggcctacttatttattttttgagacagagtcccgctgtgtctcccaggctggagtgcaagtgacgtgatcttggctcactgcagcctccgcctcctgggttcaagtgattctcctgcctcagcctcctgagtagctgggattacaggttcccgccaccatgcacagataattgttttgtatttttagtagagacggggtttcaccatgttggccagggtggtcttgaactcctgacctcaagtgatctgcccacctcggcctcccaaagtgttgggattacaggcgtgagccacaatacccggccacaaacatctttataatggtgctccacaggattctttttttttttttttttttgaaacagggtctcactctgttgcctaagctggagtgcagtggtgcgatctcggctcactgcaacctccacctcccgggttcaagcaattctcaaaaaaaaaaaaaaattaggcacggtggctcacacttgcaatcccagcactttgggaggctgaagcgagtggatcacttgagcccaggagaccaatctgagcaacagggcgaaatcctgtctcaattaaaaatacaaaaaactagctgggcatggtggtgcctgcctgtgttcccatctacttgggaggctgagttgggaggatctcttgagcctaggagataaggctgcagtgagctgagactgcgccactgcactcaagcctgggtgacagagtgagacccctgcctcaaaagaaaaagaaaaaatgcaggcatggtggctcacacctgtggtcccagctacttgggaggcccaggtacaagaatcacttgagcccgtaaggttgacgctgcattgagccatcaccacaccactgcactccagcctgggcaatggagccaggccctgtctcaaaaaaaattgtttttaaacttaaaaataaggccgggtgtgggggctcacacctgtaatcccagcactttgggaggccgaggtgggtggatcacctgaggtcaggagttcaaaactagcctggccaacatggtgaaaccctgtctctactaaaaatacaaaaattaggccaggcgcagtgggtcatacctgtaatcccagcactttgggaggctgaggagggtggatcacatgaggtaaggagtttgagaccaacctggccaacatggtgaaaccccctcactactaaaaatacaaaaactagccaggcgtggtggcgggtgcctgtaatcccggctactcaggaggctgaggcatgagaatcccttgaacctgggaggcagaggtgcagtgagccgagattgtgccactgcactccagcctgggagatagagtgagactcagtctcaaaaaaaaagaccaaaaattagccaggtgtggtggcaggcgcctgtaatcccagctactcgggaggctgagggaggagaatcacttaaacctgagagacggaggttgcagtgagctgagatcgcaccactgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccggcaggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactttgttctttgttcttgtttgttttctttcttttttttctctttctttagttcacagatctagtaagttaccctcagtttgttttaaaaagtgaacaaagtccatgtaaacatgttcccagggccaggcacggtgtctcgtgcctgtaatcccagccatttgtgaggccgagacaggcaggtcacttgaggtcagcagttcgagaccagccgggccaacatggtggaacccccatctctacaaaaaaatacaaaaattagccgagcatggtggtgcacgtctgtagtcccagctactctagaggctgacgcagaagaatcacttgagccaaggaggcagaggctgcaaataagccgagattgcgccactgcactccagcctgggcaacagagcaagactccatctcaaaacaaaaataatttttttttcgtagaggcagggtctcattctattgtccaggctggtctcaaacaccgagactcaagggatcctcctgccttggcttcacaaagtgatgggattaaaggtgtgagcgccactgcacccacccctgaaggctctaattctacatctgtgttttgttaaaaaaaaaaaaaaaagatggcgtggtcgctcatgcctgtaatcccagcactttaggaggccgaggcaggtggatcatctgacattacgagttccaggcccgcctgaccaacatggtgaaaccccgtctctactaaaaatacaaaaattagccgggtgtggtggcgggtgcctgtaatcccagctactcaggaggctgaggcaggagaatcacttgaactcgggaggtggaggttgcggtgagcagagatcatgccactgcactccagcctgggtgacagagcaagacttgatttcaaaaaaaaaaaaaaaaaaaaaaagaatagggctgggcgcattggctcacacttgtaacactagcactttgggaggccaacgagcggatcacccgaggtcgggtgatcctgctgtattgctctatatagtgagatccctatatagggtctcactctattgtccaggctggtctggcctggccaatgtggtgaaacctcatttctactaaaaatacaaaaattagctgggcatagtgatgcgcacctataatcccagctactcaggaggctgaggccggagaattgcttgaacccaggaggtggaggttgcagtgagccgagatggcgctgagaggtgacagcgtgctggcagtcctcacagccctcgctcactctctgcgactcctctgcctgggctcccactgtggcggcacttcaggagcccttcagcccaccgctgcactgtgggagcccctttctgggctggccaaggccggagctggctccctcagcttgcagggaagtgtggagggagaggcgcgagccggaatcggggctgcgcgcggtgcttgtgggccagctggagttccgggtgggcgtgggcttggcggaccctgcactcagagcagccgtccggccctgctggccccgggcaatgaggggcttagcacccgggccggacagcggctgcggagggtgtactgggtcccccagcagtgccagcgcaccggcgctgcgcttgatttctcaccaggccttagctgccttcccgcggggcagggatcgggacctgcagcccgccatgcctgagcctcccaccccctccatgggctcctgtgcggcccgcgcctccctgacgagcactgccccatgctccatggtgcccagtcccatccaccacccaagggctgaggagtgcaggcgcacggcgtgggactggcaggcagctccacctgcagccccggtgcaggatccactgggtgaagctagctgggctcctgagtctggtggggacgtggagaacctttgtctagctcagggattgtaaatacaccaatcatcaccctatgtctagctcagggtttgtgaatgcaccaatgaacactctgtatctagctactctggtggggccttggagaacctttatgtctagctcagggattgtaaatacaccaatcggcactctgtatctagctcaaggtttgtaaacacaccaatcagcaccctgtgtctagctcagggtttgtgaatgcaccaatcgacactctgtatctagctactgtggtggggccttggagaacctttgtgttgacactctgtatctagttaatctggtggggatgtggagaacctttgtgtctagctcaggaattgtaaacgcaccaatcagcgccctgtcaaaacagaccagtgggctctaccaatcagcaggatgtgggtggggccagataagagaataaaagcaggctgcccgagccagcagtggcaacccacttgggtccccttccacactgtggaagctttgttcttttgctctttgcaataaatcttgtactgctcactctttgggtccccactgcttttatgagctgtaacactcactgcgaaggtctgcagcttcactcctgagccagtgaaaccatgaacccaccagaaggaagaaacgctgaacacacctgaacatcagaagaaacaaactccagacgcgccaccttaagagctggaacacttaccgcaagggtccatggcttcattcttgaagtcagtgagaccaagaaccccccaattccggatacagtgccactgcactccagcccaggcaacagagcgagattctgtctaaaaaataaataaataaatatgaaataaaataaaaattgtaataattggataccctacatctaggacatgtatttgaggaaaaccacatctgtccattttctgaaccccagctgctgttaattttttttttttttttttccgagacaagagtctcactctgtcacccaggctggagcgcggtagtgcgatctcagcttactgcaacctccacctcccgggttcaagcgattctcctgcctcggcctcccgagtagctgagattacaggcgcctcccactgcacccagctaatttttgtatttttagtatagatgggtttggccaggctggtctcaaactcctgacctcaagtgatctgcccgcctcggcctccgaaactggtgggattacaggcgcaagccactgtgcccggcctgttaatttatttttgccccagtatctccctccaaatattccttatagatgtctcttggggaggtggtgggggttcttgcgctagaagaaaaaatatctgtgatttccttgtcttgacccttcctggcaggtgctggggacacagctgtttccctggggctgtggctgggtataggtgacaaactttttagctttgtagaggtaggtcctacagctgccaggccagggaggctagaggctgccctctccaggttccttgtttgcctgtgtcctgtactgagcaggcttagaggatctcctctgagcccactgtcactggagctggtggtgagtccagtctgcag

SEQ ID NO: 10353 - DNA, 356 bp, Homo sapiens
ccgtgagccgtgatcacacctgtgaatagccaccgcactccaacctgggcaacacaacaaaacctcgtttctaaaaaaaaacaaaggctgagcacggtggcttacacctgaaatgccagcactttgggaggctgaggcgggcaaatcacttgaggtcagaagttcaagaccagcctggccaacatggtgaaaccctatctctaccaacataaacattagccgggcgtgcctgtgattccagctgcttgtggggctgaagcacaagaatcgcttgagccccgaaggcagaggttgcagtgagctgagattgcggcactgcgatccagcctgggcaacagagtgagactccatctcta

SEQ ID NO: 10354 - DNA, 93 bp, Homo sapiens
gagaatcacttgaacctgggaggcggaggttgcagtgagctgagattgcaccactgcactccagcctgggtgacagagcaagactctgtctca

SEQ ID NO: 10355 - DNA, 1398 bp, Homo sapiens
ggctctctcatttccagcagacacccttcctcttacccagtggagaggactcagggaatcttggcagaaccctgctggcaccatcagcggcgtatgctcctcctcgtttctgtcttttcacccgttctcttctctcggtcttccactgtggagatggatgtggaacctttttgcttagtcctgtcttctgcctttcctgagattaccccaccgatctcctgtttgtgtctcaatatgttcttttctctgctcagatctccccattcttaaaagaactgtcccctcctcctcgcctccttcttcaatttctgcccctcctgtgtctgagaccgttcacaggaacgctctgccaaggatgcctgactggcccccagcaagccactcctggggcccttgtgtgctggctcccttccagccctgccttcctgcttctgctctcagactccgtggtctctcttgggcttcagggcctgggacctcctggcagcagtgggctaccccaccccccaaccccacacacacgggaaaccaccctggtgaccagatatatatatatatatatatatacacatatatatatgcatgtgtatgtatttacacacacctgggaaatatatatatctggtgtatatatatttacacacacctgggaaactgccctgatgaccagagcacactgtctttctcctctgccctctgagcacctcaagctgctgtgcctggcgctcttcttctgttctcccctcacagaattcacgttcctccacagtctcagagaacatctttgaggaaatggtctccccatatgggactctcacttctgtcagtcctgaacatcagtgggtgaggacagggctgggcttggccctcagagaggagaggagcacctgcctccggggagggtccctatcccaagaggctctgtccctaggctgggatggggcttcttggtctccacaggttcactctccaccagccagctcttcttcctgactcccctgtgtctgtgctgggcacctcctcctgctgcccaccaggcttggagtttgggaatcatctccaatacttttctctccctgtcctgcagctacctgtttgtttggtcttaacgggtcccccttccctttcctccctaccccagtgcccacagagaatatctaacagcaaaacgtacttttcctccactggactccaccctggcttggagcagatatggaattcccagttctgcccacagcctcctcccttagctcccgtccccagctgctcacccccaaacacccccatcctcctgccacagttttaaaaagtgttgcttggattgggccatcgcctgcttagaaacttaaatgtcttttgtggcttctcaaataaacatttaggcccttagtttgggaa

SEQ ID NO: 10356 - DNA, 1000 bp, Homo sapiens
ggggacacgggaaaggcccgtgggaataggcctttgaggggaagcacgctgatctcttgttctgcagcgcatgcttgggatggtatgcgcatgccttctctcactaagactaggactgcttacagaatgcgaatataagtatccttatttgggagaaaagtacattttcaagggctggtaaaatgacgtggaggaagggaggatccagggagccttctgaagagtattgtcaggatgtctcttctctttcagccacctggatatgtttcacattttgtttcccaaacaaggactagattggatcccagaagggaatggtttccttagtatacattccgaattcctttgtaagggaaaaatccacttcatctggtctaagaatacgtaagaacaaatgaaaatgttgtggctggagatgttcctgagttaatatcaggatgtttgcctgctggtttctgttttaccaaacaaaacatagctgccaattcatccatctgtaaaagtgctccttgtggaccccctcaagagaagtactggttattttatttgcagaaaacgttttattgggagttgtttactttctgtgactgaagtggggaacatgagggtccctttacggagccctcatattccatgtgtactctgtattttattgaggctgtttcccagtcagaacagcgtctctctttgtttgtcattccaaatctttcagtgtctttagagctctgagggccctggagagcctcacccaacctctcatccttccatggctgtccccacctctgtgcacttatgagtcaatgttgccgcacttcattacatgctgttcatattacagcattataagattttttcttttaaaagcctatcttcttcaatcgggtagtaagaccattgtgggttgaggcatgtttcatacttcccacataatcactccagacttaaaacagaaccggaaatacatgaaataaaaaattatttttctgttctcaaataaaaa

SEQ ID NO: 10357 - DNA, 1000 bp, Homo sapiens; identical to SEQ ID NO: 10356

SEQ ID NO: 10358 - DNA, 578 bp, Homo sapiens
tttcttatggctgcatagtattccatggtgtatatgtgccacattttcttaatccagtctatcattgttggacatttgggttggttccaagtccttgctattgtgaatagtgctgcaataaacatatgtgtgcatgtgtctttatagcagcatgatttatagtcctttgggtatatacccagtaatgggatggctgggtcaaatggtatttctagttctagatgagttcatgtcctttgtagggacatggatgaaattggaaatcatcattctcagtaaactatctcaagaacaaaaaaccaaacaccacatattctcactcataggtgggaactgaacaatgagaacacatggacacaggaagtggaacatcacactctggggactgttgtggggtggggggaggggggagggatagcattaggagatatacctaatgctaaatgacgagttaatgggtgcagcacaccagcatggcacatgtatacctatataactaacctgcacattgtgcacatgtaccctaaaacttaaagtataataataataataaataaataaataaataaataaataaa

SEQ ID NO: 10359 - DNA, 578 bp, Homo sapiens; identical to SEQ ID NO: 10358

SEQ ID NO: 10360 - DNA, 1071 bp, Homo sapiens
agacaataggggaagagatttttatgttttgttcactgctgttttcacagtatgttcaatggctcttggcacagaatagacaatattcgttgactgaatgctattggacattatctgtttattgaattagtgataaatattttaccctacgttgatataaatggacatattctacaggtaacaaccctttatttctaaagcatgatctcaatgtattataaattactgaagtagattagttcttttctttttttttttttgagacggagtctcgctgtgtcacccaggttggagtgcagtggcgtgatctcgtttcactgcaacctccgcctcccaggttcaagtgattctcccgcctcagcctcccgagtagctgggattacaggcatacaccacccgcccagcgaatgtttgtagagacggggtctcgctgtgttgccaggctggtcattaactcctgacctcaggtgatccacccacctcggcctcccaaagtgctgggattacaggcgtgaaccacctcgcccggccgattagttcttaaagtagtaatagacatctcccctccacctttgggaactgcctcctctagggagaagagtaccccgtgagttaggaagccaggtgatatggtttgaatatttgttctctccaaatctcacgtggcaatgtgacctcctgtgttggaggtagggcctggtgagaggtgtttggatcatggggcagatgcctcctgaatggcttggtgtcatcctgtaacaagtgtattcttgccctatttgttcccatgagaacctactgtttaaaagagtctggtacttcctcttctcgctctctctctctctcgcttctgtctcaccatgtgacatgctggctttccttcaccttctgccatgagtagaaggttcctggggccctcaccagaaaaaaatgctggtgccatgcttcttgtacagcctgtgggaccatgagccaaataaacctcttttctttataaattaccctagcctcaggtatttctttgtatcaacaacaacaacaagggcacacacccaaaaagaaaaaaaaaaa

SEQ ID NO: 10361 - DNA, 1071 bp, Homo sapiens; identical to SEQ ID NO: 10360

SEQ ID NO: 10362 - DNA, 1071 bp, Homo sapiens; identical to SEQ ID NO: 10360

SEQ ID NO: 10363 - DNA, 1071 bp, Homo sapiens; identical to SEQ ID NO: 10360

SEQ ID NO: 10364 - DNA, 8637 bp, Homo sapiens
cagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctggtgagtttggtgtggtttcttcctcgcgtagctattgtggagttgtcctttgccttcagcggctggaggcaaactgttggtaccagggaagggtggtgatgaaagttgcttcagggaggcggcctccctagagttaccgttcctgtccggtaacccaaggggctggctttaaggcgagtctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgagtagtgtcgcctctggaataaattagtcacggattggctttgagtttgtgtacttcacctcaaaactttggtgattgagatacgtgaatgcttccaaaaaccttagagtaaaatgatgtaatcaaaaccttttcacgccagaattctaagtaattgattctgcacccaagggaatacaagaaactccaaaaagaaattatatgaatagttttcctttattcatatagctaaggaaaccagtgcttggaatggtaacatgacttgccctttgggtgcccaggtaatacacacttatatacagatgcttctcgacttaacgatggaggttatggcctgataaacccattgtaattcgaaaacctcataagtcgaaatttaggcttgatgccgctgcccagcatcacgagaaaaggacggtttctaccgaatgcatatttcttttacaccctcgtaaagtggaaattaagtcataagtcggggagttatgtagttctatgcattgtaagttcaactagtacaaacaaaattacagtgcttcagtcactactctctcagtccttttctcctccctgtggttcagtaaaagatggtctcttctttaagaagtggaaagtttttttttttttaaactttttgaagaaccatctctcctatgctttccgagaagtgagaagatagtactatactttagacagtgtttcagataatttttaggtggcattgtttagcttttgctcttcacagtttgcagacataatttgatataatctaatcacttgttttatttgggctaatttcaggtgatggctgtaactgcacaagtgaaatcactgacacaaaaagttcaagctggtgcctatcctacagaaaaggtaagatgtactcaaacagtaagcatcccctgacttaatgttctcagtagttctttcattgtatgtttattgtgtcttatatatcctaagtgctcgagcttcaaacataaatatgatccagtttctgtgctgaagtctagagggaagacaaagcaaagcaatagatgtaagtattaatagtagcagtcacattacagagttatgagtctccagccaaagagagggattaattaactgccagaagagcagagggattcaggacaggcttcccagaggaggtgataggattttgaggaataaatgggagggacagaaagaaggaacatgtgcaaaggcacaaaggcctgaaagtatggtgataagggaaaggagtaagtcatttttgtgataggatgtactttctgtgttatgtgtgttgggggtaggaaataagactggaaaagtcactctgaagattactgtaggccaactgaggagttactttcagatttcatctaatctaagacacttattaattgggacatatcacttattgtatatattaagaaaaaatgtgacaggccgggcatggtggctcatgcctgtaattccagcacttcaggaggctgaggctggaggatcgcttgagctcaggagttcgggaccaacctgggtaacatagtgagaccctacaaaagttaaaaattagccgggcatgatggcatgtgcctgtagtcctagccactcaggaggctgaggccagaggattgcttaagcctgggaggttgaggctgcagtaagctgtgattgtgccactgcattcagcctgggtgacagagcaagaccctgtctcaaaaaaaaaaaaaaaattgcttatgacataataccaagatgccagtgactgaaacatgcatcctgatttcagagatgttaaaatatgaaaaccatgtgcatcttaaaattgaaatatgcgcctgtaatcccaacactttgggaggccagagtgggaggattgcttgagcccatgggtttgagaccagcctgggcaatgtggtgagacctatctctataaaaaaaaattagctgggcgcagtggtgtgtgcctgtagtcccagctactcaggaggctgaggtgaatggatcggttgagcccaggaggtcgaggctgccatgagccacggtcgcaccatcgcactgcagcctgggcaacagagtgagactgtcttaaaaaaaaaaaaaaaaaaaaaaggccaggctaagaagaaaaggtggctcacacctataattccagcactttgggagattgtggcggatggatcacctgaggtcaggagttcgagaccagcctggtcaacatggcaaaaccccatctttactaaaaatacaaaaattagccgggcatggtggcgtgtgcctgtctgtaatcccggttactcgggaggctgaggcaggagaattgtttgaactcaggaggcagaggttgcagtgagccgtgatcatgccactgtgctgcagcctgggcagcagagcaagactccatctgaaaaaaacaaaacaacaacaattaaaatattgtagttttcaaatgaaggtctggtagaaccttctcagggattactggttgggggcaatgtggaagaacaactctggatctctcatccctacttaactggaaaactctggtattatctgtttttatatattgagcttttgtcctaagatatttaggccaaatattctatgggtaaatacaagtatgaaaatcattgtaataagagtcactgaaggagttttaagcacaggagttacagcagatttgtgcttacagaaagataactaaaaacagcattcaaaatatattcccttcttgtctttatcattcacttatgttcttattgtccatttttatttaaaaaaaatttaaatctttgtttttctctcatatgcttgtagctcagtttgaatttgacaatgcccaagcacgtcggaagagcctgcttctcaaattcttacctgtttttgtcctgggtaccatgcttttttgttttgttttgtttcgttgagatggagtctccctctgtcgccccggctggagtgcagtggcacgatcctggctcactgcggcctctgcctcctgggttcaagtgattctcctgcctcagccttccgagtagctgggattacaggcgcccgccaccactcctggctaattttgtatttttagtaaagacgaggttttaccatgttagccaggctggtctcgaactcctgacctcaggtgatccacccacctcggcatcccaaagtgctgggattacaggtgtgagccaccacaccaggccttgggtaccatgccttgaaccatttcagtgccttttggagatggatgagttgccagcatccttcttagatccctatatatttgtttatttattgaacaaatacatattaacttatctttttgaccaaagacttttactaggtgctttataggttacaaagttctttcacattatcttatttgggcctcataattattctttgtggcagggaggaaatgtacatattttactgataagactgaggttggcctggtgcagtgggtcacggctgtaatcccagtgctttgggaggctgaggcaggtggatcacgaggtcaggagttcgagaccagcctggccaacatggcgaaaccccgtctcttaaatcttaaacaaagatttaaattttttttaaataaaaatggacagtaagaacataagtgaatgataaagacaagaagggaatatattttgaatgctgtttttagttatctttctgtaagcacaaatctgctataactcctgtgcttaaaactccttcagtgactcttattaacaatgattttcatacttgtatttacccatagaatatttggcttaaatacaaaaaattagccgggcgtggtgggaggcacctgtagtcccagctacttgggatgctgaggcagaagaatcacttgaacccaggaggtggaggttgcagtgagccgagacagtgccactgcactccagcctgggcgacagagtgagactccatctcaaaaaaaaaaaaaaaaaaaagactgaggtcacaaggttaagtgacttactcaatatttgactaccaaacacctaattcagaacttaaactcagtttgtggactctaaatcctttgctctccttctataccacagtagtgttgatctcaagagcttagcatgttggcttaaagacatccagggatgaggtgttggagtcagattgagtttgaatcttagctctacttgtattactgtgttatcttggccaagtatttaacctctctgaaataggttttctcagggctgtgaagtttggaagatacataaaagcccaaagaaaaaaatgaaaaatcagtataatcaccactctgagataaccactgtggtaatatttttgagatttttaaaattataagaataatatatgcaacactttttcacactctaaagtacaccatttcttccttttcctcatctcaccctaggggtagcagttacttgtgtgttgtcttgtagacatttttctatgtgtataaaatgtattcatcatatccccccctacacacacacactttcacaattgaagtcatattacactttctacaacttgtggtgacatggatttaattcgatgtcattatatataaatcattgtttttacctgtatcatataattccattgtatggggggaaattggtaattactttgattaaattaatttaaaacttggcagtctgtggagacatttttgattgttagagcttggaggggccatccgtgggaagaggccaaggatgctgctggaaacctacaatgcccaggacagccctcaacaaaaaatgttctggcttcaaatgtcaatagctctgagattgagaaaccctgttatagtcttttttgggggggtagtttattgattttcctcttctcattgtcttctattaattttctgagcgttgtttctcttgtattagcataactttctcattggccttcttaggcatagctacttcttgagactattccagatacctaatatgaactgattgggaaaatcttgaacttggaaaaacatcccgtttaccctaggctttcatctggttctttggctaaaaccaaatctgtttttctttctgttttgttcaactcagggtctcagcttcttggaagtgaaagaccagctgctgctcatgtaccttatggatttgacccacctcattctggacaaagcctcaggaggatctcttcagggacatgatgcagttttgagactggtggagattcgcacggtatgaagcatttggcttcttggagttttaggtttctaaattttgagctccaagggtatcacacagtagctctcatttaagtgagtcttctcatgtttaaggaaaccaaatgagaaaaggtatttttctattcatttgctctactttgtacatattttaggtgccttatgtggcaccttaatatagggactctggtgtgtgcttcattttgggaaggaaatataatcctgattaactaccatgttgtaggttttggaaaagcttcgtcccttggaccaaaagctgaagtatcaaattgacaagctgatcaagactgcagtgacaggcagccttagtaagtgaggagaccatcatgaagttgtggggaccatcagaaagttccaaattttgtaaaattcattgggttatttatttcaggtgagaatgacccacttcgttttaagcctcatcccagcaatatgatgagcaaggtaaggggttgtagtattctcctgatttttttctgaggcagctatacctagatgagcctcttggtgatcctggataccctgggattctcttaggacttgattttccaacttgtgtgttagaatgctgagtttgagattcccttttttccctttttatattcccaccaccccagggtactccagctttgggttttcttctcacttatctcatgaatgcttcctaaatttgcagacattgtttcttttgtagttgagctctgaggatgaggaggaagatgaagcagaagatgaccagtctgaggcttcagggaagaaatctgtgaagggagtgtctaagaaatatgttcctccacgcttggttccagtacattatggtataaactttggctgctgcctcctcagcatgaactgtttctcttttctctgttcttggataaccctgcttattttcatcatgtagatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggtctgagcccttgcattagaaattattcctgcactctagagtcctgtcctcatgctttatactaatgtgactaagtttggtaccaagagaattaatgttacatagaaaatggagtgaaaactttgggatgatagtttctaagaatcaggagtttggagttcaggatagaaactaggaaaatttttaccccaactgtttagttcaaagcaaaagcagtacattgcaattcgacatgagatttgagggggaaaaaagcagtacaaagaggaatgtatgcagttccacatagtacaactttaagattctgtgtttcactgtcacagctctcacttttgtgcagaaggcaataaaggtaggtttttatagtgacattgtgagtgctagataagttcagggaaggaaagtagaaaagcagtgtaattgaatacagactcgtcaactttgctcaggtgcagtctttgcagttgatggatttgcatgaaaggacacgtttagggaaacctgcttatagagctgaaataaaaaaattttggtgtaatattttaaataatattgtggataggctatggattcatatctagcatgagggaagttctagcacagagcacatttcattgaggaagctcagtattgagcattcaatatgtccttactaaatactatgttgatctgctgtgaaacttcttgagaactccctgaacaagagatgagtagatacttgggcccaggttgtgggctggagctttccatctccatggtctgagcctgctggaaactgtctttctctggcaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggtgaggttgagatatggttgtagtaggatgtgactttcatgctttcagcaaaatgtatgtggggcttattaccatgaggaacttgggaagggatgctggctctcagaaccacagtgccattccatcacttctccatctgtctccaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttgcttatgaattaaagcccctttttgcacatgta

SEQ ID NO: 10365 - DNA, 132 bp, Homo sapiens
acgcctgtaatcccagcactttgggaggctgaggcgggtggatcatgaggtcaggagatcgagaccatcctagctaacatggtgaaaccctgtctctactaaaaaaaaaaaaaaaaaaaaaaaaatcagccg

SEQ ID NO: 10366 - DNA, 450 bp, Homo sapiens
agtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgta

SEQ ID NO: 10367 - DNA, 5324 bp, Homo sapiens
aagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatccaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaa

SEQ ID NO: 10368 - DNA, 84 bp, Homo sapiens
ctcactgcaacctccgccacccaggttcaagcgattctcctgcctcagcctcccgagtagctgggattacaggcacctgccacc

SEQ ID NO: 10369 - DNA, 2454 bp, Homo sapiens
cgagcgcggaggaaaggggtgaagagccggcccccctcctgaagaagactcttcagatccccgcgcgcggggaccgtttggacgtaaccgcctcccgtctcggtgcccgtccatccagccggggttggccctgccactgtcgccacatcccgcctccaattcccgccccgcttccgctcggctttgacaccgcgcttcacagccaccccggtccattcgacccgctccgcacctcacacacggcccgccggcggccgccgccatcttcgcgcgcccgctcgccctaaccccgcccccagacgccatgcccacgtgaccgctcgcccccggacccggagcgtgggcggggatttcgtcacgtgacgttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctccta

SEQ ID NO: 10370 - DNA, 309 bp, Homo sapiens
ggtggctcatgcctgtaatcccagcactttgggaggtcgaggcgggcggatcatgaggtcagaagatcgagaccatcctggctaacacagtgaaaccctgtctctactgaaaatacaaaaaattagccaggcgttgtggcgggtgcctgtatccccagctacttgggaggctgaggcaggagaatggcatgaacccgggagacagagcttgcagtgagccgagatcgtgccattgcactccagcctgggcgacagagcgagactccgtctcaaaaaaaaaaaaaaaaaaaaaaaaaaaaaaaagtgggg

SEQ ID NO: 10371 - DNA, 306 bp, Homo sapiens
tttttttttttatttttttttgagacagttttgctcttgttgctcaggttggagtgcaatggcgcgatctcggctcaccgcaacctccacctcccaggttcaagcgattctcctgtcccagcctcctgagtagctgggattacaggcatgcgccaccatgcccagctaattttgtattttgagtagagacagggtttctccatgttggtcaggctggtctcgatctcccgacctcaggtgatctgcccaccttggcctcccaaagtgttgagattacaggcgtgagccaccatcccagccttgttg

SEQ ID NO: 10372 - DNA, 6149 bp, Homo sapiens
gctccctggcattgggcagtgttacagtgcactcttctgaacctgaagtcagaattcctgagaataatcgtgagttgggaggggccatggagggtgtgagggtgagcagttgccggccgcctggggatctagagagcacccagcccagcctgcagtttggggctgttccccatctcgtgtatttgctgctgcttcttccttcggctcattttgaccctgtctgcagctgtgaagttgtcctgtgcctactcgggcttttcttctccccgtgtggagtggaagtttgaccaaggagacaccaccagactcgtttgctataataacaagatcacaggtgagttgcttctcctccttcctgattgcctaggttgtggagggattatcatgcctggattctacgatccagactttgtgcccttatcccagggcacaccctggggctgaagtcctcatggccttcctacccccctttctgggggaagaggagagcacttgcgtaccttggatgcccccttcatcagcctcccttagctctccagttcactctgtccttgctcttgcctcctcttgtggtagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttggtacgtgccccatgtcttctgggtgggcctggagttagttacttctcatagcaggctctgctgcactttggagctctttgatggtgagaatacccacaggtgggctattcagagtcctggagctgccagagagggagatgagcccctggttaggtggcagccaggggcatggtgagagtaggaggcttgagctgagtagttgggggtaccattgtagttggttacttagactcaagcagcccccaccctgtactcagcaccttctgtctttctcttccacagtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtatgtatggggtggtggtgaaagatgtgtgggggatgcagttatagaaccccaaaaggtgggaggaagaacaggcaacagggtgaacttggaactggggtcaagagacattaaaaaatgtctattttgcttcttcagcaggaagccaatttgttttccttcctcaggtctttgatcccctgtcagcctctgatactggagaatacagctgtgaggcacggaatgggtatgggacacccatgacttcaaatgctgtgcgcatggaagctggtgagagttagggcttgagcccagacctggggtggggattggggtctgcttttcatcctgccattggtgatactgtaggtgccgtgagtgagtatccccgtgcctgacttcttatttgtgtctcgcagtggagcggaatgtgggggtcatcgtggcagccgtccttgtaaccctgattctcctgggaatcttggtttttggcatctggtttgcctatagccgaggccactttgacagtaagtatctgcccccagaggctctcctttgtactgcccccatcccagggcctggcatgggtgtcatctgagtactgaccctgatactgtgctcatgtgtgtgggtgttgtcccctggggaacactgatcacccatctaacaccaagagctgggggcctgcccctccatcttcccaagccatgctgtcttctgtcctgctgacactcatgatcccatttcttctctttcaggaacaaagaaagggtgagtgaggtgctgtcctggggttctccaagtttgagagcatggatgcatgtggtttgaagctgaagtgggcctaggggaatgggttgaaggcagaagcaaccagtttggagggaaggcatttggatatccagccctttctctgtggccttggccctgggtctgtcctgttaccccacccatacctgtctgctgcgcactctgtgcttctgtagcattctcgcttctggcctttaaagttggcaaggggaggttaataagcacctaggtggctgagtgtctctgtcttctggcttgttcacaggacttcgagtaagaaggtgatttacagccagcctagtgcccgaagtgaagtgagtatgcctcccctgggcaggggtgggccacctggggctggagtgaggagatttctagcccatgtttatgtgttttggggattatcagctaaagaagactattgagagttgactggatgttttatttctgcagggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctggggattacgggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattctttagcttt

SEQ ID NO: 10373 - DNA, 3667 bp, Homo sapiens
tcagcttcgcatcgaaggtgccactttactctatattcataagctgtgccatgtcttctttaccagccttctcgagactgcaagagaatttgagatcgattttgcaggcactgacagcggctgctactctgcctttgtggtctgggcaagatcagccatgggcatgttcgtggatgcttttagcaagcaggtgtttgatagtaaggagagcctctctacagcagctgagtgtgtaaaagtggctaaggagcattgccagcaactgggtgatatcggactggatctcaccttcatcatccatgcccttctggtgaaagacatccaaggggccttgcacagttacaaagaaatcatcattgaagccactaaacatcgcaactctgaagagatgtggaggaggatgaacttgatgacgccagaagccctgggtaagctcaaagaagagatgaaaagttgtggggtaagtaactttgagcagtacacaggggatgactgctgggtgaacctaagttacacagtggttgctttcaccaaacagaccatgggcttcttggaagaggccctgaagctgtatttcccagagctgcacatggtacttttggagagcctggtggaaatcattttggttgctgttcagcatgtggattatagtcttcgatgtgagcaggatccagagaagaaagcttttatcagacagaatgcatcctttttatatgaaacagtcctccctgtggtggagaaaaggtttgaagaaggtgtggggaaacctgccaagcaactccaagatctgaggaatgcatctagacttattcgtgtgaatcctgaaagtacaacatcagtggtctaatgcttgggtctgtttatatgtgtatatatgcagagagagagcttatatattatttatatttatattaagttgtattagcatactctatagtttcaaacacaacttgaaaattaaaagtgccctcttaaaaatacaaaaatcaaaaagaggaaaataagttaaattaagcccaagtaacaaaaatactggaattattaaaacgtatagtatgctagctatccttttaaattatgctaattctcttcttctgaaattatggtcacactatatactatagcatttcggttttatcctttgataaaacttttcttttttcttttttttttttgagacagggtctcaccccgtcgcacaggctggagtgcagtggcaaagtctcgactcactgcagccttgacctcccgggcccaggtagtcctcccacctcagcctcccatgtagcaggaaccacaggcaggcaccaccatacccagctaatttttgtattttttgtagagatggggtttcgccatgttgcccaggctagtcttttctttcttctttttttttttccccacagtatatattatacagcagtcataatatctataaatacatagagtttatgttgtgaagtttcccagttcactgaaatgttaggtttcctaaagggtacagtgccgtataaaacaacctgcctcatatatttctcctcaaaacgttggactatttgggaaaaggaaaagagttgggaaaattggttttaaggtaagttttagtcaaaagaattctttcttgaaactagctggtttgtggattcagatactctgatccttacagaatccaagaggaagctttcataaaaacaattcagcaaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatgcaaatctcagtgttctcactatgaccactctgagcagagatttggttttgtttccttttgtaacaaagtgaaaacaggtgagacaatgtgcccaaaacaaagggaagaagagaaccttctgtgactcctaaaatgttccatgctgcatttttgtttcattttttatttttccttgctttgtttttaaacatgaatataatgcttacttcaaattgtttagtaaaacaaaataactaaagaaatgtgagcttcccaaggtttctaaactatcgctgttgtatattctatagcgttccttattctttgagggaaactgtgcttgctgtgatccattttgtctctagcttctagttgtgattcttgtccataagcaccaaatttgatgcccatgatttcaaaaggtcatttcttttatctgaatgaaaatggtggtactaagactgtgaaaattatgtgaaacctaaagtagttgccaaagtggctcagggttgtaaaattcattgacttaattattcatgtgccagatcaacccctttattttctctttagctgtgcatatttaaaatattggaaagtatcagatttacagattttctttgactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttctgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacatgtactataaaagtcagtctatgtacatactgcttattgatgtgctgtgatatgagggaatctgaaatgtttcataaaaataaagcttaaaaattgtcttacactggataaaa

SEQ ID NO: 10374 - DNA, 87 bp, Homo sapiens
agcctcctgagtagctgggattacaggggcccgccaccatgcccggctaatttttttatttttagtagagatggggtttcaacatgt

SEQ ID NO: 10375 - DNA, 17032 bp, Homo sapiens
ttttaatacctatttataagtatttattaaaatgttttaatgctttaaggaatatcaaaatttgtgaacagccaaccagtctaaaacgaaaagggctgctaacagtgttatgaatggtgaacaactaaaactctcatacattgctggtaggagtgtaaactggcagaatttactaaagctaaacagaaatataccccgtgactcagcaattccattcctgtatatatacccaacagaaaagataagaatgttcttagcagcattatgcttaacagccccaaactggaaataattcaaatgtccattaacattagaatggatgaataaattctagtatattcatacaaatgcaagagcaatgaaaatgaactcctgctatacataggaacaaagatactacattataaaattaaaaaataatctgcgacgatggggtgaaaacagtggggacctctggaggtggtgagggtcatgggtatcaactgggaacagacacctataggaagccttctgtggcaatggaagtgttctctaacttgatccgggtggtagttacacaggtgaacactgtaaaagtttacccagctgtgcacttaagatttgtgcacctgtattacaacaaagtgaaggaaaattgcaacaagaaaaaagaaaacttgtgaacaactgtgttagggctatgccaacagcatgtacagccacaagacaaaaagcaaactgataaaagtctctttgtcctttccctataacatggaaaatattttttttaaaaaagattacttaaaatgcacaaatggtattccttttattataatgttttaaacttggcttaaagttcaaaatactatttccagataactttccactgttacatcaactaggcaactttgttatgtttatgttatatgtatcagttacttatcagcacagaattttaaccactctgctaaattttgagaaaacagctaaactcaatataaaatttggcctacagaattatagtggctatttgttactaaaaatattccaaaagaaatttacttattttactatattccatattctttaacttaaaatctgctgccactgtttagtaaaagtgggacaaataaaattctttaaaatatagaaaatacagttcctgttaagattttgcaaacaaaaaaattaataaataatacaatttgagtactctaaaacaatatactttgtagtctagattgtggttttggtcagtatgtctgacactatgaagatttacatcagttcagggaatgagttctaatactattaataaatagtcaatataaccaaacacctgacaggattccccatatgaatatttttaggaaagtatacaaataaaaagattaacaggtttttaaaatccttaagagcaagaaagaacaaaagtatctaaaacttatacacgacaggcagaacctgggttacagtatacctaaggcaagagtgaatgtagcaccctgagacacaaaacatcttaaaattacaatcttatatgcgtatatataaaataggacactttctattggttatgtgaactagattataacctacaaatcttagtattaaccagaacttcctgactggctgacatagcacattagtgagataatacaggtggtacttgagactttgaaacctttttcaaagactttcttcgcttttgactttgatgctgtcaccttcaaggcaccagtccaagtgctcattaatctgagactccagaacttcattctgacaaactgggcaattaaccattttgctctgactggatgaactgctggaattctgagctgtggttgtactatactttggatcattaccactgctttttatttgctctttcttgataaaaaaattgtcaaaaacagtcttatcttctagcctaggtcgtttatttgggaatgtatcttcagacccactcacatcctgggatggcatcacagatgctgattccgttacttttgaagaatttcttagggatatcttagaagatgaaacccttctctgagaactagaagagactgagtttttagggatgttgccaactgttacacttatccttggagatccattcacacctctgaaagccttttggttggcaaatgatactctaggaaagtagttgcttagaacattttggtgactgttactaacagcaggggagaccagatgagaatttttacttgaaccattctgttcaaatttcaccttgattttagaattaggtcttacagcatttgctgaatggttttgatttaaaagatcttgggttttattaatggcatgtgaagtgatcagtttcccaggtgaaggtaaattgcttgtttctcctagaacatatcctttcccactaaaagggattactagctgggcctcacctctgttgggtttatctgccaaaaaagcaaagaagattgttatgtaagtgcctcaactcaaaagaaatacagtaacaaacattaaactaatgtacagttttctcaaaatgaagaactagtattttattccatcttacatccatacaatcctattaatgggaggagggcaatcttcagaattcaggagttctgatattgagagaatataaaggataaaaaaaaattctctcatatttaaataaagaatcttatcatgccaaagaccaacaacaaggcaacatttaccttgaaaattgcttagtgtcctttatgtgtaattccaggagggaaaatctgctgcctcattcttatctttccttctactcacgaaaatgaagatacggtctttccatatcaattcatctatagctctttcactcaataattaaagatttgggaaatataacctatgttcttgggtcaacaacttcccaagggaagaagcatcttcagtaactctgaacttcacaggaaaagggtaaatcttgaagatgaagtactggcaaatatatgtcatatccttttcccattctttgaatgaacatacatacatcaatagagtcacttggatagaatccagctgataggaaggggtgtagttaggacgtatattccgggcattgttacttgaattattgtttttattttgacaatctttttgccttctgtttcctaataactcagtgagtcaagatagggaaaggaactttacctcaaatattatcagagattgaattttgtttctttgaataaaaagaaactgaaaaaagttaataaaaataaaaatatccatggaaactattcctacttttacttacttctgtacagagcaaagtctgttttcctaccatcatttcatggacagtgggattttttccttaagtctacacttgaagacttctacaccagaaacgatccttaagtttatcttaataccagttctctgaaggacagtattgtctttacatcatagctatggtcacataaaaatcagaagaatatacacgaaggtacctttattctctgcggccaatactggttcctttcctagttttgcctttcctttgcctttttttgagtaattctctggttccttgatttttatgtaagtgcctccacaggttttctggtgctcagcccaccaatagtcatgagcagagggttccctgttagtagctcgtttgacatagccgtaatacggtggcctgtgctggcacggcccattgcagcgccaccagtgtcgccgatactcatccacctcatcgtgaaaagtatggtatacctgagtggagacagaatttttagtattcaataagcaagttaacaactgcaagaaaacaatttacataagcagtcttttttttttttttttttttttttaatttttgaaactttcccagagctttctgaaaagttctattttaggagagaaagcaactatatttagtttctgttcaaaagttgattttaatgggaaacagcagcagttaatacttcataaactgtgtaaagatagatgcacatgggattagaggacaaaaaaatcttttaaaaacaaaaccacagaaaatcttcatgaacactaaaagtttcagaaatcaaatttgtaaatgatcaaaaattaggataaagataagattttatgtaataccatactaaaataagaatcattcccactgctaaattgaagttttccctataagtaaaaatagcaaagggttctaaaggactacattactccctataaatgcctgactgacgctaacaacacaagtatcttacccagtgaagcttctgctaagctcactctccacattctccaagttctgtgcttatgtctctgtaataagccttatgaggtaccattttatctgtttataaatatttctattaccagactgaaaagttctccaggatctgaatgttttaattttttgtgtccctagtggctaatatagtgcttttggcaccaagaaggtgctcagtcagaaaagcatcattcattgagtcaaataaaattctctgaagtgtgcttttcaggccttaagtaggatgccttctttttcaccctctagacaaaaatcctatttggaacccaagcagaaaacaggtaagggaaaagacctgactgaaaagagggtcagccctcccagcatggtggcactgaagactatagagcaccatttgaaatgactcctaaatgactatgggcaccttattcttctgccttctcagtggaactctctgtgtaagagtgagaagcatctgtatgtaagattttggtgttttaccaaagacatttagctttctaataaattccccttgtgggaaagaatgctaagctttctataactctatagatagttttaaactcactatcgctccatcctaagcaaaaaatttctacttggtaagcatgcaaagaatgcacattatattaaatgcagaagggactgaaggacataggttttaaggcaaagaagcacgggaaaccacgcactctattatgttcagaactcttaattcattacccaaaaagagagacaaatggatctgttttgtttgtttgttctgtgacatggacttgctctgtttgcccaggctggagtgaggtggcatgaacctggctcactgcaacctccgcctcccaggctcaagtgatccttccacctctgcctctcgagtagccgcgaatacaggcgtgagctaccacgattagctaatttttgaattttttttgtggaaacaaggtctcactaaattgcccaggctgatctcaaacacctgggctcaagttaccctcccacttcggcctcccaaagtgctgggattacaggcgtgagccaccacacccagcctggatctgttctgcttccaattcctgtaactcctaacgcttgggaatgtgacttttaacaatgtagtcactaaaataaaattactctacaatgtagataccctgcagagttccttataacaggatgtaacctgtaaaagcaaggagtgttcactccttacaacctctcctaaataaaaacacacagatatctaagataaaagaacagatactcttccagctgaacaatgggacgtatacaagggctttgcttaaagtataagttctggttaagaaacttaatgtattttatacaagcaagtctataattctcttgctaacccggattttatgtctgatttttttaaaaactgcaagacactttcctaatgttgaagtaactgtgtctaataatgaaatgaagtctttagaaaattaaaactgatagctagaaaatagtaatacatggagaggccaggcatggtagctcatgtctataatcccaccactttgggaggctgagatgggaggatcacttgaacccatgagttcaagaccagcctgggcaacatggtgagaccctgtctctaaaaaaaaaaatttttttttaaattagcttgacatggtggcacacatctgtagccccagctactcaggaggctgaggtgggaggatcacttaagcccaggaggttgaatctgcagtgggctatgaatgcaccactgcatccagcctgggcaacagagcaagaccctatcttaaataaataaataaacaaaacatggcggttgagcactgttcattttctatcacagtggattttgttgccttttaaaggaaggaaatacccaaacataagaaagaatttaatctatcctattaatattcaattcagtacattatacaccttatacagatgtactataaagatgggcaagacctaccctgcgttcaaaagtatgaaagtagcataaaaaattgtaatagcttaaatatctgctgaggattcaaaagagggagaaatgagatgccactggaacgatgaaaagcattcggacacaaaacagagcagtggcacgcctcagggaagctacacctgaggaaaggcagggaggtcaaaagtgcagttaaagagacaggacacaggcagcagagttggaggcagtaaaaaaggaacaaggttatttaataaaatgaatacaataaaactaatatttaattagtgtcagattgggctaaaatgttttgatgtgctttctcctttaatcctttctcctcacaaggatccaacagataggtattgttactactctcatttgccatgggtataaaatgaggcataggaaagttaataattggtggagccaggatttgaatccaagcagcctgacgcctccagctttttgaacctgaggctttgctatctcctacaatgctatacagagatatgaatcaaagaagaattctgatgagggaatgacatctgcaatggtagcaggatacaggatggactaaaaaagacaataataaggaaacaaagttaagagatcatgatgattccagaagtgacgtactgcaggcctgaattacctgtgtgtaaaatgttgactcagaagaggtcagaggcctcagggatatcactggctctgctgccattccaccatgtagtcccagacaagccaatttgcttctctaggcctctcgttcgctgtggaaaatcctcaaagatacttgtttctacctagttctctacttttaattaaatctcaggagttattgaataaacaactactaaacatcataaatagatatggctttctataccgttatattggctccagtcaggctgttgatgcgatgcatatgtttacaaaattctggaccatgcccttctcggtctttgtcgttattagtgacaaataaataggcatgtatcatttcatgcaggagggtctggaacataaaatattcaaattagttttagagtctgtatgacactttggaaaatataaattttcttattctatctggtgtctaaccttttctgtatcacaggcttccttcagaactgataaaactcattctaggccgggtgcagtggctcacacctgtaatcccaacactttgggaggcaaaggtgggagggtcacttgagcccaggggttggagaccaacctgggcaacatggcgaaaccctgtctctacaaaaaaatacaaaaattagccaggtgtggtggtgcatgcctgtaatcccagctacactcaggaggctgaggtgggaggatcctctgagcctggggaggttgacgctgcagtgagctgtgattgtgccactgcactccagcctgggggacagaatgagacactgtctcacaaaaacaaaacaacaacaacaaaaaacccacctcattctataaaaattatataagcactcattcacaaaatattgcatatgagttgagcatcccaactctgaaaatccaaaatgctccaaaatcagaaactcttgagcaatgacatgacactcaaaaggaaatgctcattggagcattgcggattttcagatttgggatgctccacctgtaagaataacacaaatattccaaaatccaaataaatctgaaatccaagacacttctagtcccaggcatttcagagaaggggtactcaaatttgtgtaacatctaaagctctgaaaatcacaggttaagaactccctgttctaggaagacctttttgactatatatcaaaatccagaaaaatcaatgaattcaactacataaaaactttaaaattcttttttttttgagacagggtcttactctgttgcccaggctggagtgcagtggctcaatctctcctcactgcaagctctgcctcctcggtccaagtgattctcgtgcctcagcctcctgagtagctggcactacaggtgtgcaccaccatgcctggctaatttttgtattttagtagagatggggtttggccatattggcaaggatggtcttaaactcctgacctcaagcaatctgcccgcctcagcctcccaaagtgctgggattataggcgtcagccactgcacccagacaaaactttaaaattctataggaaaaaaacaccaagtaaaaagacaaactcagaaaaatatatgtataactcttatcacaggctattcctaatatacaaggagctcctaatgtcaacagggaatgacaacccaatttcaaaatgggcaaagaccatggagttcacagaagaagtataaatgacccacaaacaaatgaaaaaacgcccaacttccggatcacgaggtcaggacattgagaccatcctgctcaacatggtgaaaccctgtctctactaaaatacaaaaaaaaaaaaaaaaaattttggctgggcatagttgcgcccgcctgtagtccgagcagtatactcaggaggctgaggcaggggaattgcttgaacctgggaggcagaggttgcagtgagccgagaatgcaccactgcactccagcctgatgacagaccaagactccatctcaaaaaaaaaaaaaaaaaaaaaaaagaaaagaaaagaaaaaatgcccaactttatttataaaaagagaaatgcgaattaatactacactaggatggtcaggcgtggtggctcatgtctgtaatcccagcactttgggaggctgaggtgggaggattgctcgaggccaggagttcaaaaccagcctggtcaacatagtgagaccttgtctctacaaaaaaataaaaataaaaataaaacaattagcttgtgcatctgtagtcctagctactcaggaggcggagatgggaggatcacttgaggccatgaattcaaggttgcagtgagctatgattacctccagcctggacaacccagcaagaccctgtctcaaaaaacaaaaaacccccacaaaaacccaacactacactaggatgttatttattgcttatcaagattggtaaaactcctaaagtttgacaccattagtaaagctaagggaaaataaacattcctatatactgctggtgggagtgcaattctcctatggaaaatttggtagcatctaacaaaattacaaatgcatttgtcttctgagagagcaatacctagactagcatgcaaggtcatatgcacaaggtgtattcactgtgacactgcttataacagcaaaagattagaaataactccagtgttttatacatccatataatggaattctatgcagccacaaaaaagaatgagaaggatctacatgaaatggtttggagaaagctatagagcgtattaatgaaaaagacagggggctgggcacagtggctcatgcctgtaatccccgcactttgggaggccgaggcaggtggatcacctgaggtcaggagttcaagaccagcctggcccacatggtaaaaccccgtctctactaaacacacaaaaattagccaggcatggtggcgggcgcctgtaatcccagctactcgggaggctgaggcagaggcaggagaatcacctgaacctgggaggcagaggttgcagtgagccgagatcatgccattgcactccagcctgggcaacaaaaaaaaaagaaagaaacaaagaaagaaagaaagaaaagaaaagaaaagaaaaagaaaaagacaaagtacagaagaatgtacatagtattttgtgtaagaaaaattttgtatggtggggaggaggaataaaaatgaatagaaatatttgcaaaacagaaaaatgaaaagaaactaacagctcctacagcaagtaaggagttcaagatagaggaggacactgaacaagacatctttgtgtatagctttctacagcttttgggttttgattcagaaatcatgaaaacttgaaacaaacactaaaacctactgctcattccacaccaaagatgcacaagtttctgtgcaaaattaacaaaagcatttaagattgctggggtttttgctctaaaaaatataaataatttttttaagcaaaaatcagaaagatcttcaaagacatacctttttcatgatcctccataatttttttaaaaaacaatttccatcagaagaactagactgtcattaatgaattttagtcttataaaattatgctgaacagaaaaatgagagaatcaaacattttaacttggtcattcatatatccctctaaaaattatcaactgtatctcttaaaaggaactttatttatttatcttattatttctcagagatggggtctcactttttcacccagactggagtgcagtggcatgattatatttcactgcagcctcaaattcctggcatcaagggatccctctatctcatcctcctgagcagctgggattacaggcgcatgtcaccacacctggctaattttttttcaattttttgtagagacaaggtctcaccatcttacccagacaggtcaactcctgggctcaagcaatccatctatctgattacgtgcatgagccactgtacccagccagaactttatttttcaagtaaatgccgctcaacgaagaagactcaaattcaagaaaggtactgcaaaagtttctcaatgttctaaattagagcaatgataaagatctattctcataaaggagaaacaaatttaggttcctgatttttggttcaatttaattaaacattaaaaaacatcttgaaaatggtactgaactttttaaatatctatcattttccatatttagtcttaattcaaggatctatacacaacacagtcccaaaatacctctgttttccatgactgttctatcgggttaaaatgaactacctctagtcctaaatatgcccccagttgtctgaactcacttttgttcacattattcccatgctttctgccaagagtagcctcctgtcctatctctgcttgtcaaaagtacaattcgtcctttaatgctcacctctccatgttttaatcgcaggagtgatgagttgaatggtaaaggggacagaacaagagccttagagtcagggaaactggaacctaaacccacaatcacagcatgagacctgggacaggctccaagtggctcctcatccctaaaatgggatatcctcattttgcatggctgtggtaaagacgacgtttagtccaaagtctgacacacaataggtgctcaatagtgagcagcaggagtggtgatggtagtaacaaaatgtacagttataaagcttttcttgacctcctcaaccagataaagtctgttccttttctgaacccccttctctatgatttaggtaactacagttgtgcctcacttggcagggatatgttctgaaaaatccattgttaggcaattttgtcattgtgcaaacatcttaagagtgtacttacacaaacctaaatggtatagcctatgtaatatatatatatatatacacacacctaggctatagagtatatatacctaggctatagagtatatatacctaggctatagggtatatatacctaggctatagagtatatatacctaggctatagagtgtatatacctaggctatagagtatatatacctaggctatagagtatagcctgccgctcctaggcaacgaacctgcacaggatgttactgtactgaatgctgtaggcaagtgcaacataatggtaagtatttgtgcaactaaatataaagaagaaaaaaggtacaataaaaatatagtcttggccaggtgtggtggctcacgcctgtaatcccagcactttgggaggctgagtcgggcggatcacgaggtcaggagattgagaccatcctggctaacatgatgaaaccccgtctctagtaaaaaaaatacaaaaaattggcctggcatggtggcgggtgcctgtagtcccagctatgtgggaggctgacgcaggagaatggcctgaacccgggaggcggagcttgcagtgagtggagatgcgccactgtactccagcctgggcaacagagcgagactccatctcaaaaaaaaaataaataaatatagtcctggccgggcatggtggctcatacctgtaatcccattcactttgggaggctgaggcagaaggatcacctggggtcaggagtttgagaccagccaacatggtgaaaccccgcctctactaaaaatacaaaaatcagccaggcgtggtggcgcacacctttaatcgcagctacttgggaggctgaggtaggaggatcccttgaaccagggaggcggaggctgcagtgagccgagatcatatcattgcactccagcctgggcaacaagagcaaaactccatctcaaaaaacaaaaaataaaaataaataaataaataaaaatatggtcttataatcttatgggaccactgttatatatggggcctgtcattgacgaaaatgtcattttgtaactttctgccaacaggaaatgctcacttgatactattatacattccccattctcttctcacccactacttaaaaacatttttttctcatgtgtttatgtaatcatttacccaatacatattcattaagcaactcttccagttagggctccttctaaggctgatttggttaatcatgctgttcaactttttaaaatgtgtattatttttttccgcttattcattgggttactaagaaggttgtgttaacattcttcaagtatgagtctgggtgtcttggctgacacctgtaatcccagcactttgggaggctgaggcgggaggattgcttgggcctgggaggttgaggctgtagtgagacagggtcttgctctgtcaccccaggctgtagtgctgtggtgtgatctcggctcactgtaacctccacctcccgagttcatgcgattcttgtgcgtcagcctcctgagtagctggtactacaggctgtgtcaccacacgcagctaatttttgtatttttagtagagacggggtttcaccatgttggtcaggctggtctcaaactcctggcctcaagtgatccgcctgtctcagcttcccaaagtgctgggattatgggcgtgagccaccgcacccagcctgattgtatattctttttgcttctgctaatttatgcctcataaaatttaaagttatgttattacttttggagagattatgtattgttgcttaatagattattttattattataaaatatcccacttttcctctagtaaaacttcttcccttgaagtctttagtctgatactaatactggttgaacatccctaatttgacaatccaaaatctgaaatgctccaaaatctaaaactttttgagcacttacaagatgattaaaggttaagttctaaggaaatgctcactaaagccatttcagatttgggacttttggattagggaagctcaaccagtaagtataatgcaaatattccaaagtaaaaaaaaaaaaaatctgaaacacttctggtcccactttggataatgagtactcaaccttatagccacaatagttttctgcttttaagtgtttggatgattacttttcctcatccttttaaacttaaaataagtgtgtctttactgtaagcatgtctcttttaatctagcatgccattccatgtatttaatggagtgtttagtccacttacatttaactgatattttgtttacacctacctttctctttatcatctgagctctgttctttttcattaatcaagtatttctactgtaccactttacatttagtagctactttttaaacaaactgtggtaaaaaaaattaacaaaattccccaacttacccatttttatgtgtacagttcagtgttgagtatattcacactgttatgtaatccattgccttttattatccttaaaaacagcatctctcatctccaagcatgttttaacatgcttcccaccccatgctcagaaactaccactgtgctcttttgtacagataattctttctttttttttttgagacagagtttcgctcttgttgcccaggctggaatgcaatggtacggtctcggctcactgcaacctccgcctcccgggttcaagagatcctcctgcctcagctcccactgctccattctgctagcagaagtaagtaccagctctaaatgtgaagcgtgccctcacactggtttgtgctgccagctcagctaggtgtcctgagagcacagcagtgttgcagcccaactgaggagaatcaaaatttgtgtttctcaacaggaacatgtggatcctgttttctctgtttctaaataagtaacttaagccagttacttaacctctctgaaccttaatttctttactcataaaaatgaaaacagcaacacatgaacataaacagggctgttgtaaaatcaaaacagataatatacctagaaggcttttatttttttgagacagagtcttgctctgtcacccaggctggagtgcagtggcgcgatctcggctcattgcaagctccgcctcctcagttcatgccattctcctgcctcagcctcccgagtagctgggactacaggcgccggccaccacgcccggctaattttctgtatttttttttttgtagagacggggtttcaccgtgttggctaggatgtttttgatcttctgacctcgtgatccgcccgcctcggcctcccaaagtgtcgggattacaggcgtgagccagcgtgcccggcccctagaagccttttttttgttttttttttttttactatgaagcactataaaaaacataaggtgttcattattgtttgccccataattcaagctttcactgagggcaaagtgactttttttaacgatacatacaggcgaattcacagcagtctaaatcattgacaagtatttgtaaattactgcgctaggaagcaagtttacacgaaaaatacctctacaagatcctttcttggcctcaacttcaaaaggggttcgctgagacggatggaacacattccacccttcccttcatagctgcatatcccagcacacctagaaaacaatcaccataaaaatgtgttacattggccaaatatgcccaagtccttacacattcttgggcagttcacactaactcagttggcagatggctttcatgaaagtataccccccttggttagcagatacttgcatttcacctaattaattagttacaacccccgcgggcgcctcccgcgatggctccgatccccgccgggcaaggaaggaaagcagcgtgctctcaccaccctgcttgagaaggtggaaggctgcaggcacctgctagagacgccaggaccgtacctggtgtacaacggggacctagtggaatacgatgcggaccacatggcccaactgcagctccccttgccctagctaggctgcaacagctcaaaggcaatcctattctgctactcccagtctccttccgacaagttacagttcggtgttattaacaagcagatatctccagtagcatatctccaaaatcataacagacgcctgtataaaggaaattggtactttaaacacaatttaatatcatatcttaatttgtttgacagtaggttgttttctatcaactcaaaaacaagcatgctgggatacaactgtatcttaaacttaaccctgttcacgtgcaggagtagattattatttcaaatagggatttctgaaatttagcgtgtagaaaaagaatcgttttaaaagcatcactgaagatccccaatgcaacacacgagctaactaaagtgggtttcctaacgggaatagaggaggagaacacacatcctttggcagttactctgcgtcctcagcactttcttaggtgcagatttggttgcttctcccttctgggtcctacagcactatcataaggcaaatcaggaacttgttattttcaagtgaagtgagattcaaataaaaatctcttttttgttacggccctgagtccaaccgtggcggtgtggtctacacagctttcttattgttcgagtgggagaaaaggtaaggaagacagaaacacgccgaggcaggaattgccaggtccaaaaccagactcccctcatttaacgccccctgggaccgtcggactagagaaaggagagaaaaccagggccgggggctgcaggaaagctgccagtcccgcctctttccccagcggggctcggaactcacagggtcattcgcacgctccacttcacctcgacggcctccagctggccccagaagaattggtcgttaaactgaacaaacagtgcctgcaagtccggtgtggggtccaccaactcccacgacgcgtccactagcgacagggactcctgggcatgatcgcgctccgcctcctgcaagttccactcctcctgaagccgcagtgccaacatcaagtcatcatccatcgttgccaggatcacaggcggggtccgccggcgtcaggctggctccccagttacgccgcgaccccaagccgcctagccgaggaccaggactagctcctaggagatgccggctctcgagacggcccgtcaatcccgcgagagttcgcggaaacgcgcttgagaacgagaacggagcttaccccaaacgccgaagccaagattctagggctttaaaaaaagcagtcagcatgacacctcctagtgggcgcagaacctgggctcacagggctcgggccctacgaagctttcaggaagctagtttcagcctttactctttgccggttatttcaaacctcaacgtcacgctcggttcatgcgcagtaccgaaatttctctcggcctctccc

SEQ ID NO: 10376 - DNA, 1772 bp, Homo sapiens
gactgcccgcagcgggccggccgccacgagtacgcgctgcccctggcgcccccggagcccgagtacgccacgcccatcgtggagcggcacgtgtgcgcgcccacacgttctctgcgcagagcggtaccgcgtcccagggccccagcccggccacaaacactccctctcctcgggcggcttctcccccgtagcgggtgtgggcgcccaggacggagactatcaaaggccacacagcgcacagctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcctttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaattttcagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaaatggtttactttgtagagtttacatggttttatgcgcacactaattgtaataaactatgccaaaccaaactg

SEQ ID NO: 10377 - DNA, 120 bp, Homo sapiens
gctaattttttgtatttttagtagaggcggggtttcaccgtgttagccaggatcgtctggatctcctgacctcgtgatccgccatcctcggcctcccaaagtgctgggattacaggcgtg

SEQ ID NO: 10378 - DNA, 7225 bp, Homo sapiens
cttgaaggtggagctcattggttgccagattacacaaggtagggctcagggcaagccagtgagttactcaagtttggtcatattttttttcgcctatcattgttactcatgtggttttcccgacatccctcctctctcaggtaatgattcattggtgtggcgcaagacaagtcaaagcaccagtgtttcaactaagaaagaagatgagacaatcacaaggcccatcccctcggaagaaacatccacaggtagagccgtgattgtctgtggtttcataaggagcataactggtaacccacccaatatcagtaacttcaacaaaatttctttttctctgtcatataaacattggaggtggatgatccagtggtattggcacatatgtaaaatgatgtatgtttacagcttttcattgcagtattataaatagaaaaagattaggaatgaacttatgtgcccttcaaacactaggtacatattttgtggaaaaataaaacattagcacatccatgcagtggaacactctgcagccatacaaaaaaaaaatggaaatatagaaattggtaatatagaaagctgtctgagatatagtggcaacttaaaaaaaataagcaaaatatagaactatctaagtagcacgccaccctttctgcaaaaaggagaaacaaagaataaatattcattccagtatctctagaaaaatttcaagaaaacataatgcggctttctgtgaaggaggaacagaggtaggagggacacattccattccatacttttgtatacggtttgcattttgaacatataagtatataatctattcaaataacattaaaagtacattttttcagaatataaaataatttgcatatcaattttataagaatttggaaagattagaaaaacacaaataagaaaacaaaaattagtcataaatcagtatccgtagataatcaccaaatctcactgtttctagtcaactatatttatgtttctaactttaagacaaaaatggtagcatatcatattattctgttctgtagcatatatttttcatttaacattgtattatgagcattttccaatgttattggaaggttgaaaaccccaattattaatgtctttatagtattttttcacatggataaaccattatttacttgaccattcccctgctgttggatgctttaagttatttgattttccccaaattttcactcttaaaaataacaccgctaccgggcacattggctcatgcctgtaatcctagcactttgggaggccgaggcgggcggattgcctgagctcaggagtccgagaccagcctgggcaacatggtgaaaccccgtctctaataaaatacaaaaaattagctgggcgtggcagcatgcgcctgtagtcccagctactcgggaggctgaggcaggagaattgcttgaacccagaaggcgaaggttgcccaagccgagatcacaccactgcactccagcctgggtgacagagcgagactccatctcttaaaaaaaaaaaaaaaagaaaaagaagtaataataacacttctgttacttatacacaaatttggttttcatctaaatcccttttccccttcttcatgaattgcatttttccactcttaagcatccctttattttcttcccagggatcacagaagagaaagatgaagagcaaatatttttcctttactttgtgtattttctacaaacttggggcctgccttggtggctgtcaaagtgtcctttttttagagcagaaagagttgcaggaaaacatgatgtggtgtttcatgcaacatagtggaaatgcagttttaggtcatcaggctgcacttcctctcagtccgcagccccagagctctgtaacgaggatcccagttttccagactattgttatggtacaggtccaaacccgcctgccatctggggaaatgtgttgcttgagccaaagtaggagctccacactgtgcttaaatcatttacctgtctaaatagttctcacctgaggggtgggggaggggttaaactctcccctcatttcagatttttggagtttaatatgggccaagcaacaagcccagtgtgcctgttagtccctgaggaacattggaaactgtctctggggggctgggggagaaattttactttcccaaactttagccaggattttgaatcctttctttttgctttccagtatcagtaaatgcctaacatgtattcattttccccctatattaaatgcttaaagacttttcaattccatgttcagttttaaatcatgaaaagtggttgttggtcatttatgttgtaacgtgatggctttccgtcttctttaggaataaacattacaacggtggctattccattggtgctccttgttgtcctggtgtttgctggaatggggatctttgcagcctttagaaagtatggtgactttacatgtttaaatttcttctctaattatgcgaacaataaaaaaccaaaaagtttattcttcagaaatgcatatgtacaaaagcagcatggcttctttcaaaataaaatgttaacttatattttacaaacaagttagataaaagtagaaatgatcgagtattactttattaatctttttttatagacagggtctccctgtgtctcccaggctggagtgcagtggtgagattgctcaaactcctgggctcaagcaaaccccctgcctcaacctcctgagtagttaggattacaagcatgtgccaccatgcccagctaatttttttatgttttgtagagatgggatcttgctttctcacccaggctggtctcaaacttctggtctcatttgatcctcccaaagcactgggattataggcatgagccaccgcaccccaccatgtattactttataagcagttcttgtcatttagagacctttggtaaagacttaacctttgagtattgttgaagtatcctgaaattgatatattgctttagaagtatctgtgcttctcctccctgaagagtaaaaggaatattaaataggctgcttggggtatcaccaagctgccccgtaactcagcctccccaagcctgtttccttatgtataaaatatagtttacccagatgaattctgaatctcttccagaaccctgagatccatgtttattttgacaaatgttagatgttggatctaaacaaaaaatggaaagtattctgaagttttctcttcttatattttaagcaacttcagaatctataatgtgtatattagtacaaatagaatgaagaatagtttctgccatcatgagagaaggtacaaaagtctctggttcaggtagatattcgtaagttaaagcatgccttagtgtaatgtgcttgtatgaaatgcttctaaagacacccacagttttggactggagtatagtagagatgaagtgagaccatgtggtcatgaggaattgcttcaggatgactgcatgagctagtgataaacttaataaggcactgatttctaatatgcaaaataagattagtatatattcttctagtgaaatcttgtgacctttcttataaatgagataaatttatagataattctacatatttgtatgattttctaaagcacatggcagctgccatctcatttaattctcacatcaaccctatgaggtaagtactattatgatccttatgttatatagggagagagaggcagatacattggcttataaatattcagtaggactttttgtcttgataggaagaagaagaaaggaagtccgtatggatcagcagaggctcagaaaacaggttggttgaaaactctatctacaattttatctgtctttgaggaagggacaggatctgctgattgaaagcataaggaggccagtggcccacatttatttggttaaaagacataagccctgtagcctttaaagtagcatatctataaggaagaaatttattgtgttctgtctctttattttaatggccactttacttttgttcaatgtcatcccctatcatttgtcaacatccttttttcttggccactggagtttaggccacgacactgtctgccatcaaggaggtatgacaaaagccttatcagtgaactgaagtaggcccgtgttgttagcatctgcaggcctgtgctgtactttccaccctgagaaagtgagaaaaagaccaggcagggctggtgtgcaggtttcagataatcctgcacaccagccccgtctggtctttttctcactttcccagacacaggtgcccaagcaatgagttagccatggtccagagagagagggcagtggggcaggacccctgagaaagctcagggaccatttgagactccacctccccagggtctaaacaccagctgcagtgtctcctctgcctcacagatgccatgccagtgcagattgtcggagaccatacccagatgatctcacaaagggagaatctgggacctgatgagggcaaaataccttttaaaggcacagcggaaagcatggttagagtagtgtttgctgttgtggttaatgaccttggcatgctgttcttagcacacacacctgaggaggacattgatcactgtcagctgtcaggaggcagcctgacctctgactcatcaaggaacatgttctggaggacgcgcattacatttctgacatattcatttggtttatgttacctttattccagactgttggaagcagattaaatatccctttgccagacatcagtcagctgagtttaccatcagctatgataatgagaaggagatgacacaaaagttagatctcatcacaagtgatatggcaggtaagtgtcatatttctaggactgtgctattagattggaggtgctgcttgtgggggagggagacaggagagaaataaggcaaaatccttttctatttagatagggtccagtaaatctgaaatgtgttttttctgcattctgcacagaattacaaactgacactgagatattacttaaaagccctattcagccagtcttttcacctgcaggggatatagtgacatccatagtgatagccctgatgtactacttgtatctggaagccctgaatctatttttgttaccaaagctttgattaaggcactggtacagaggggctgaaaggaggaattaaatacagttcctgccctgaggaaggtgagataggaaataaaggaactctctcagtatgagaagggcctcagtgtccctgacaagccacatcaagagtcgagcttcccaaaccatctatggggaaatgctttttgtttctttttttaaaatttctactccatcatgaatgaatacactgtaaaatgcaatataaaatactagtaataaggaaattttaaagatacaaaatacaaagctctaattttttattattagattcaacagacataaaattaagagtaataaagagtaactaagagtagtttcttgacacttagtctcaatttctgcacctgtctctatggcactgctaaaaacagctctcagatacataggactctgtggggcatgctctgagtagcactgcgctctggcttctccctcctcacgtgcagcctgaggacctgcagtataggcatcacctgggggcttgttagaaagggaggccatagaactagaagctcccaggtgacgcctgtgcacatcagtgactgggagttgtcagcctaagggttggttgagtcactttgtggacaaggagagcatcctctgcaaccaaaatccatcctcttgttccttggaagtgacatgaagggagaacctaatttctgttgtcttatgcctttcattctccttcagcttctaattcagtctctcctccctcctccctgaatgatcctcaggctccttaaatgtgcaatgacccgggttctgtctcacccccactcaccacagtctctcccctaaacagtcccacaccctccccaacttccagcagtgcccttccctgcatgtttgtccatgctgcttctcacacccagacttccctctcagtccccagtccataattctcagcagcctgctggacacctccacctgcagatgtcacccgttcctcagcaaccacaatcgaatccactgttcctaaccctcaccacagatgctctgtgcattccttgtctaatggcttctcgactgcacatcccagcctcaaagagtccttcgtcccggctttcctcacaccccacctctcattggtaacaaattcctgattcctgtcccaaagggtcacttttcctctttcctagtttgtgacttctatgtgcatttctctttgcttttttacctctcactttttgatcttttcctcttgggtcaacctccacagttacctctgaaagtgccagtctttcgtttcccatagaattaaaccagacttcctagcaagacaatcaatgcttttccatgctctaacgcgtggctaacagcatatactcaggatgtgcgttcgaatcctactccatcgccccattgtgtgacctaggaaaagttagtctctctctgccttggtttcccatttgtaaaatggagtaacagttcctacctcgggatttttttgaagattattaacatcttgctattggaatagcgcctggcaaagagtaggagctctataaatgggagctcctggcatcatcctcactgtcaccactaggccctgacctgttgctttggtcctcatatcctattaaacaaactactctgtgtccctcatactctggccatatcaactctattttcgaggctgtttttttctccatttccacactgtgtgacttccacctccatagcttctccagagccagtttcagagccacttcctccctgaagtatgtccccatgccccaggacgtcgtcgtcgcccccatctctgagaagaccctgcgaagcttcctgagcaggcggtgcggttgtgtactgcctgcgggtggcttctgtggctttcacatcagggttttccgcagtgcctgggacacctgagggcacccggggggaaagtcagtcaccacgacctgaagcagagtatccccgtctgccactgacaggccggcccgtgtgtggtgcccgctagctgccatctgtcttgtggtttcagattaccagcagcccctcatgattggcaccgggacagtcacgaggaagggctccaccttccggcccatggacacggatgccgaggaggcaggggtga

SEQ ID NO: 10379 - DNA, 38894 bp, Homo sapiens
ggagccgctgagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggtaagactcccgcagcccctgaacgggtggggctgtgcggggctcgtggtgccccttggtggcccggggcggggccttcggaggccttcgagcccgcggcaactagcgccccacacaaagggtcgaggcagggctgcagggggagtgggatgccacttaggcctctgagatctgagaggatgcaaggaggacgcaagaggatgagcctgcgtaccgaagtggggacgaggccatagcgaggactcccccgtggtctgagagggggcaggccagagctggctggctcagcggcctgcgagctaacggggactgcagtaaaaacacgcctacatcccgagtacggaggatttcttgtctcccccagtgaagcagaggttataactacatctctgtgcctggaggtggggagataatcgtagtgaggacactccttcaacccgaaatggaaaggaggcctttgtggcctaccagcaaaaggggacccaggtcacacctgtggggaggaagctgtagtcggtacactcctgtgagttcagaaaggaagtgtcacaaccggccgccttcgtggcctgaaggtggaggggtttgcagtgaaatgcctccgaggtccattgctggggaggggctttactcgagggtgtagcagttttgagaagccggcgtctgaagctaggaggtgagggggtggggtgagtacgcctcctgaggctctgagaattgtagtaagatgccaggcctttggtcccccagtagggaaggggctgctgtgagcagcacatttacggctccctcgggagaggatcctgtggcatttcaggaggacgagatccagtgggctgcggagggtgggtgcttttgatggagagttaattgagtttctctgaagcttggctgcattagtttgcagccacgtgaattgggtggtgggagggactttgaggatctacaggttagtgacggggttggacgccagtgcagcaggcttagctgctaggttgtaaacgtacgggctttttgtgtgcctccaacgtgtgctttatagtgacaaatctgaggggctcttgtgagggttactcagtattaagtgctaaacatttactcatctgcgtggtgtcatgctgagaattgcagactttaagagatttctgggccctaaaaccctccttggctccaggattctcagagataacctaatataaattgaagaagttggtagggaccgttttatattattcaataatagagtcagtataacccactggaaaaaagtgtgatggcaactgaaggtttgttgaagggagaggctaggcttgtgactgcagtattttagagcttcttgcttgaatggtttgaaatggtgtaatttttgcaaaatgcagtcttagcaacaagaattgtctgggaccttgttaactagtgtatattgttaatgcatctcagagcatttgcagtcgagaaaaatccctcaagtctggacacatagggaaatcttgttttttaaattatagaactacaatacaagactggttgtacttgtttttgaaatttggcagttttgataagaatggaggatttctggatttagtggaaagtgtgcagacattttcaaagagtataaaaagttgggaagaactgttacaggtggttcaaataacgttatggtaatttatgaagaaagtgaaatgtttggcgtgtttatacaaaacaatgaagatgtgcttagtatatattattggacagatttttaatgaaacagggaatacatttttatatatgctcgattaaatgtgattactttgcttatggattgtaatgtataattttcattttctttatgttcaaatctgttagatgaaaaatgtgaagctttagaaataattgtgtggttacttgcaacgtattgttacatgctaataccagtactctttgggcttctttcaccttctttgacacgtcaaatgttttgatgattgagtattgagagtttgggagttgttagtacagtctttaggtgtgaaacttgatgttgtgggccagtgtgttccaggtgctggaatccagtgacagtgttgatagtttttactccattttgcagagagccattctgtcattgtatgaatgtatgttttcttctgtagatgttgtaggaagaaccaagtgtcagtagttggttgcacaaaagatgcttttagatgtccctccctaaaatgcagagactgatgatgtccacttttatatcttttgtctggcccacaagtgcttaatagtaaatgttcatggagtaaaggaatattgttaaatgttttcaactaaacagaaaagataattttatctaaactacagttttatcagattttactaccacacccatataccttttggtttgcacaaaatttaattaagtttaaagccagcttttaagactcaaaaacagagtgaatgtggttgtttaggttagaagtataattttgctctgaagtgaaaatgaaggtagcaacatttttgttggcatttggggggattgaaacataacttaatatttttgacaggaggaatatcttatttagaaatgtcttctgatttgctgcctttgagtacggaatggaggttaatggaaaaattgagtaatgcgttataaaaagtacacatctccatcagtgtcagaataattttttcattaagagtgatcccagactttgatatatggtccatttgggaatggggaacaaaatcaagtggctgaaactgtggttgtttcataatgtttattataatgtgattatactgtttttagcattgtgcccgttgtgattggttctctgttgctaatctctgaggtgaacatttgagagtttgtttcttttggatctgaagaacctagctctgctgtaccctggttcttgttgattaaagagtgataactgaacaaagttaaagttcacttttggatgtttactaccagatgaagagtgaaaatagtcgttttagtttgtgccttgacttcttgatgaagagatttgttgtcagacatttttttctgaaattccaagtgattagaatggctagtaaatacgaaagtctgtcttgccataatatgttaaatttttgtagcagatacttgtgatttgtgcatgcatccggtattttgtcaagttgaagcaagcctttatgttaggactaattcctgataatatgaatggaaaacatactaaagccagcttcttgttttagatcttctgaagtatatcagtggctttaatgacaaatcaggcccattttctcctttcctatcattatgctgtatgtatagatagaatatgtattttagatgttttattgtttagttattattttagtcttatccttctaaagttcagcaaagctttaggtaaatggcgtggatttttgaaatcctgcattcagtcgctagctgacatttagaatacaggaatagtagtttcctggaaaacagtgacacttatgttaaattcttgtggtttttacaaagtgaggtgtcaacacagaagtatttcagttctatttccatttacctttcccttttgaagaggtataataccaagggttgtgaagttctgacttgtagcatcaactttctgcatggttttccttggtatggggtggggtgggtattcctctttgctgaaatagaagagaatcataaatttctatctggattgattttgtgctttaagttgtacacataaaacttgaactaggcatttgtcaaattcagctgggcctttcagccttgccttgtggaatgagaaatatcttccttttaaaggtaatttctggtaaccttttagaaatttttgagagtagacctggtgagttccctttgagcttaactggctgaccccagatatgtccttctcaagatagacatacggtatcttttgagtttgcaagggaagaggctgagaggaaccttcttaccttatattcaggcatatgccctggccccatacctgaccttttgaattggaatctccagtagggatcagatgtttattacaagttctagaaactagaaagttaccctgttatgtggctgctggagtcaaacctgtacataaatattacagtacttcatgctcttgctcattgctttacttgaagcaggtttttttctgtttcacattttcctttgtgacctgttaaactactagatatggctttcaaatgaagaatttttaaactccttagacttagttaggctaggccaggcgtggtggctcacacctgtaatctcagcactttgggaggctgaggcgggtggatcacttgaggtgaggagttaagagaccagcctgggtaacataatgaaacccctgtctctactaaaaatacaaaaataagctgcgggtggtggcgcaagcctgtagtcagtcccagctactccagaggctgaggcatgagaatagcttgaacccagggaggcggaggttgcaatgagcctaatgagcctagatcgcgccactgcactctagcctgggcgacagagcgataccctgtctcaaaaaaagaaaaaaaaaagaggctagatttctacaacatgtaaaagattaatacaatgctctagacttttgattgtgttgattacatatttgcatagctttttgtggtaaaaccatctcactattctttagcaacttgagtagttgactagacgatgaatagtttgtcctttagaaaatcacacagatttttgaaatatgttttactttttggcgatgaatattaaggtcattagttgtattttggtcttggaagatactaatttaagatgagcatcatttggaaaagtagtcgtaggtaatcttaatactgaacagtggcaaatttcttctctctccgaattaaaacatgacctttgaaaaaaaataaaaagcaaaaaatgacctttgaatatagttgtctagacatttggtcatatatgcttgtgacttgttaataacctcaccagtttggaagaaatgacagtgaaagatgagtgacctgtttttattttgggatatactcttaatatgtcaggcatttttagggtgtttttaaattttattttattttatttatttaaattttacaagtttttgagaactgttgtgatgtcagaggaaaaaacactttcccttaatattttgttaatattttgagctccagtggaattagtccttatagcaagaactcatacttcatttgttttgtgatgttggatgctattttgtgcaaaataaaatatattgaaagaataattgcagtaatttccatgagtacccttgaattgctatcttaagttgtccaagaattgttattgtgcgaacttgtgccttttcatcacaaatttggtgagaacctggggaaatagacttgtgttacggagttttctggactggtttaattataaagtgatcaaagcaattagctgtgaagctgagctttatgactgttttaattttcagtggattcgttattgggctaagttaatgacactcttgtaaatatataattattttgagatactcaaatttgaaagcaataccaactaaaaagcatgtgtgggattttgttacggtgtctttctttttttttttttttttgatatgcattctaatgaagtactctggtggtttcagactcgccttcgtaatgtacagtgtggcctgtgcgtgttgttttgtgtttcctgcattgatttttgcctccgtttattctctattgcagtctaaaagttggttttaattggttgcccacaggattgacttggcctctacttcttgttaaggaaattcatctcttgttttatcaggtaagagattttgaatagagagttcgtttttatacaaaataaaatgagatagcttattaagaaatatgaaaatatatgtagcaactatattgtgtgtgtgtgtgtgtgtgtgtgtgtgtgtgtgtgtttttgtttgcttgttttttgttttgagacggagtcttgctcagttgcccaggctagactctgttgcccaggctggagtgcagtggtgccatctcggctcactgcaacctccgcctcccgggttcaagcacttctctgcctcagcctcccgaatagctgggattacaggcgcctgccaccatacccggctaatttttttgtatttttagtagagatggggttttatcctcttggccaggctggtcttgaactcctgaccttgtgatccacctgccttagcctcccaaagtgctgggattacaggcatgagccgccacccaggccggtgtggttttttacaagtttatctgagggataggggtggggtagatgggtgctttgaacagttgttcctttgggggtcaatttcatttatatggatctatttatcttgtgattttcctgataggcagtaagttttattccttagtagcattttagactaattacaaatacagatgcttgttattgatatgtttatttatatttcctaagagtttaagtatagataatgggtcacatgttttagagtacaaattttagactttaaatggaaccttagcaagtggaatctaaccctcttgtttaagtaactaagataggcccaagttaggttgaaatgacttagctgtcaaacagttacttagtaacagaaaagcagatacttttttaaatttttttttaaatttttatttgttttatttatttatttctttttgagacagagtttcgctcttgttgcccaggctggagtgcagtggcgtgatctctgcctcccgggttcaagtgattcttctgcctcagcctccctagtagctgggattacaggcacctgccaccatgcccagctaattttttgtgtttttagtagagacggggtttcaccttgttggccaggctggtcttgaactcctgacctcgggtgatccacccacctcatcctcccaaagtgctggggttacaggtgtgagccaccgcacctggctgcggatattatttcatattttttggaagctagaaacaatttttctcatcagatggctttatgaataaatcttgtattccactttggtttaatattcagccctttccagctggtaatctgaggcagattttcaatagcatattctcatgtgtaccttgtacaaactttcagtaaatccctgctcttaacagaaaatggcttgaagacttaactgtgtatgtcactttagccctgtgtttaatttttgtgttcttgggactatatcaagtttctgtttgattgtcccagtgcaaactagtctctctctctctctcaagttgttttgagtacctggattgcccatgatgtttcccctatacaaagtgattaaccgttttttgaagttgaacaggaaatgctatcacattttgcatacagccacatattctagattgagcaaggaatgtgaatttgatttaatgacttggaaactgcttgatgaacctccttataggctgctaaatagtaaatgagaaaagagactgttggtgtgatgttttttagcgttaatttttcttgttgactcttgaagtttgtaaatgaaaagcttccccacacttcccaaatttctagtgctttataatggcctcacaaaaagcattttctgtttgctagtccatttttctggattaaatttgaaggtggctttttatttttgtgtatgtgtctgtgagaaaactgtcaaagccaagcagtttgtttcttgtttgtatacggcagttgtaatattgagatataattacagattttgttgcattagtatttatataatatttgacaatgaagttacagaattcttagagcttatagtagaaaatcttgccccttctaatattcttgagaagtgataaaaccaaatctcttcattaatttataacctttctgagggtcatgagctgattttatgggcttatatttaaaagttgacttttcaggtggggcgcagtggctcacgcctgtaatcccagcactttggaagactgaggagggtggatcacctgaggtcaggtgaaatcccatctctcctaaatacaaacacttagccaggcatggtggcgcatgcctgtaatcccagctacttgggaggctgaggcaggagaattacttgaacctgggaggtggaggttgccgtgaaccgagatcgtgccgttgcactgcagcctgggctacaagagtgaaactctgtctcaaaataaataaataaataaaagttgacttttcagatgggttggaaaacaccctatgttattgaccaccttaatttcaaagtagtatgtttcccaggcccaataattcggtttgtgtcactttccaaagggctgcccttgaatttgctcttagaagcctttggaactgaaatactgaaatttgaggggaacatttcttttttgattatgtcaaaacaggcatgatctaaggagatcacagagatcctgtaggagttgtgtaggtccaagactgtaacaaccactgagtaattcacactctggttctaaaacaaaaacaaaaaatatttttattgtcagccctctcctaggggaaaataatactttaaaaaattttattaaatagaggatttggttatgagtcattggacctgagttttaattaaaatagtcacagtgaatgggactataaccaggttctacttttgggggtaatgaatcaaggtaactcagattttagctgtcctattcagtagttcttttggcttcttagtatgtcttaaccttgtttataataaataattccatatgtagttttttgtaatgtacaaggcagattgaaaagttttaggatgaataaaataatggaaccagttctcatttaagacttgaatctacttttagtcttaagtattatttacaattcattagtattctagttttttgcttctgttggatggattttgagactgagctctataaaatcacactcttgataattctatgaaattatcaagtatatagggaagatgctaagccagttttaaatactaacttctatatattctttgcatgttttttccctatagattgttaaactttgtttcctgatttgacttagacatttcttttaaatcttactgaatgattagtggtctgaatgatgtatatgtattttactgtcctacagttgttttttcttgaactttttgagtcttgggactgaactgtttccaaaattaatgccttctggaagttgaaattgtctacgttttacattgtaaatggcacgtaatgttcagtttttagaatatctaaattaaagacattgcctgtgatagcttgagggaatatttgagggcctaatatggtagctggtcattcttgtagctaaaaacttggtgtgataaacaggagtctgacctggccgttgccttttctcatctgcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgcacaaaagtactttactgagctataatattatcttgtcagggtttttgttttgttttgtttttaaacctgaaaatattttgtgcctttggagaggtagatttggtaatcttggagaggtaaaaattgttgcttatccttgcctgctaatgctgaagtgtcaagagaagaggatacttggaacagcagggaggaaacttgattcaagtccatagtatccaccttttcagaattttatgtgtatgatgtgttggcaaacaaagcccttaaatgttgaaaactttttatcttgaaagagtttagcttgtattagaatttggatacccagtgtgttttagagggggctagacatataattccaggtagtagctgagccattattaaataatcgggatttgactaagcaatggacaaatcactgagtgaaatcagctgcctacagatatccaaaatggcttttaccatctgaaaggggtggactgtgtgataatatgtctccttttcttgttcaggagagatcagttatgtaattcattgttacctgctttccagtgttttacagcaagaaatagtttatcaactatgtgcatcatcactaatctcccaaaagtagagcttttacagggtatggtagaatcaaacttatggctttccttttttattaaaaatggctttatttcagtcttatctttttagtatagaatctgatcattttgacttgtgaaatgttctggaaagagtgtactctggtagtagcacaattctctgatgttacagtgacttttctgggaaaacccctgtctattcaacaacataagcaagttcatctcctgctcaggtaaatggtaatttttttttttttttgagatggagtctgtatctgttgcccaggctggagtgcagtggtgcgatctcggctcactgcaacctccacctcctgggttcaagcgattctcctgcctcagcctctcagtagctgagactataggtgcgtgccgccaagcccagctaatttttttttttttttttttcatttttagtagagacggggttttgccatgttggccagcatagtccccacctcctgatctcatgatccgcccacctcggcctcccaaagtgctgggattacaggcgtgagccaccgtgcccagctggtaaatggtaattctttaccatgctgttcttgggtttattcttggtgctttggctgctttgtgttagagtctcaaaagcatcctagagtatgactccttttctggatcaacgttaactagcagtgagtagccacggtggcttgctactctacatactgctctatcactggagtccagaaggaggaaaaagccacctgacataaacatttcagacccagggacagaaggacagcactctgaaagtctaagggcaggaaagagtgctgggaaaaatcacaaccaaatcccttgaattctgtcaatagccccacggacctccttccagtgaaaatgtttaagatgtgcttgcttcagcagcacatattaaaaacgaattaaacagagaagattagcatggcccctctacaaggatgacacgcaatttgtgaagcgctcttttttttttttttttttttttgagacaaagtctcacgcttgtcccccaggctggagtgcgatggcgtgatctcagctcactgcaacctccgcctcccgggttcaagcgattctcctgcctcagcctcccgagtagctgggattatgggcatctgccaccatgcccagctaattttttttgtatttttagtagagatggggtttcaccatgttggccaggctggtctcgaactcctgacctcaggtgatccacccacctcagcctcccaaagtgctgggattacaggcatgagccaccatgcccggccctatttttttttaattaaaatgttaaaggttagggcatagagactcagcaaacgtcatatagagaagtggtaaatggcacagctgagcattggaattggctccccagttgttccagacatctggatattgatcttagtaacttactagtttcaagtcattttgcttaattaatggcttgccatttcatgataggagatgactatttcgttgtggggcaatgcccagcaagagaacataattcagtatgaacagtcaaaggtgttgagtgtatttaactcattttaggaatgagctgtactgtattcaaatgggctacttgatggttcattacctccattctgctgctgttcatttcctccctttgcttgcttatatagtaaacctgctcgtaaccaggacttaaaactcttagactgaagccccttcactgctgtctctagcctcagcctcctaatgggtgggagtagttcattcatagcttttgattggtggataagacttgtcaggctgggtgtggtgggtcacacctgtaatcccagcactttgggaggccgaggtgggaggatcgcttgagcccaggaattgagactagcgtgagtaacatagcaagaccctgtctcaaaaaaaaaaaaaaaaagccttgtcacttagagtttgtgcttcatatcaaatgataacaaccacattgtgctacaccacaagtcacacagtgggaaggatttaagagggttaaatagtttttttgtttcttttttttttttttttttttttttttgagatggtcttgctctgctgcccaggctggagtgcagtggtacagtcagctcactgtaacctcgatgtcctgggctcaagcaatcctgcttcagcctcctaagtagctatttttttttttttttaatttttttgtagagatgaggtaattgctggggtaggggtgatggtggagtggaggggtagtttcactatgtggctcaggccggtcttgaactccggggctcaagtgatgctcccgccttggcctctcaaagtgctgggattacaggtgtgagccactatgcctggcctcagtttcttaaaaggttttaaatcacaccaactggtaccagtgcctctgattgccttgatttttctgtgatcccacttggaagtttgttaatgccacactccactatactccacacattagattgcagtgggggctggagagtggcccagcctttatacataactcccttctgtggtttggcctgtgggaccagtagggtccctgtgctgtaactctgactgaagtgatggacattaatgcaactactaattactgatgtagatgagctgctttacttctatgaccattgaattgacagattggaattggaagcacctgtcaccttcaagcttttaagacaacttcacatgaatgtacagcttagccatagctgtatctcatactaacagatttttgcagtggtgtgcacccagcacttatactttggtggaaaagcaaaataaggttcctgttcttcaacagttgagggttttaagtcacaactaagtgcttggttgtgcttatactaggtacattcctataccacgggaaccaggtagtggctttcctggccatttgctaagttatggttagacaggaacaagtgtaaactagtctttgtcatagtgtagtttcctgttgttgaaatattcctttgctttctcggcttccctaacatgtaaattctgaagacccatcttaaactctccccagtgtcccaaatgaatttattccagtgaagggtaaggggcttgcattatgaacaataggtaggtttcttttccaagagctctggtctgcttttgttcatttactcatctcattttgtgctgtaggagatatacactccttttgtgcacactgtagatgcacaggtatttggtgatgcctcagtcctggagatcatcaggaaggcggtatagtactgttgtctcagacaccccacaggtgatagacattaaaagaatgtagatttcagccgggagggatgggggcagaattgactaccctatagatgtcctttgaaaattttgatacagatcacattttttagaggtgagttctaccttatttgcactatgcatgcttgctacttaaaatttattcctttgatcaactcctgtaaatgtggagtccaggatttcctaccttccttccccagcagtcagacaaatagggagaattatattccatgtttgtgcaaggctaacattagcatagatcatgaggggagaccatgtgagtctcactgctgttgtagtggcagggtagatttcagattggggtgaattacaaaatgtgaactgttgctaaaatggttggatatagaaataacattctcagaatcggttcgtggttccatcagttatgtgacttaggacagattatttccctctggcctcagtgtttcttttacagtatgggattaaattagataagcttgtgtccagttttaagcttctgtgattgtatgaacctagccattcggtttctggaaatctgtactgagtttggaccttaaactaaagtgaccaggaatggagctccaaattttgatctgggtactgctctcctggtttccctagtgtggtagtgattctacactgcagcttgagaaattcaaaggggaagagtcttcatctctccttttgggggctgtccctgtcctgctagttatatcctggagcaggtagaccagaggcattcctcctggatccactcctccttggtccaattaaccaagaaggagttaatgatactgcagaaggacccaaaggtgcacttccctgtttgtgagcacctacagggacagttgacactgggtacttactctgtgccgggcaggggatactttctatgactgtcctcatgtaatcctcacaaataacactgtaaagttaacattatcatccctactttacaggtggggtaatccaggcagagaaaaataattaatagtaaggggaaaacaaagatgttttaatcatggatgcttgtatgactcctcaggtagaaaccctccctcaactatccccagcccctccctgacttttagggaaagtgggaggccactggcagcagtcttctgtcatggattctgagctgctggggaaggagccttttcagtttgccaactccaactatagtgtggagggcccttacctattggtagggcttcttggcctccacggtcaagcttatgattgcagagggggacctgaacttactttgttgtttttttgttttcgcaacagagtctcactctgttgcttaggctgcagtgcagtggcgtgatctcagctccgcctcctgggttcaagcaattctcctgcctcagcctgccaagtagctgggattacaggtgtgcaccaccacacctggctaatttttgtatttttagtagagacagggtttcaccatgttggccaggctggtctcgaactcctgacctcaggtgatccagcctcccaaagtgctgggattacaggtgtgagccactgcaccctgcctgaacttattttgaagtactcacgtgaagactttgtgttggtgtgttcagagtctctgggcagagaaaaacacccactccgctacagtcctatcctgcttttgagagcctgtttgcaggttctagcaggggagcactcgtatatccttgaccaaagaccagtcctcctctctcagggatggtcgtcttcaatcgagcatgcagcttcgggacagatgcatgtggagcggtgagggaggaaggggacacccacctagtcagccagatcagccaaatcaaccctggtgatcaatggggtgacagatgtcacagccagatggccctatcctgcttttgaagaccatgtagtcctcctcagtttgcttctttccttctccatatccagttttgtcgtcaagttaggttctttttgaagagttagttgtacagtggtcagatttgttcaacttttggataagcctttggggatgttggggttagattagtggctttggttttttgtttttgaccttcacccagtacagtaaagtggaaaaccttgtggccatcttctttttcatattttcccaccttttagtttttgtgtgcacatgttaagctttgtagtgttgccaaatactttgtgtcagcctgactccttagtagtatatggatctaaaccaaatttattgaaaatttcagtttatgagtaccattcagtagcccttagtcatatgtatgaataaggaatgtgtagttttatagaaaggattttcatttttggttcagtttgtgacctgtgaggaatatccttagagctgctgatgtaaatttggagaatcctcgagttagaaaagtagggataagaaaacttgtctaccttctccatgtcctttgatggggccaaaaaggaaaaagaagagtggtggtggttggtgtagtttgtcttttcagtcttacgggaaacaatgttccatgggtggtcctttgtaagcctatggaggattttctgattggctttcaagacttgatcctgcatctgtgagctgatccagcatgccaaggtaggcaataggagtgtgagcatgacattggtttattaaaggagtggccctgccacccagaccttcagccctctatgccaccttcttgcagcctctgtacaacttctggtcattacctggggtggataaggaattgggaattgcaggctggtgcctttctgggttaggactttggaagtggaagagggaagtgttaaggactgacaaatgaatttcagctcatttggcactgaattagatcccactggacccaggagaaatctgttcttggttatgaataggaaaattagaacctcccaaggcaagggaagggtggccatagaaaatgaagggcaagttactcccttgtagcagagaatgggattccctatcgacagtagtatgctggtaaactggctggcagggtgaaggaagccatgactttttgcagttgcccaatttctacagttttaaacttaccaaggccacctgcttcaacgatttcctgatatgtaacagttggctcttgcaagccatacaagcttgcgccagcacactgctgcagacttgcctcaagtatttgaattcccattatgtgctcaggtatatgctgtgtggcaggagatgctgaaacagtgtttattctgaagagctttgtcatttaattgacaggcaagaagctggagaaacatcgacagaatacagtcgtgtggcatgaattgaatatagtggtccagagtgagaagttgagtgctggaaagatcatgaaaaggggagcatatataagctaggcttgaaggataacgataatagctaacacgtggtcatagcagttccagcctctgtactaagcatcatgcatacattatttatattaatcttcagaaatagatactatcccccagtttacacctgaggaacctgaagtttagtgagattaagtatttgcccaagttatatagatatgacatcaatttagtgttgtagtatgtcattattgtggctaggaaggaataaggccagtatttggagcctggtcacttcactgcagaacccacactcttgcccactgcatcagattgcaacaatataaaaaggggggcttttcaaagagaggaaaaaagtctaacaacagtccaaggtttgagattaggtaggaatcagaatatttgagttctagtcttcatttcacttaaccatatatgtggccttagccaaaccacatcttccctctatgccttggattgagggacttgaattagatggccactcagttcttttttatttctgacattttgtgaattttaagttataaaaatgggaatgagtatgcctttcttaagggacactgagagaatgtgccctgctagggcacattgaggttggcagagggagtaaacagaagaaaacaaactataaagggtaactcctaagtggtagaaagcagaggcagaaaaatgttggagctatagactcagctgttccattcgcaacacccgactagtcccaaatggaagggtcagggggtggggacctaacagagaagataaattggtgtttggtgttgggtgttcctagaaagcctacttctctcagtgtctcagtagcaggtcagagctagatttgggtcatttctgaggatccttgagtatcactcctttcctagcattcataaatttaacagatatcagtagagcacctgctgtgttccaggcgttggcacagaagcaagactaatctggtccctctgcttgttgaagttacagtccaagaggagaaatacataataagcaagttacacattttgataggattataagaattggggttttgttggattagagtcagggaatgtctgtgacttcaacataacagataggaggggactgagagtggaaatggtaaaaccagttagactgttagagacatcgagccaagatgtgctcggtgatgaaagagtgcacaaatatcacaaaaataaatgacaaattttttttattgactcaaatgtgatatttaatatggttctggaagattttggtcctaaaaaggaggttgaaagtccatggcgttaattataatggcagtatatgaaaaatacatgagtctggtttaaagtaggtagttgttcaagagatgtaggacagaagagtgacatgaacagttttaatcacagatttctaagcagagataggcttagaggtagatttcaaaggagattaaacatgttttggaagagattaataatcccgtggtttatagatcatttaaaggaaatgttgctcaaaggatagaaaactacagatggaaaagatttgtttataaagagttgattccaatgagaaagaaaaggagacaaatctgtgaacaaaactgcttgcacaggaagctctgacctcagaatggaagccaggccaccttaggggctcacatcagtgagagttcagccccttatcctactgaggcacacatgagcccacaacagtatggctggggtttgattctgggttcaaaaaactgaaaaaggatttagtccaggaaaagtggtgtaatggtaatgattaggaaggaatagtccaccagaaattgaggcctacacaggaagatgataatagtagcccactacacgtgtttggcccagaccaagggcatctcttttggggacatttgagaagtcgtggagtgagaagacagcagctccagttgtggcctgtaatcttaccaccccaaataatcactgctaatgcttttgtcattcacaacaacctcttaccagggggaggacctgtagttctccaattaaaaatttccctagctgggtgcggtggctcatgcctgtaatcccagcactttgggaggccaaggcgggcggatcacctcaggtcaggagttcaataccagcctagccaacatggtgaaaccctgtctctacaaaaatatgaaaattagccgggcatgatggcaggtgcctgtaatcccagctactctggaggctgtagtgggagaatcgctggaacccaggaggcggaggttactatgagccgagatggtgccattgcactccagcctgggcaacagagtgagactctgtctaaaaaaaaaataatagtttccccaacattttattatgaaaattttcaacatgtagcaaagttgaaaaaaattatacccatatatccgccatttcagatcctacaacttaaaatcttgttttatcacatttcttcaacaactccttttattttttggtggatttcaaaaaagtttcagtcatcggtacacttgtaaacatttcaacatgccttaactttagtgcaacatttgtttatgggttgttgggttttgttttttttttttgtaaaattttacaatcagatgtgtacactcagtgttcctttagatggaagtggcaaatgcacacactcctgtgacccatattcttagaatgctaagaacgtttccctttccactgggagctctctgcctctgctcagttaataccttcccttcccctgggggagaagggaggacaaccagtgttctgaatatttacatcacagattcgttttgcctgttctgaaacttcataaatggaatctgtttactttattcttcatttttattcatgttacagatactaatagatttttttgttgctgaatagttttctataaacatcacaattggttctcatattgatgaatacctgggctgtttcaagtttttggctattgtgaataaagctgctgtgaacattcttatacaaatctttgtggacataatgtttccatttcttttggctaaaaatgtaggagtggaatcgctcttgggctaggtgtttgttaggttttttgataagctgccagactgttttccaaagtggtacatttaatgctttcactaacaatatatgagagttccatatccttgccagcatttggtggtggtggtctttttaattatacttttagccattgtggtgggtatgtaacagtatctcattgtggttttatttttcatttccctgataattaacgctgtggatcactttgcttatttctgattcacatattttcctttatgaagtgcctgatcaaatcttttgcccattttaattgactatcatttaatattgagttgtaggagtcctgcatttaaatttcaaagttgaactatacaagatcaggataggggagatttattgttacacatcagttcaaggcctgaagtgtgacttgagcaaaagcacattcaccatttgttcagcaaatggttattagtaccagctatatactaagtactaatactagtgatacagagataatatccagccctagttcaaggaccccatagtttacagggtagacagacaaaagtaaaaattatggtgtggcttcaatgttaagtcagtcactaaatacttactgatgagtatctactgtaggatagatagatactgctgtgggtcctggagctagccagagttcctactctagtatagcttattttctgtagtgtataaggagggagacagagtgcaaaagccctgaggtggtaaataaggttggtgttaggtatatgtggatcagaaaggccaacctggctggaggatagttgcgtggctagatgattagttaggcaagggtaaggtcttgcagggccttgaagaccatggtaagaactttgggttttatcttaagtgttttggaaaggcattccagagttttcagtggaaaaatgacatgatcaggtttctgtttggctaataaacccagaaatgtgtgtgtatggtcgcagaaacactaatgaggaaacatcgcagtcatccagagcagagacaagaaaatccttggggaaaacaggcaagggttcataaaggaataatgtcatattagaaccatggatgacaggacatttgctaggcaggaaagtcaggcatgtgtgttagatgaaccagaaataactttggatgactagttcggtgggtgggtgagtgagcggcaggaggtagagctgatggcaaactgggaagagctttgaaggttgatctagggatgcagggttaccagattgcaaaactaccaaattctatgtaggtatgtcctttggagttgtgcagcaaggtagctttgctagggagtttggctccgaacctaaaggcagctatacggggcttttacttggaatagagactggaagctggcatctgggatgaccaggtggagcagtgctaggacagaaaccaagcaggacgcaagagactaataaggcctgaagttaggtaggggttgttgaactggaagtggaggctttgggcttagaatgaacagtcaagaagatttgaggtgtggatttggggggaaagctgatgaggcctttttatttattttgcttgttttgtttttgttttttatttcatataaggccttttaaaaaatacaaaacagtataaaatattgaaacaatacagaattatggagttcacaaaattcttatcttccactcctttgagctacctaaaacatttgatgcatcttctatttttctgtgtgtgtatttatttatgtttgtattcaaatctgttataaagatacacctacaattgaagtttaaaatggaagtttacaattgaagtaaaaaatggtcatactcttcctattattattattattatttgagatggagtcttgtgtacagtgccatgatctcggctcactgcaacctccaactcccaggttcaagtgattctcctggctcccgagtagctgggactacaggtgtgcaccaccacacccagctgatatttgtatttttggtagagactgggtttcaccacgttggccacgctggtcttgaactgacctcaagtgatccgcctgcctcggcgtcccaaaacgctgggattacaacagtgagccactgcgcccggcctatttttgattttttcataggataccaatataatatagttctggcttgttttttagccactattcagcattccgttgttcagatgtatcatatttagttgatagacctttaagctgccttagatttttcactattcccagcattagtgaaatgagcattcttttttatttgtctctgtactgtgtaaacactgcctgggagagcatgtgaggtgacatgcatggagttcagattgtgacttgggggaagctgtgatcctgatcccttgagggagcatgtattctgctctgggtctgtccttggggaacccccaagggagtgatcaggatggtcagaagtctgcaggccacattctaggggcaacagccaaaagaactgcggctgtttctccagatttcagctgggactgttcacagcttccaggtatcagatgagttctcatagggagatagggtaaggccttcccatggagccctaggctggggaagaactaccaggtagaagtaagaattccacagagttaggtcagtttgggtaggatttgtatggacctagactttctgatgattggattgtaagactgggttttctatcactgggactgttcatgcaggggccagggtgctgtggaggggcagtatgtgaagcaagttgaactctgaagcattccaactttgataacagcattccagatggaaactatgagggaccaagatgaggtgctgtgggctgcgagggaggagcgattgactgaggatcagtataggggagggctgacgctggaggcatctcagggtatagctttgggaaacatggaatgctgagtgaagctcagtgaaagatctgacctcgtgtgcactgctggtggagtggtcttcaggtatatgggccaagggggacacagggataacaagaggtctgagggtgattgttatggtggctgcaggaggacggaattacccaggtgttgtcgtggtgaaccatgcaagaaaataatgttcccagcagagggaaggggtgaatcagagaagcttggtgctgcctgattacaagggcgagacatcagttagtttggagctggctgggcagggagctggggctggagatgaactttcagatttcattctgcaaatatgtattgtctaggtgcttgggatagagcaataaacagaacagctaaatattcctttctcacagaatttatattctagtgggggaaacagtatatacatgtatataatgttagacattgagaaaaagcaaaaaaggggtatgcaatgccaggggcagtggggttgaaattttagaggggctaaaagggagagcctttatatatatatgtatatataaaacagggaagattattttgagtaaagacttgtggggaaagggagcagtgagccatgtggatataatgcagagaaagaacacattccaggtactgcaaagtgtttggggtagaaacaaacttggctggctgggtgtggtggcacacactatcatgccaggactttgggaggctgaggtgggtggattgcttgatccgaggagttgcccagcagcctgggcaacatagtgagaccctgtctctacaaaaaaaaaaaaaaaaaaatagctgggtgtggtgatgcacacctgtagtcccagctacttgggaggctgaggtgggagggatcgcttgaacccaaggggcagaggttgtggtgagctgagatctcaccactgcacttcagcctgggtgacagtgagactctgtctcacgaaagaaggaacaaacaaacttggcttatttgaggagtgacaaagtggctgaaatggagtgagcaagagagacactccgagatcaggttaaagaaatctggaccttccaggaccttataggccatggtatagtttggactttttttcttttcttttctttttggaaatggagtctagctttgttgcccaggctggagtacggtggcgcgatctcggcttacttcaacctccacccgccaggttcaagcgattctcctgcctcagcctcccaaagtgctaggattacaggcgcccaccaccataccagctaattttttttatttttagtagagacagggtttcaccatgttggtcaggctggtctcgaactcctgacctcaagtgagccaccatatctggccaagtttggagtttttctaagctcagtaggaaatgggaagtactagagggttcaggcagaggcgtgatatgacctcacttttttttttttttttttgtgacagagtcaacctcggtcccccaggctggagtgcagtggcgccatctcggctcactgcaagctctgcctcccggattcacgccattctcctgcctcagcctcccgagtagctgggactacaggcgcccgccaccacacctggctaattttttgtatttttagtagagacagggtctcaccatgttagccaggatggtctcgatctcctgacctcgtgatccacccaccttggcctcccaaggtgctgggattacaggcttgagccaccgtccccggccttttttttttttttttttttgagacggaatcttgctcttgttgcccaggctggagtacagtggcacagtctcggctcactgcaacctccacctcctgggttcaagcaattctcctgcctcagcctcctgagtagccaggattataggcacacgccaacatgcctggctaatttttgtatttttttttttagtagagacggggtttcaccatgttggccaggctggtctcaaactcctgacctcaagtgatctgcccaccttggcctcccaaagtgccaggattacaggcatgagccactgtgtccggcctcacttatgttttaataggatcgccctgattgctgtatttagaatagcctgttggggtggacatgggggaacggaggtggagacagcatagaataagggagaccagttgaagaggctaatgctgtaagccaggtgacaaacagtgatggcttagattgggcagcagcagtggaaatagtgaggagttgaacattagcagtagaggtgaggagaattagtagggggatcataactccaccacaagagttagatccccagggttagtgagaaattattggaagaagataatttgtggaggatattatctggatcatagttatatttggggttatgttaggatcagaacttggattagggtctggcctggggccagtaagggggtcagaaagatttattggtctttgcaaagaccaagattagagtctgggtttggacagccctattgggattaagacaaattttagggtgaggatagtttggggtcacagttgtagatggaggctagtaccccttttcaatatcttcagaccagggttggttgtatctgccatcttctgtgccagtgagctcacctaggggtggaggggtttggaggctatgaggccttctcttccttgggtgtcacgggggtggacgtatgctcagccctgcctgggtgatgcctgctggccttcccaagctgggacctgtagtcggggaaggggagagaaggctccctggtgcttgacccagctccttttccctcagatggcccactgcgtgaccttggttcagctgtccatttcctgtgaccatctcattgacaaggacatcggctccaagtctgacccactctgcgtccttttacaggatgtgggagggggcagctgggctgaggtgaggcggattatggaggttaaggttgtggagggaggctaggattgtgttttggggtggaggctgtgactgtgatgcttactggcctctgcccacagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacaggtatgtagggctggggattaggatccttcagatgcaggtctgtgagacaacctagcctgcctggaggtagggggcaagcaggacctaaccctgcctgttatcctgaaactcccttccctgcttttccccagattgtgtccagccaggtactgactctccccttgatgctgaagcctggaaaacctgctgggcgggggaccatcacggtaaggaacccagcaagggttgaggagggacttaacatcaatgaattcatgaggtgatgtagtctcccctacctaggtctcagctcaggaattaaaggacaatcgtgtagtaaccatggaggtagaggccagaaacctagataagaaggtgtgtctggaagtaggccctggtaatccaagagttaaggggccaaggatggtgtatgggggatgggggtgtggacagagggatggcataatggttgtttgttcctgagtcttgtaactggggtctcgcattggcaggacttcctgggaaaatcagatccatttctggagttcttccgccagggtgatgggaaatggcacctggtgtacagatctgaggtatgagacccctgggattgggtgggctggggtaggagataatctcctggggcctgtgactagcaaggtttggaactcagaaagagactgcaggtgggtagagaagtgtggcagctcctcagggggccatgccagagctcactggaggccttggcctccaccttcaggtcatcaagaacaacctgaaccctacatggaagcgtttctcagtccccgttcagcatttctgtggtgggaaccccagcacacccatccaggtgaggagcttgccccctaagtggactgcgctggagaagagaacctggggagggacttattctcatctgccacctggcttgtttatgtccacacacacctttccctcaggtgcaatgctccgattatgacagtgacgggtcacatgatctcatcggtaccttccacaccagcttggcccagctgcaggcagtcccggtgagtgctggtcttgccaggggtgtggaaatgggcctagatagctgaagcttgtgggagagaggaaggagaaggcagctcgagtccttgactgatgctctgagaatttcctaccctaatttttctgtcctcaccaggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtaagttactttaccaagggcaagagaacaggtctggggctcagggtggcctttagctgccttcctcacctcctcccaggtgggcgtggacttcactggctccaatggagacccctcctcacctgactccctacactacctgagtccaacaggggtcaatgagtacctgatggcactgtggagtgtgggcagcgtggttcaggactatgactcgtgagtacctgcttctctgggctatacccgctccctgcagatgcttcagcctctgagcttacagtcccctcactgccttttgcccaatacactgtcctcccacagagacaagctgttccctgcatttggatttggggcccaggttccccctgactggcaggtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatttcaaccccagtaacccctactgtgcaggtaagtttccccatccaccctgaggcaggtctgtccacacaaagaggggcaagcctgcatgagtaaaagggagagtgggggcagatacctgccttcattgtccagagggtggattttatttaattttagtttaatttattttttgagaaagagtcttgctctgtcacccaggctggagtgcggtggcgcaatcttagctcacttgcaacctctgcctactgggttcgagcaattcttctgcctcagcctcccaagtagctgggactacagtcgcttgccaccgtgcctggctaatttttgtatgtttagtagagacggggttttgccatgttggccagggtggtctcgaattcctgacctcaggtgattgacctgccttggcctcccaaagtgctgggattacaggtattgagccacagcgcctgacccagagggtggattttagagctaggcctctggaatcaaatcgtcatgccaggccaggagtggtggctcacgcccgtaatcctagcactcagttgcgaggccaaggtgggtggatcgcttgagcccaggaatttgagactagcttgggaaacatggcaaaaccccatctctactaaaattacaaaaattagccgagcatgatggcaggcgcctgtagttctagctactcaggaggctgaggtgggaggatcacctgagcccaggaggttgaggttgtggtgagccatgatcatgatcatgccactatactccagcctgggtgatagagtgagaacctatctcaaaaaaaaaaaaaaatgatgccacatgacttggggcaggttgcttaatctctgtgtgctttggtttcataagactaaacataggaaattgagtactcaaggagaggatacaagtaaagcagtaagcctggtacttactaagtgttctccgaaaaatggtatctgttatattatcgttattatctttgcctagaagctaacaggtacttacttgagcatcagtggaagccttgtttgcctccttgcagggtgcattttgccagagtccaccaagcccttttgtttagggccaaaccttttgactccccagtacccccaagggggcacaagctgaagtggaaaatctgacctgacctgatctgatctgggttttaaaattttaattttgtatttcaacataagttcagacttagagaaaagttgcaagaatagtcataggagctcagtcccttggaactcaggggtcagggcctgagttcacaggggctcttcacctttatcccaattaccctaacataacattttaccacatttgttttctcttttctcatacatgtatacagtgtgtatgtgtgtgtatatgtgtgtgtgtgtgtacacatgtatacatatacacacacattcacacatttcaagggaaaaaagattaaaaatatgtgtttatgtatgtacacacatgtatacgtgtgttggagaatgctgtagtgaatagccctgcctcaggtttgcttctatggccctaccagctttgtacccatcattatccacctggctttttacctctgagtacttcagtatctcctaaaatcaaagactctttcttacattatcacagaccaatcctcaaaatcaggaaatgaacatctatgctattatccagcctatagcatttattcagatgttgccaattgtcctaatgtcttttacagcaaaagaaaatctcagatcacacattgcgttcagttagcacatatctttttatatggaagacttcttgcctttcatgacattcacatttcatgatataaacagtataggccagatattttctagaatgtccctcagtttgggtttacctgataaatcctcaggattagattcaggttgtacatttttggcaggaataccaccaaagtgatgctgtatattctcagtgcatcatattcagaggaacatgatgttgatttgtcctattaccagtcatgttgactttggtcacttagttaaggtaagatctaccaggtttctccactatacaagtactattttctcctttctatttagtaagtatattctgggaagagactatacaaatactcatcacacacacatcaacattcccctctagtttttttttttttaatttattttttattttttattttttgagatggagtcttgctctgtcacccaggctggaatgcggtggcgcgatcttggctcactgcaagctccacctcctgggttcacgccattctcctgcctcagcctcccgagtagctgggactacaggcgcccaccaccacgcccggctagttttttttttgtatttttagtagagacggggtttcactgtgttagctgggatggtctcaatctcctgaccttgtgatccgcccgcctcagcctcccaaagtgctgggattacaggcctgagccactgcgcccggccttagtttttttattttttaagtgacgggggtctcactatgttgcctaagctggccttgaacccctgggctcaagcagtcctcccacctcagcctcgtgagtagctgggactacaggcacatgccactgtgcctggctatactctctagttttaacatccattgatgatccttgcctgaatcagtcatttctgtgattgtcaaatgattgtgtaattcttccttttacatttattaggagctttcccttctccctcagtaattaatccatagtacggatccttattgtatcaaatggatcattattaaataggttataatctgatgctcaaactctcctggatttgtccaggagaatccctctcatctgggtgctaattcaagctgtgatttagggcaagtcccctcctctctttgaaccttagtttcctcatgtgtaggagacagttaagtaccctggtttacaagggtgaatgaatgaaatgcacccaggttccgagatctcctgggctgggatggggtgatttcaggactggtgtagtcctgagaggtccaggattttacggtatttcttgctctcctctgcaggcatccagggcattgtggatgcctaccgccaagccctgccccaagttcgcctctatggccctaccaactttgcacccatcatcaaccatgtggccaggtttgcagcccaggctgcacatcaggggactgcctcggtgagagtcgtgggtggcagtggcagtggtggcaatcaagggcttccttgagggttatggaacaaaggacttttttttttttttttttttttgagatggactcttgctctgtcacccaggctggagtgcagtgacgcgatctcagctcactgcaacctgcacctcctgggttcaagtgattctcctgcctcagccttcctagtagcttggattacaggcgtgtgccaccatgcccagctaatttttatatttttagtagagacgggctttcaccatgttggctggggtggtcacaaactcctgacctcaagtgatccgcctgccttagcctcccaaagtgctgggattacaggtgtgagccatcgcacccggcctgtaacaagggacttcttatgagtgtggggatgtgtggctggggtgtttgcaggggtttaggaggaggatctgcttcaggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgtgagtaggtgcaaatttgatctgggagtttaccctttcacctttccctgatgtgagtagggttgaggcccaagggatgctcaccttttcctctaagcctgggatatggttgggttcttgagcatgaaatacagactttgggcagctgttctgggccaccactgacttttcccttttcttggcaggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaatgctttgccacc

SEQ ID NO: 10380 - DNA, 121 bp, Homo sapiens
ccaggtgcagtggctcacacctgtaatcccagcactttgggaggccgaggcaggcggatcacaaggtcaggagattgagaccatcctggctaacagggtgaaaccccgtctctactaaaaa

SEQ ID NO: 10381 - DNA, 315 bp, Homo sapiens
taaactttttttttttttttttttttttttgagatggagtcttgctctttcgcccaggccggagtgcagtggcgcaatctcggctcactgcaagctccgcctcccaggttcacgctattctcctgcctcagcctcccgagtagctgggactacaggtgcccgccaccacgcccggctaattttttgtattttttagaagagacggggtttcaccgtgttagccaggatggtctcgatctcccgacctcgtgatccgcccgcctcggcctcccaaagtgctgggattacaggcgtgagccaccgcgcccggccccc

SEQ ID NO: 10382 - DNA, 9308 bp, Homo sapiens; identical to SEQ ID NO: 7907

SEQ ID NO: 10383 - DNA, 224 bp, Homo sapiens
ttttgtatttttagtagaggcggggtttttccatgttggtcaggctggtcttgagctcctgacctcaggtgatctgcccgcctcggcctcctgaagtgctgggattataggcgtgaaccatcacgcccagcccatagtgctcttcagtgtcagttataatgaccaaagttctagcactgtggcctcaacctctaggtctacaactgcattttactaagtgctag

SEQ ID NO: 10384 - DNA, 428 bp, Homo sapiens; identical to SEQ ID NO: 7902

SEQ ID NO: 10385 - DNA, 6149 bp, Homo sapiens
gtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtaaggccaggccttcccacccaggcgccccaatgcctctgtattggtgctgagcctccatctgactaaggcctcccagcctccatgccttctgggcaatgagaattgtttgccttccctgcggatgcccagggcgcctcagctcacccccagcagggcagctaatttgggggaaattgtctccaggtccccagctgcccccactctggactttccaagccttctaccccgtttcttgaccggtcagatgtattactcaattggagaaaatccgcattgagcaatgggtaggagagggaagtccctgccctacaccctccccgggaccttcttatcttatgtggtactccacacggggcctggtggtgagcccagcagaggagacaaaactcactgggaggcatggactcacctgctcagccctgaagcctgggagccctcgggcctccttcccagcgtcatgctgcccatttccgagctgcgtacttccacccacgtcacagttagggaaactgaggacagagagagatcaggcaggccgcccaaggtcttgcagtgagtcatgaccaggactcagccccaccagaaagcctccacttcccactttccggggttcacaggggctgactctcccatctcggccgggcctaggaaccagtattttcagcaaaacctggtgcggcggctgtgtcttgcaggtgtacgtgtctgagattgctcccccaggcgttcgtggggctctgggggccacaccccagctcatggcagtgttcggatccctgtccctctacgcccttggcaagtatggccccgcactcctgtgtgcaggctggtgggaggggtgggtgccgccaaggtagacgtgggtggaaagggaatgatttgtcccagaacagatcctgggctgagaggcaagagatctggcatcccggccccactcagtcagcaccttgctgggcacctccaggcagggcctgcccctctagccacaggcccagtctctagctggggcagccagggcttctcctggacccacagtcgccagactatcttttaacggcagaaagcttccatcaaatgccatctcagatgggaagtccagatagaaaagaaatcacagtgcgtgcagctgctcagttgagggggcgtggaggtcttgggtggaggcctagggccttgcctgcccaacctaccccttcctcatcctgccctggccctaagactttccaaggacttcccactatgtgccaggggctgagcaatccctgcagccccaccctgcctggggcaatcagggtaggcttcctgtaggagatggcccttggactagaccttgaagggcagatgaggttattcagaggctccagagggaaggggctgtaccaggcctggacctggcccctcacccacccctcgcccccaggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacaggtgcaggagggtgtgcgcccgaaccgggcaggcccacctccagcacttcagctgtgtgtggccgtggaggcttttcctggaagacaggaccacagtagttcccactaatccaagtgcctgggttggggtggggggctgttcccagagcctgggtggcctggtaagctggttctttcctggaggagggaaaaaggaggtctcccacacaacccctggcggtccagggcaggatggcgcctgctggagaggctggcccaacgccctcagcggcggccttgtgtttcagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctggtgagagcccagccccggccggcgcccacccacggggtcccctggaggctggcagggcaggggaggcagggcctgctcctgcacttacccaacccctggtcttacccacacctgctctgtgccgggtgtcagggatgccacagcaagatctgagatctgggccttgtggagacagttccagtgccttcacctgttctcagaatgtttttaagataagcttaagtgttttaaaataaaatactggcaaaatcccaacacgaggccaaggcgggaggatcacttaagcccaggagtgtgagactgcagtggccacgatctcaccactgcgctccatcctggtgacagagcaggaccctgtctctaaaaacatatagaaattttaaaaattaaataaaatacatgggattacaaaggaaaccagctttatagaaacgtggaccccttgaggccacagaccccaggttcagagccctgtggcatctgccacttaatgagggaagtcactttcccctctgaacctcaacttcctcctctgcaagatgaagatagcagcacatctccatcagcctgccccaaggctcaaagtgagatgagatttgaagattagtaacagcacggttcagcaagtcatcatcacgcctggattctgtgccagctgggcatagtggtgggcagagcagatgtgtccctgcccaggagccccataggctcggacagtatagatgcccagcacgctgcaggtgccaggccactcagtactgcactgagctgctggcctgagcccctgcaatgcctgccgggacaagctgggtcctggagggggatgggaacagcaggcaggtccctcagccctggtggtctccccccgatagccccccaaggacgacgcagccatcgttggggccgtgcggctcctgtccgtgctgatcgccgccctcaccatggacctcgcaggccgcaaggtgctgctcttcgtctcaggtaagcaccctgcaggcagccctcctgccccactcctccgcatgggtcagggctgggctgggtgtgcaggcctgcctcggggtggggctgtgtggctgggaactgcagagcacctgcctccctagcatcggcagggccctggcccaggccagtggtccagaaaggtccgctggggctccgagtggacacactggctgtgacactccacggtgggagcctaacacgcggctggagacagagcttgctgccctgctgggggtctctagtcccagacacgagctggaccacgcaagtatcaaggggctctgcagaaggagctctgagagaaacagctggctcagagggtcctggccccacgaggccacctgtctgtccacagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggtaggtgtggtggtggctcagaggggcaggctgtcttgggtgttaagggatgggtgatgtgtctggggtggctggagaggggggtctccagcagctcagcggagacagacacagccgcctccagtcaccccacagggcctgaacctgcctcctcctccgagcaggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtggtgagtgttcagccccaggccccaggcccctaggccctcgctgactggccaggacccttctcagtgccaggggctgtgccaaggcctgctgtcaggaccctaactctcagtgaccctaggagatgagcacacaccccctgaactcagagaccccagagtggtcacgtgatagcctagcaaacgctcttcattataagaaacaggaacgggcgtaggcaactgttctgggaagtcaggttacctcctgggccagggcaggacatggcccaggaccctgccaggggccccggaagccacctccccaccgtgcctcatctcccgtcctcctgggcgctgggtctcagcagcagccacactcccccctcaaccccacccactccccctgcctcctggttcaaaactacgggccctgtgaccagccagaatctgtgaggcccagagtaagttcccatgagggagaagctggctagggcagcctaggccagcgcctaagctgtccctgcagtggtcagggcaggggggttgggggagggcaggcaacccagagtgagtccatcagcctagagggtccaagaagaacctgcgtgcccaccaggctgcagggcgggcctcctgcaggccgcggcatggaacagctgggatgccagcgctgggtagggggtgtggagggggtacctgagctgacgccagagggcccagcccctgaggaaggccgaggggcagacgggatgcagacttcaagggctacttcggatttgtcctggggacagtgggggagccctggtgtgggggggcggtctctgaacacaggaaggaccagatgaaggccccacagggctggtcactaccagcagcgcccacgagctcctctggggcaggaggaccctggagcttctccctgtgacccggccccgctcttcacccgcagagcaccttcggcctccaggtgcctttcttcttcttcgcggccatctgcttggtgagcctggtgttcacaggctgctgtgtgcccgagaccaagggacggtccctggagcagatcgagtccttcttccgcatggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgta

SEQ ID NO: 10386 - DNA, 8031 bp, Homo sapiens
gctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcgggtgagagtcgctaggttgggggctgcgggtggggcctgggggtggccctggttccctccagccggcggcaggctcccgccctgggcctcccctgacctagtcgccaccgaggggccatctggctccctcctgtcccagacacgctactcctatttaaggaactggtccccctaagggaaggaacgatccacgagagtaccgggcccagccccccactgccacagacagtgagactgaggccccagcgagcaggggttctgcctgaggtcacacagcaagcctccagccgccgccctgggggcagaaccagagcctcctcttccggagaaaaggccccagcaccagaggctcagccactgcggatgagctaacaatggcctgggaatttcccaggggagctggggctcaggccctgggaacgtgaatggccttggacccaggcgtccctagcactgcccgctgagccgggcagccactgggttcagaaaaggcaatggtccctggaggagggactcagagaccctggtctttttgtccgccaccatcaccaggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttggggtaaggaccatcctctggaggagggtgggtgcaggaaggagggacctgctgagccttatctccagctaggaacctcccaaattctccaccttgggggtccctccagggccctggtcccccctcccccagccatccaggccactagtgggtggggtaaagctacaggattcctctgaaatgaggaactgaaagccagtggagagggtgagggaaggagcaggtggggaggtggctgtcagggtctatactaggtggggctgaggcttccccgggtccccacacccacagttggctggatgggggcaagggtatcaggtgtcagtggggagaggcactggctggggcaaggagagtccgcaggacagattgtgggctgatggagaggaagatcccagagtcccagagtctaaaattataatcttaatagcctcatatgtagagttgttaacatagtagttaagataaaaattcccaaggtttactgagcacttcctatgtgccaggcatgtgttgggcactgaacgttcattgattctcagggccaacgccacgaggtagaacttgcgctctccccataagacagctgaagaaactgaggtgcagacaggctgggcaatgtgcccaggtcccactaccagttagcagagtccagagggggtcccagttgctgctgtacagggaacttaagaacctccaaatcttaaagcccagtaccttcaagtcacagaattctcctgtattaaaatattagacatttaaacatcaggctggacagaaccactgtggatatgtggcgcagcacctcttccttagagcagaattccccgtttgggcatccctaacaaatggctgttccttgaagacaggaggctccctgtttcaagtgcttgacttggccaagtgcttgaccagctcctggggtcggcctagggaagaagctgtccctggactctgatgagactggggtgccaagtgcccagacatatctgccctgcacccccttcccctgcagtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtaaggccaggccttcccacccaggcgccccaatgcctctgtattggtgctgagcctccatctgactaaggcctcccagcctccatgccttctgggcaatgagaattgtttgccttccctgcggatgcccagggcgcctcagctcacccccagcagggcagctaatttgggggaaattgtctccaggtccccagctgcccccactctggactttccaagccttctaccccgtttcttgaccggtcagatgtattactcaattggagaaaatccgcattgagcaatgggtaggagagggaagtccctgccctacaccctccccgggaccttcttatcttatgtggtactccacacggggcctggtggtgagcccagcagaggagacaaaactcactgggaggcatggactcacctgctcagccctgaagcctgggagccctcgggcctccttcccagcgtcatgctgcccatttccgagctgcgtacttccacccacgtcacagttagggaaactgaggacagagagagatcaggcaggccgcccaaggtcttgcagtgagtcatgaccaggactcagccccaccagaaagcctccacttcccactttccggggttcacaggggctgactctcccatctcggccgggcctaggaaccagtattttcagcaaaacctggtgcggcggctgtgtcttgcaggtgtacgtgtctgagattgctcccccaggcgttcgtggggctctgggggccacaccccagctcatggcagtgttcggatccctgtccctctacgcccttggcaagtatggccccgcactcctgtgtgcaggctggtgggaggggtgggtgccgccaaggtagacgtgggtggaaagggaatgatttgtcccagaacagatcctgggctgagaggcaagagatctggcatcccggccccactcagtcagcaccttgctgggcacctccaggcagggcctgcccctctagccacaggcccagtctctagctggggcagccagggcttctcctggacccacagtcgccagactatcttttaacggcagaaagcttccatcaaatgccatctcagatgggaagtccagatagaaaagaaatcacagtgcgtgcagctgctcagttgagggggcgtggaggtcttgggtggaggcctagggccttgcctgcccaacctaccccttcctcatcctgccctggccctaagactttccaaggacttcccactatgtgccaggggctgagcaatccctgcagccccaccctgcctggggcaatcagggtaggcttcctgtaggagatggcccttggactagaccttgaagggcagatgaggttattcagaggctccagagggaaggggctgtaccaggcctggacctggcccctcacccacccctcgcccccaggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacaggtgcaggagggtgtgcgcccgaaccgggcaggcccacctccagcacttcagctgtgtgtggccgtggaggcttttcctggaagacaggaccacagtagttcccactaatccaagtgcctgggttggggtggggggctgttcccagagcctgggtggcctggtaagctggttctttcctggaggagggaaaaaggaggtctcccacacaacccctggcggtccagggcaggatggcgcctgctggagaggctggcccaacgccctcagcggcggccttgtgtttcagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctggtgagagcccagccccggccggcgcccacccacggggtcccctggaggctggcagggcaggggaggcagggcctgctcctgcacttacccaacccctggtcttacccacacctgctctgtgccgggtgtcagggatgccacagcaagatctgagatctgggccttgtggagacagttccagtgccttcacctgttctcagaatgtttttaagataagcttaagtgttttaaaataaaatactggcaaaatcccaacacgaggccaaggcgggaggatcacttaagcccaggagtgtgagactgcagtggccacgatctcaccactgcgctccatcctggtgacagagcaggaccctgtctctaaaaacatatagaaattttaaaaattaaataaaatacatgggattacaaaggaaaccagctttatagaaacgtggaccccttgaggccacagaccccaggttcagagccctgtggcatctgccacttaatgagggaagtcactttcccctctgaacctcaacttcctcctctgcaagatgaagatagcagcacatctccatcagcctgccccaaggctcaaagtgagatgagatttgaagattagtaacagcacggttcagcaagtcatcatcacgcctggattctgtgccagctgggcatagtggtgggcagagcagatgtgtccctgcccaggagccccataggctcggacagtatagatgcccagcacgctgcaggtgccaggccactcagtactgcactgagctgctggcctgagcccctgcaatgcctgccgggacaagctgggtcctggagggggatgggaacagcaggcaggtccctcagccctggtggtctccccccgatagccccccaaggacgacgcagccatcgttggggccgtgcggctcctgtccgtgctgatcgccgccctcaccatggacctcgcaggccgcaaggtgctgctcttcgtctcaggtaagcaccctgcaggcagccctcctgccccactcctccgcatgggtcagggctgggctgggtgtgcaggcctgcctcggggtggggctgtgtggctgggaactgcagagcacctgcctccctagcatcggcagggccctggcccaggccagtggtccagaaaggtccgctggggctccgagtggacacactggctgtgacactccacggtgggagcctaacacgcggctggagacagagcttgctgccctgctgggggtctctagtcccagacacgagctggaccacgcaagtatcaaggggctctgcagaaggagctctgagagaaacagctggctcagagggtcctggccccacgaggccacctgtctgtccacagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggtaggtgtggtggtggctcagaggggcaggctgtcttgggtgttaagggatgggtgatgtgtctggggtggctggagaggggggtctccagcagctcagcggagacagacacagccgcctccagtcaccccacagggcctgaacctgcctcctcctccgagcaggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtggtgagtgttcagccccaggccccaggcccctaggccctcgctgactggccaggacccttctcagtgccaggggctgtgccaaggcctgctgtcaggaccctaactctcagtgaccctaggagatgagcacacaccccctgaactcagagaccccagagtggtcacgtgatagcctagcaaacgctcttcattataagaaacaggaacgggcgtaggcaactgttctgggaagtcaggttacctcctgggccagggcaggacatggcccaggaccctgccaggggccccggaagccacctccccaccgtgcctcatctcccgtcctcctgggcgctgggtctcagcagcagccacactcccccctcaaccccacccactccccctgcctcctggttcaaaactacgggccctgtgaccagccagaatctgtgaggcccagagtaagttcccatgagggagaagctggctagggcagcctaggccagcgcctaagctgtccctgcagtggtcagggcaggggggttgggggagggcaggcaacccagagtgagtccatcagcctagagggtccaagaagaacctgcgtgcccaccaggctgcagggcgggcctcctgcaggccgcggcatggaacagctgggatgccagcgctgggtagggggtgtggagggggtacctgagctgacgccagagggcccagcccctgaggaaggccgaggggcagacgggatgcagacttcaagggctacttcggatttgtcctggggacagtgggggagccctggtgtgggggggcggtctctgaacacaggaaggaccagatgaaggccccacagggctggtcactaccagcagcgcccacgagctcctctggggcaggaggaccctggagcttctccctgtgacccggccccgctcttcacccgcagagcaccttcggcctccaggtgcctttcttcttcttcgcggccatctgcttggtgagcctggtgttcacaggctgctgtgtgcccgagaccaagggacggtccctggagcagatcgagtccttcttccgcatggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgta

SEQ ID NO: 10387 - DNA, 10827 bp, Homo sapiens
gcagaagggagcagagggcaggcacgcgagccacggccacgctttattgcttaagacgcacacagaacacagaggaacaaacaagaaggaaagggcgccacacacagcccagaccaggcaggagcggcccagccgccggaagagacgttccttgcaaggcagggcccctgctggacagcacgccccctgggcgacagggtcagggaccccaggactgcacagctgcagacttgctgggaacctgggacaggtgacacgcccactctcgcctgtggcccagggccttccacctctgcatccagccatgcacccaccatttccccacagggtacaggggcagccttccttgatccacagccaacccttctcctgctgtctctggctgtcagtgagacccctctggaaagggcagaagcaggcaagccaggcagaagggggcccggggtcccactacctgggtaggaatgagcagagggcgggcagagcccttgctccttgtgggaggtagacaggtctcactgcatacatgggacagatgtgtgcacccacacacatatacatacacacacacacacacacacacacacagccctttgaacccagcactggcctgaggaaggtggccccggaggaaccctgaaggcacatgtccaccaggctataatgcccctgccaccctggggctcagctggccagactcccaggggtgggatgctgctgacccaggagcccaccaagtccccagggcagtactgggcagggcccagaaaaccccacgcccagcccaccagcctgccactcctggcctcagatgccactcccggcctcagatgccactcccagcctcagacgcagatgggcccgagaggtgttcctgggaaacagttcacttagcaagacccagtacctgcgctccagaagctcagcgcaggcccagcctggggttggccccagatggaatatcttccacacccgcccgcttctgccaagccccacctgggctaagccaggcccgaccaggcacctgcccgatggctgagagccagcctcacggtcagagaggccagcgggctgaggccacagggcagagggaatatgggggtgcacatcctgggcaccagctctctgcatcctccctgggtaggcctggctccggacagcctggcacccagggcagtggggacagctctgtgtggggaggtgactgtggcctctgcccagttcttaaaaggcagaagctccctgagggcagggcttgggcaggccagcaggagcacctgagtggggctgaggtcagacccgctaacccactaatggggctgggctgtggctgatgttgacggggccacaccagggagagggtgggcaccctcggtgccagggagagcctgctctccccacttccttagcaccaaggccagcaggggcggggggtgatgggcagaacctaggggccccagcaggcccagggaggaggggcagccgaggggccttgaggtggcctgtccaaggttcccagggccagcagggagcatcccccacccagctgtccagtcactgccaaggctgcagttccaggtaccggggtgcaccttaggagccctgtgggcttcttcagaaggcagggtgacagtgggcgctgcaccctaggcagcagtgggaggttgctggcagcggcaggctgtcccaggccctggggctccacctgctaagagagctgggggaggtccctctgctcagtgcccaggtggcagggtcccacttgcccctcccctcaagccaggaccagcatctccaggggaagctgctcccaggtcacagcaggtcacaggcagccctgtctgtggtgtgagatctgcagacccacccagcagaggagtagggctgggtagtgtccacacagctgctgcaggctctgcctcaagtccagcagcccagaccctcacaccagcagccagtggctcctggcttaagccagtctggagaaaggagcagaggactccaggtgtagggacacgtgcaaaggcccctctccaggctgtgcctcagcgtggacagtccaggcctcacttggacccacacagagccagaagaggggacagggagggaggggcgcccagcccttcacagctccccctccagggtctccgcgagcttctcctcatccgcctgctgcctctgctgctggatcctggcataggagatcgcatcgcccctggggagagagagaggcagcgtcacgtggagcaccagccccatgcccacagccctcctgaccactgcccggttcctgccctgtgacccaggtgtgacctgcaggcattctgatttccccagagacaactgctggggtggcaaaggcctgtcttgtcccctctgagaatggcccaggctccctgggatgctgggctgtgaaggaaccagcctcagtctgggctctgcaggagagagggtggcaactgagtacaatgcccggtgcagacctgggaggggaaggggctcccaccagccatgtttttgctatccttgctgcaggccgtgacggggcaagactgggccacgcagaagtgttgtaagtcctctgtcttcacccactcgagctgagccctggaggcaccaatgagttactgggacctctgcctcggtctccactagctaaaaggggccactctcagatcctcctcactgaaggacttcggggggcggagggaggaaggccctgcccaggggctgggcctggcagacgcactttttgcccagagcagagagtccgtacagcacccccgtagcaaaggcgatggcgttgcccagcagcgtggtcagggtcaggctgatgacgatgggaacgaccgccatcctggggggaaagcagaggtcaagggggcactccggccccacagccaccacatccttccccgcttcccagactcggcccagcatccttcctagacacccagggcacaggaaggatccccaaaaatcaactgagacacagcttcagaaagtccttcatcagccctgaacttgtctgtaaaactgttccattctgggaataggatccaaagctttcatcagatttttgaaggggtctgtgatcccaaaaagagctaaacagtaacgagatggtccagtgccctcactgtgagaaaaactggccagaaagtgcctgtgacagagaatctggcttcccatccaggacctactagcttcgcgggcaagttactcggaatctccaccgcggagaggggatcaaagcttgtccgaggtcagtcatgttacctacacaatgctgaccaccacaggcactaaataaatgctctgagttatagagtaacaccagccacatcgccacaagtaaggtccctggaattcaaccacatggaacacagggtctcatcatgggagggctgcaggctgcggggtctgcggggtcggcccagaccttgctgcagtttggcgtcacctggtggcagggtccactggggcttaagcgtccccggggctgattctccatcctggctggaatttccaggccagcagcaattcctgggctaactgggccaggaggatacctgcagcctggaggccagcgctctgtcctgtcgcctccctagaggaggctgcctgtgcaggaggacaagactcgtggccaattgcattctacctcagtttccattcttgtagacatgtggttgtgagatttttctgtcgttaaaaaatttcaaaatgataaaataataatagaaattacaaagaaaaagaccacggcggggaaccttctgacaaaaacaaaattaaaggcaaacaagagcctggaaaaatagttgcaggaaatacaaccaaggatcatgaaatctttaatacagaaaacacactgaacttgctaagcagaacactgaggttcccacaggttaaaaagtaaactcgaaaattttcatatcagaaaatgcaatggaaacacgtgggaaaatatttttccctcttagataacaaatagataaatgcgaatgtgaagtggtgtgcagccctgggctggggtgggggcgggggagagactcaagggacctctttggaaagcaacgtagccacgcatcttaaaatatttttaatgatcagaatctttgacccagtaattccacacctgaaaatagatattaaggaaatcatcataaacacagaaaaagttttagcagacacatgtttatcacacctcgatttacaccagttaagaaattaagaacagcatgatacatccagctgaatgaatattcctgtattgaaagaatgttataaagtctgtggtgatgttcaaatgcttatatcattactctaagtgaaaaaaggcaggatacaaacttattcataatggttataactgtgttaaaagcaggcttttaaaaaatgcctgcagacaggaagcacacacatcagaagattagcaggcagcgggcttcgagtaacattgttctatattccaaattattgtgaatgaatttctatgatgtctagcatttttaaaatacagttttttgaacccctaaggacatgacactgcgtgtagataagagctttgtgatcctgtgttcttcgtgatttagatatggcacaagatggctccagaactaagcatgtggcttgtgctcttaccatcaaaactaccgggcctctctgaaggggaagcaagcttgcatctagacttctttctaaagataacctagacaataatgaatacagctgccaccagcctcctatgcactagaggcattattctaggagtttccgtgtattaagcttatcctgaaattagttccttcttatgactgagaggagaagtattacatattgatttcattgttagaaatgggaaaatttttaacaagtgtatttagagggcaaccacattttctgctctgcaacctgcttctcccccttcacgtcaggacatctagatgaacccactcttcggaaaggctgcagagaaacatgtcctacagacctactatcatctggttaacaactcccagtggacggaccaaaattccagacgcttcccactttctctccactgcacggatgctgccacacatgctcatatacctctgaaccttccagtgactacggcacagcgacagctgagttcctgggcgcagaaccactggggcacgttttggcagctatgagcaaatcactgtgcacaaaggcaatcccagtttacacttccacagagaggaactgaatacactgcccaccctcacctgacttttgggtcctattttgtcagtggggttttggggaactgtgtcacgggaccctgcccagcaacccctcacccgcagtagaagacagccttctgccaggagcgcagccggtccaccttctccgccactgtgtttgcaaactcgatgaactggcagcagaagggcgcctcacacagcaacaagatgaaggcattcatgctgcagggaccagggcaggagaagagcagcgactgacaatcccaggaggatgagggcggcccccagtgccagtgccataaggaatgccacctccctcaccctcctgccctcatccctcctcctctgggaagccgcccggctgctccagggcacctgctcgtacccctcggagagcctctgctgaagactccagcactccccagctgctcctgcacacccatctccccagctgaactgaacactcctagagggaagcccctgggcttctgcttccctttatcctcctcctgtgtgacatggaggaaaggggaccccacatcatggcactgctacaacgctgcggcaggttcatccacagatggagcactggcagctgtgtcctctgtctgctgttagtattatcgccatggccaccaaaagccgtcagtggcaccagcaccaggaaggctgccccaccagggaggcagagagctggagccacgcagtcccgaaacagtcacggagagctgcccacacacctgatgccaccggccccaggcccggggacacccaggggaagcccacgctggggaggaagaactttagcaagtccttgcatccagccctatgtttggggtgggaacagctaagccactggtgacggaaggtgtctgctgtggtcttggtattctctatgcatggataacaatcagttagcagacactgagccaggcccttctgtccccaggcctgggagaaaagtgccatcattatgcctgtgtaacagaaatgcaggctcaggacacctaagagccaccccaagcccggggcaggcactctcttcacaactcttaaccactgcacccgccccgagcctcccacacaccaggcctccaagcacgggctcactctgtgctgggccagcccttccacttcaaactcggccaggctccgactccaccccctgaagctgggctgggcgcctctctgtccatcccccttccctatccaccactggccagcacaagcactgaggaccccaccacagcaggcccccgaggctctccactggccataggtcactggggacgggacctgaatctcgtctagctctgtacccctcaaggcaccaagccccatgaggacactcatcaattcctggtgcaccgccacttctcacgtgccccaagccacacgggcctgccctcaccccgccttcccttccgatgggatggcgaaaccctggcaggaggtgggcatggaacgcacatgagggtgttctgaccacgggttcccgtgacaactccgacccgcctctcccatctatctttggcacagctccgagctcgagtgccctctcccagcagaccattcaacccagtcctcagccagccccaatgaacagccttccccaccccagtcctgggagctcccagagggcgagggccccagtatagtggacttggcatctgcagtctcagtggatgctccagaaatgtctggagcactgatggccttgcccctgcaccggatgaaggccggggtgggcattccctgggccttgacctctcattaggaaactaaacatggtgggggtatgaaggggaagaagccgcatgctgtggccagaaactcacatgcccgaggcacccaggctggagccagtagccatggcaaccacaaggatgcccactcccacggcccctgccactcctctgtcccgggaggtgcccagcagattcccgaccagcaagacccccggggtgggacggccatgcattactcacatcatccacacgccggccgcgatgttcagagggtggatggtgatgcagttgaagaggccagagatcgcgcaagcttgaaacaagagacacgggcaggagtcagcagggaggcaggcggagcccgctgggaaggcggccttgggagatgactggaaaggacgagagtctctgcggatgctcagcacacagttctcacagcacccagaagcctgccctctatcgtctgagacaggtgaggagacgcagagaggtgcagtgccttgcttgccccaggccccacagcaaggtggcagcaaggtggcaggtggatctcacagcatcctctccccgtttcagggctcagaggagctggccctctgaccccagctacatcaatatccacctcaaagggaggttaggattaaagaaggattaaagagtgaatgtccctcaaggattcaggccagtgctcccccaagactcagccttcggtaagggtcacttgccaccattcacagggccggccacacaagaagtcctctgactcagaaaatgtggcttggattttggttgggacaaggggtgcctctctcagaacagagatgggaaccaggtaagactgagcagcagttccagctctaacttcctcaccagccctgtgccactggcacgctatcttcatcttcctagacccgtttctcctcttgcacatgagcaagtcccacagcccagccacccaccgctgaaatgccataaggccaggaaggggagggggcatcgttttccaccccagaacgtggcttctctgatgctcagatgtgcagccttgacgccccgcctcccagctgcacctcaccagcagggtctcttgcacccaactccctcctccacccacagcctgcagcctggcttcaccaggaactccaggagccttcaaggcaggtccaaggaggtggctgctgggcagggagcaagcccaggccatcactgaggggggccttggaggcagcaattagcacccagctcattaaacttgcagcagctcctctgcacctgatccctccacctgggtctggaattctgctgttttccattttcccaggtaaccttatgcagacagcaggcaaagaagccagataaagtgagccgaactgcaatgggactgcttcatgggcccccagggtctccttctaaaacaaaggactcaagcgttgcactgctcctcagcacagccttagacatctgccttcagacagcaaggtgttccagaaccacaggtacacaggggcctgcctgtcctagcagagtgcccaaagggtgacacggctccctgcctctctgctgtgcctggcctcacctgacagctcggctgtgcttcctgctgcagtcagcatttggcctccagctccaaccctaccccagctgtccaacccacagccagccttgggggaggaccaggtgtcaagccagaccagcaggctccagccaggaatcctttagcaataaagggctggaggatgtccacttgggggcctcaatgctgatatcttccacgtgagggggctgtcaccatgcaatcctgtcccctcccaaggtatcacctccagatgctcttaggacccagggtagaccctctccaggtactctctctgatcccctcaccctggaggaggaaaaccttacccaaggaccagcccggcacacaacccttgtctgaactcctgccgcatctctaaaacaccctgcatttttgcattctaccctgtaatacagcattttgatgttcacataaccatgcccccaaaaatctgcagatgcaactgacaactcagggcaatgccgcaagtttctcctgaagcttcatctgtagacccaacagagccccaggaactcccaggaaaggcagaggtacctcactttgagaggcacagaactgagtaagactccacagcaaatctgggagtcggcagggccactgaccaagaaggaaggaggtgtggcctacaggccatagtcaggacctttcctttctcaccactgaccatgtcaccccactgcactgcccaccctaatctgcagggaaaacagctaaccagacatgacaggactggatccaatgcctaacttcaaacccaccagtctctactacaaagtcaaaagcgtacttgccctgaagagcagtgacacaaactcggggcctttttgtgatttgggggtagggcctgccctaccgtatccgttgcctctggataagggcatgcctagcgagggcagcacactcctagcccagcaccctcctgcctcaacctccctccaccctctacccacctggaaaggctgtggaacccaaggtgaccctgaaaaggtggtccttctggcaggattgctgatggggcctgccctgcccaggcccagagctagccctctctgccaggcaggcactgtttaaaccctgcagacatcctcgacagacattctctaagaccttgcccactccagtaatccacaagattgagggcagacaggaaaggaaagggtatcactcagacagacttgtctttccctggaaggccagctgtacggcttccattcactcctggagctgacctgcctccctctttgtccttttctggctgtgcttaagagcctagcttccctggcagcctaaggtcagggtctgtgactgggatgcgtgcggagaaggggaggaaggccggtgacaggcggctaaggcagcagcaacgggggagatatgagagcggacagaggacccagggagaggccgggccctcagctcactgccccgcggccccaggggccacctgtgccctgacaccacctgaccctcagcaaacttccgcccagtggcttcctgccagaaatctagccagccgtgcacccgcctcccttacaaacaatccttgcccaaaggttagcaatgtggctgccgtcacctacgcccaagtcaacagttgacgctttagtacgggccaggtgggcatgcgccccgtgagcatcaccgagaaagtctcacaaaagcccctggggagcggggggagggctcagtcacgtgccccaggccggtgccccacccccgcccccgcccccgccgcccccccgcccccgccgcccccccgcccccgccgcccccccgccctggggtttctggtccctccgggaatgttcccagaagcgccagcccagcccagcccggggtaccaaggcgcccaggcccgagcgggtaaccatggcaaccccaggacgccggctcccggcggccccgccattcctccgccccgggaggcgcccggcagacccccgacccccagcgggtcctttcccctggggccgccggggcggggcggggcagggcagggcgaggagcgcatgcgcggcggggccggcccctctccccgactggatactcacagactgcccccagcaccccagacaggcgacacagccagcggtaccaccacgtcatgccctcttcctgcgcgggcggcgcagagctggcggacgccccgggcgccccacctgagctgctcatggtgccaccgtcaggcgcagctcacagccctcacaaagggctcggtagccggccgcgtccgagccggcgcgctgcc

SEQ ID NO: 10388 - DNA, 128 bp, Homo sapiens
gcctgtaatcccagctacttgggaggctgaggcaggagaatcgcttgaactcgggaggtggaagttgcagtaagctgagatcgtgccactgcactccagcctggccaacagagcgagactccgtctca

SEQ ID NO: 10389 - DNA, 10828 bp, Homo sapiens
gcagaagggagcagagggcaggcacgcgagccacggccacgctttattgcttaagacgcacacagaacacagaggaacaaacaagaaggaaagggcgccacacacagcccagaccaggcaggagcggcccagccgccggaagagacgttccttgcaaggcagggcccctgctggacagcacgccccctgggcgacagggtcagggaccccaggactgcacagctgcagacttgctgggaacctgggacaggtgacacgcccactctcgcctgtggcccagggccttccacctctgcatccagccatgcacccaccatttccccacagggtacaggggcagccttccttgatccacagccaacccttctcctgctgtctctggctgtcagtgagacccctctggaaagggcagaagcaggcaagccaggcagaagggggcccggggtcccactacctgggtaggaatgagcagagggcgggcagagcccttgctccttgtgggaggtagacaggtctcactgcatacatgggacagatgtgtgcacccacacacatatacatacacacacacacacacacacacacacagccctttgaacccagcactggcctgaggaaggtggccccggaggaaccctgaaggcacatgtccaccaggctataatgcccctgccaccctggggctcagctggccagactcccaggggtgggatgctgctgacccaggagcccaccaagtccccagggcagtactgggcagggcccagaaaaccccacgcccagcccaccagcctgccactcctggcctcagatgccactcccggcctcagatgccactcccagcctcagacgcagatgggcccgagaggtgttcctgggaaacagttcacttagcaagacccagtacctgcgctccagaagctcagcgcaggcccagcctggggttggccccagatggaatatcttccacacccgcccgcttctgccaagccccacctgggctaagccaggcccgaccaggcacctgcccgatggctgagagccagcctcacggtcagagaggccagcgggctgaggccacagggcagagggaatatgggggtgcacatcctgggcaccagctctctgcatcctccctgggtaggcctggctccggacagcctggcacccagggcagtggggacagctctgtgtggggaggtgactgtggcctctgcccagttcttaaaaggcagaagctccctgagggcagggcttgggcaggccagcaggagcacctgagtggggctgaggtcagacccgctaacccactaatggggctgggctgtggctgatgttgacggggccacaccagggagagggtgggcaccctcggtgccagggagagcctgctctccccacttccttagcaccaaggccagcaggggcggggggtgatgggcagaacctaggggccccagcaggcccagggaggaggggcagccgaggggccttgaggtggcctgtccaaggttcccagggccagcagggagcatcccccacccagctgtccagtcactgccaaggctgcagttccaggtaccggggtgcaccttaggagccctgtgggcttcttcagaaggcagggtgacagtgggcgctgcaccctaggcagcagtgggaggttgctggcagcggcaggctgtcccaggccctggggctccacctgctaagagagctgggggaggtccctctgctcagtgcccaggtggcagggtcccacttgcccctcccctcaagccaggaccagcatctccaggggaagctgctcccaggtcacagcaggtcacaggcagccctgtctgtggtgtgagatctgcagacccacccagcagaggagtagggctgggtagtgtccacacagctgctgcaggctctgcctcaagtccagcagcccagaccctcacaccagcagccagtggctcctggcttaagccagtctggagaaaggagcagaggactccaggtgtagggacacgtgcaaaggcccctctccaggctgtgcctcagcgtggacagtccaggcctcacttggacccacacagagccagaagaggggacagggagggaggggcgcccagcccttcacagctccccctccagggtctccgcgagcttctcctcatccgcctgctgcctctgctgctggatcctggcataggagatcgcatcgcccctggggagagagagaggcagcgtcacgtggagcaccagccccatgcccacagccctcctgaccactgcccggttcctgccctgtgacccaggtgtgacctgcaggcattctgatttccccagagacaactgctggggtggcaaaggcctgtcttgtcccctctgagaatggcccaggctccctgggatgctgggctgtgaaggaaccagcctcagtctgggctctgcaggagagagggtggcaactgagtacaatgcccggtgcagacctgggaggggaaggggctcccaccagccatgtttttgctatccttgctgcaggccgtgacggggcaagactgggccacgcagaagtgttgtaagtcctctgtcttcacccactcgagctgagccctggaggcaccaatgagttactgggacctctgcctcggtctccactagctaaaaggggccactctcagatcctcctcactgaaggacttcggggggcggagggaggaaggccctgcccaggggctgggcctggcagacgcactttttgcccagagcagagagtccgtacagcacccccgtagcaaaggcgatggcgttgcccagcagcgtggtcagggtcaggctgatgacgatgggaacgaccgccatcctggggggaaagcagaggtcaagggggcactccggccccacagccaccacatccttccccgcttcccagactcggcccagcatccttcctagacacccagggcacaggaaggatccccaaaaatcaactgagacacagcttcagaaagtccttcatcagccctgaacttgtctgtaaaactgttccattctgggaataggatccaaagctttcatcagatttttgaaggggtctgtgatcccaaaaagagctaaacagtaacgagatggtccagtgccctcactgtgagaaaaactggccagaaagtgcctgtgacagagaatctggcttcccatccaggacctactagcttcgcgggcaagttactcggaatctccaccgcggagaggggatcaaagcttgtccgaggtcagtcatgttacctacacaatgctgaccaccacaggcactaaataaatgctctgagttatagagtaacaccagccacatcgccacaagtaaggtccctggaattcaaccacatggaacacagggtctcatcatgggagggctgcaggctgcggggtctgcggggtcggcccagaccttgctgcagtttggcgtcacctggtggcagggtccactggggcttaagcgtccccggggctgattctccatcctggctggaatttccaggccagcagcaattcctgggctaactgggccaggaggatacctgcagcctggaggccagcgctctgtcctgtcgcctccctagaggaggctgcctgtgcaggaggacaagactcgtggccaattgcattctacctcagtttccattcttgtagacatgtggttgtgagatttttctgtcgttaaaaaatttcaaaatgataaaataataatagaaattacaaagaaaaagaccacggcggggaaccttctgacaaaaacaaaattaaaggcaaacaagagcctggaaaaatagttgcaggaaatacaaccaaggatcatgaaatctttaatacagaaaacacactgaacttgctaagcagaacactgaggttcccacaggttaaaaagtaaactcgaaaattttcatatcagaaaatgcaatggaaacacgtgggaaaatatttttccctcttagataacaaatagataaatgcgaatgtgaagtggtgtgcagccctgggctggggtgggggcgggggagagactcaagggacctctttggaaagcaacgtagccacgcatcttaaaatatttttaatgatcagaatctttgacccagtaattccacacctgaaaatagatattaaggaaatcatcataaacacagaaaaagttttagcagacacatgtttatcacacctcgatttacaccagttaagaaattaagaacagcatgatacatccagctgaatgaatattcctgtattgaaagaatgttataaagtctgtggtgatgttcaaatgcttatatcattactctaagtgaaaaaaggcaggatacaaacttattcataatggttataactgtgttaaaagcaggcttttaaaaaatgcctgcagacaggaagcacacacatcagaagattagcaggcagcgggcttcgagtaacattgttctatattccaaattattgtgaatgaatttctatgatgtctagcatttttaaaatacagttttttgaacccctaaggacatgacactgcgtgtagataagagctttgtgatcctgtgttcttcgtgatttagatatggcacaagatggctccagaactaagcatgtggcttgtgctcttaccatcaaaactaccgggcctctctgaaggggaagcaagcttgcatctagacttctttctaaagataacctagacaataatgaatacagctgccaccagcctcctatgcactagaggcattattctaggagtttccgtgtattaagcttatcctgaaattagttccttcttatgactgagaggagaagtattacatattgatttcattgttagaaatgggaaaatttttaacaagtgtatttagagggcaaccacattttctgctctgcaacctgcttctcccccttcacgtcaggacatctagatgaacccactcttcggaaaggctgcagagaaacatgtcctacagacctactatcatctggttaacaactcccagtggacggaccaaaattccagacgcttcccactttctctccactgcacggatgctgccacacatgctcatatacctctgaaccttccagtgactacggcacagcgacagctgagttcctgggcgcagaaccactggggcacgttttggcagctatgagcaaatcactgtgcacaaaggcaatcccagtttacacttccacagagaggaactgaatacactgcccaccctcacctgacttttgggtcctattttgtcagtggggttttggggaactgtgtcacgggaccctgcccagcaacccctcacccgcagtagaagacagccttctgccaggagcgcagccggtccaccttctccgccactgtgtttgcaaactcgatgaactggcagcagaagggcgcctcacacagcaacaagatgaaggcattcatgctgcagggaccagggcaggagaagagcagcgactgacaatcccaggaggatgagggcggcccccagtgccagtgccataaggaatgccacctccctcaccctcctgccctcatccctcctcctctgggaagccgcccggctgctccagggcacctgctcgtacccctcggagagcctctgctgaagactccagcactccccagctgctcctgcacacccatctccccagctgaactgaacactcctagagggaagcccctgggcttctgcttccctttatcctcctcctgtgtgacatggaggaaaggggaccccacatcatggcactgctacaacgctgcggcaggttcatccacagatggagcactggcagctgtgtcctctgtctgctgttagtattatcgccatggccaccaaaagccgtcagtggcaccagcaccaggaaggctgccccaccagggaggcagagagctggagccacgcagtcccgaaacagtcacggagagctgcccacacacctgatgccaccggccccaggcccggggacacccaggggaagcccacgctggggaggaagaactttagcaagtccttgcatccagccctatgtttggggtgggaacagctaagccactggtgacggaaggtgtctgctgtggtcttggtattctctatgcatggataacaatcagttagcagacactgagccaggcccttctgtccccaggcctgggagaaaagtgccatcattatgcctgtgtaacagaaatgcaggctcaggacacctaagagccaccccaagcccggggcaggcactctcttcacaactcttaaccactgcacccgccccgagcctcccacacaccaggcctccaagcacgggctcactctgtgctgggccagcccttccacttcaaactcggccaggctccgactccaccccctgaagctgggctgggcgcctctctgtccatcccccttccctatccaccactggccagcacaagcactgaggaccccaccacagcaggcccccgaggctctccactggccataggtcactggggacgggacctgaatctcgtctagctctgtacccctcaaggcaccaagccccatgaggacactcatcaattcctggtgcaccgccacttctcacgtgccccaagccacacgggcctgccctcaccccgccttcccttccgatgggatggcgaaaccctggcaggaggtgggcatggaacgcacatgagggtgttctgaccacgggttcccgtgacaactccgacccgcctctcccatctatctttggcacagctccgagctcgagtgccctctcccagcagaccattcaacccagtcctcagccagccccaatgaacagccttccccaccccagtcctgggagctcccagagggcgagggccccagtatagtggacttggcatctgcagtctcagtggatgctccagaaatgtctggagcactgatggccttgcccctgcaccggatgaaggccggggtgggcattccctgggccttgacctctcattaggaaactaaacatggtgggggtatgaaggggaagaagccgcatgctgtggccagaaactcacatgcccgaggcacccaggctggagccagtagccatggcaaccacaaggatgcccactcccacggcccctgccactcctctgtcccgggaggtgcccagcagattcccgaccagcaagacccccggggtgggacggccatgcattactcacatcatccacacgccggccgcgatgttcagagggtggatggtgatgcagttgaagaggccagagatcgcgcaagcttgaaacaagagacacgggcaggagtcagcagggaggcaggcggagcccgctgggaaggcggccttgggagatgactggaaaggacgagagtctctgcggatgctcagcacacagttctcacagcacccagaagcctgccctctatcgtctgagacaggtgaggagacgcagagaggtgcagtgccttgcttgccccaggccccacagcaaggtggcagcaaggtggcaggtggatctcacagcatcctctccccgtttcagggctcagaggagctggccctctgaccccagctacatcaatatccacctcaaagggaggttaggattaaagaaggattaaagagtgaatgtccctcaaggattcaggccagtgctcccccaagactcagccttcggtaagggtcacttgccaccattcacagggccggccacacaagaagtcctctgactcagaaaatgtggcttggattttggttgggacaaggggtgcctctctcagaacagagatgggaaccaggtaagactgagcagcagttccagctctaacttcctcaccagccctgtgccactggcacgctatcttcatcttcctagacccgtttctcctcttgcacatgagcaagtcccacagcccagccacccaccgctgaaatgccataaggccaggaaggggagggggcatcgttttccaccccagaacgtggcttctctgatgctcagatgtgcagccttgacgccccgcctcccagctgcacctcaccagcagggtctcttgcacccaactccctcctccacccacagcctgcagcctggcttcaccaggaactccaggagccttcaaggcaggtccaaggaggtggctgctgggcagggagcaagcccaggccatcactgaggggggccttggaggcagcaattagcacccagctcattaaacttgcagcagctcctctgcacctgatccctccacctgggtctggaattctgctgttttccattttcccaggtaaccttatgcagacagcaggcaaagaagccagataaagtgagccgaactgcaatgggactgcttcatgggcccccagggtctccttctaaaacaaaggactcaagcgttgcactgctcctcagcacagccttagacatctgccttcagacagcaaggtgttccagaaccacaggtacacaggggcctgcctgtcctagcagagtgcccaaagggtgacacggctccctgcctctctgctgtgcctggcctcacctgacagctcggctgtgcttcctgctgcagtcagcatttggcctccagctccaaccctaccccagctgtccaacccacagccagccttgggggaggaccaggtgtcaagccagaccagcaggctccagccaggaatcctttagcaataaagggctggaggatgtccacttgggggcctcaatgctgatatcttccacgtgagggggctgtcaccatgcaatcctgtcccctcccaaggtatcacctccagatgctcttaggacccagggtagaccctctccaggtactctctctgatcccctcaccctggaggaggaaaaccttacccaaggaccagcccggcacacaacccttgtctgaactcctgccgcatctctaaaacaccctgcatttttgcattctaccctgtaatacagcattttgatgttcacataaccatgcccccaaaaatctgcagatgcaactgacaactcagggcaatgccgcaagtttctcctgaagcttcatctgtagacccaacagagccccaggaactcccaggaaaggcagaggtacctcactttgagaggcacagaactgagtaagactccacagcaaatctgggagtcggcagggccactgaccaagaaggaaggaggtgtggcctacaggccatagtcaggacctttcctttctcaccactgaccatgtcaccccactgcactgcccaccctaatctgcagggaaaacagctaaccagacatgacaggactggatccaatgcctaacttcaaacccaccagtctctactacaaagtcaaaagcgtacttgccctgaagagcagtgacacaaactcggggcctttttgtgatttgggggtagggcctgccctaccgtatccgttgcctctggataagggcatgcctagcgagggcagcacactcctagcccagcaccctcctgcctcaacctccctccaccctctacccacctggaaaggctgtggaacccaaggtgaccctgaaaaggtggtccttctggcaggattgctgatggggcctgccctgcccaggcccagagctagccctctctgccaggcaggcactgtttaaaccctgcagacatcctcgacagacattctctaagaccttgcccactccagtaatccacaagattgagggcagacaggaaaggaaagggtatcactcagacagacttgtctttccctggaaggccagctgtacggcttccattcactcctggagctgacctgcctccctctttgtccttttctggctgtgcttaagagcctagcttccctggcagcctaaggtcagggtctgtgactgggatgcgtgcggagaaggggaggaaggccggtgacaggcggctaaggcagcagcaacgggggagatatgagagcggacagaggacccagggagaggccgggccctcagctcactgccccgcggccccaggggccacctgtgccctgacaccacctgaccctcagcaaacttccgcccagtggcttcctgccagaaatctagccagccgtgcacccgcctcccttacaaacaatccttgcccaaaggttagcaatgtggctgccgtcacctacgcccaagtcaacagttgacgctttagtacgggccaggtgggcatgcgccccgtgagcatcaccgagaaagtctcacaaaagcccctggggagcggggggagggctcagtcacgtgccccaggccggtgccccaccccccgcccccgcccccgccgcccccccgcccccgccgcccccccgcccccgccgcccccccgccctggggtttctggtccctccgggaatgttcccagaagcgccagcccagcccagcccggggtaccaaggcgcccaggcccgagcgggtaaccatggcaaccccaggacgccggctcccggcggccccgccattcctccgccccgggaggcgcccggcagacccccgacccccagcgggtcctttcccctggggccgccggggcggggcggggcagggcagggcgaggagcgcatgcgcggcggggccggcccctctccccgactggatactcacagactgcccccagcaccccagacaggcgacacagccagcggtaccaccacgtcatgccctcttcctgcgcgggcggcgcagagctggcggacgccccgggcgccccacctgagctgctcatggtgccaccgtcaggcgcagctcacagccctcacaaagggctcggtagccggccgcgtccgagccggcgcgctgcc

SEQ ID NO: 10390 - DNA, 2052 bp, Homo sapiens
gcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 10391 - DNA, 312 bp, Homo sapiens
ggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttg

SEQ ID NO: 10392 - DNA, 148 bp, Homo sapiens; identical to SEQ ID NO: 8938
  misc_feature (136)..(136): n equals a,t,g, or c

SEQ ID NO: 10393 - DNA, 158 bp, Homo sapiens; identical to SEQ ID NO: 7318

SEQ ID NO: 10394 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 10395 - DNA, 3431 bp, Homo sapiens
aggaatatgtttatccagaagccagagacagacaatacttactatttttccataaaggagccaaaaagtcacgttttgacctagagaaatacaatcaactcaaggatgcaattgctcaggtaagttttacaaaaattaaaataaatcccagccctatcttgcatggttattattattatccacagccacggttcttcaaatgagtaaactgaaggaatgttccaaccctcttcttcctgtataaattattcctcagttgattacagtaactattttaggcatggacatttctctagaaagttttataaaaagcaagtgagaagatggtgtgtttgctccatcctgttaacactagcacattgacatttttaggcctacttttacttttttttttttttcattttatttctttgtagttgtctgtttctacttttccctctgctttttgattatttctgtaataatttatctaagatttttcacaaaaatgtgtggtagcagtggggaaaagtaaaacccaggtaagagggaaagactgctagagatctttgccagggacagtttagagattattaaactagaagatgcttggaaaagattgatatattttatttttcataaaagctacctctttcaaatttctggatgtgcctccctcactctgttatctttgattttggtgaataaaccctcattccttttctctgtagtctttgtgactttagagatttttcagcaatctctagaagcttttccatcctctttaatgtttagttgctcttctctgcctttcctgtctcttcttgatgatagggttgtgctttgaataggcttaatccatcttcctgctttggcctaagtggagttctgtcttcctttgctatgtatggtgattctaaactggagggaatacatcagaatcatgcctggagctgttaaaagtacagatgcttcagtctcaccctaggcttgctcgttagtccagctcctcccgggtgaagtccaagcatgtgtgagttttgaaagtactacagttgactacacacgctgttccaaaattcactggctaagtaaaaacttaaacaggtactggataaataactaaaatcttgagtagcataaagttctggctcttagcccttgtgaaagggcttctcactggagaaacaccatcaagatgtatgtctcagatgctccttacattcttagcctctgagtcctaccctgttgatagcactgatttttctggaggctttgttgagggctgaaactgccaaggatggcttccattttggattcaccctttgttgtcctatgccgtgagttaaaatgctttgtctttcaaggcactcttattttgagagttattgagatgatctctctgacttatagtaatggagaacagtttccttttcttggtagacagtaatatcattgaaagcttcactagccagttttctcaccttttgtttctattttaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaa

SEQ ID NO: 10396 - DNA, 973 bp, Homo sapiens
tgttgtgggaagtcagggaccccaaacggagggaccggctgaagccatggcagaagaacgtggattgtgaagatttcatggacatttattagttccccaaattaatacttttataatttcttacgcctgtctttagtgcagtctctaaacacaaattgtgaaggtttcatggacacttatcacttccccagtcaatacccttgtgatttcctctgcctgtctttactttaatctcttaatcctgtcagctgaggaggaagtatgtcacctcaggaccctgtgataattgcattaactgcacaaattgtagagcatgtgtgtttgaacaatatgaaatctgggcaccttgaaaaaagaacaagataacagcaattgttcagggaataagagagataaccttaaactctgaccgccagtgagccaggtggaacagagccatatttctcttctttcaaaagcaaatgggagaaatatcgctgaattctttttctcagcaaggaacatccctgagaaagagaatgcacccctgaggttgggtctctaaaatggcccccttgggtgtggccgtcttctatggtcgaaactgtagggatgaaataaaccccggtctcccatagcgctcccaggcttattaggaagaggaaattcccacctaataaattttggtcagaccagttgctctcaaaccctgtctcctgataagatgttatcaatgacaatggtgcccgaaacttcattagcaattttaattttaccccggtcctgtggtcctgtgatctcgccctgcctccatttgccttgtgatattctattaccttgtgatgtatgtgatctctgtgacccacaccctattcgtacactccctccccttttgaaagtccctaataaaaacttgctggttttgcggcttgtggggcatcacggaacctaccgacatgtgatgtcccccccggatgcccagctttaaaatttc

SEQ ID NO: 10397 - DNA, 12244 bp, Homo sapiens
ctgtttctcttcctcacttcagggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcggtaaggcaaggctttgctgtatcttacttttctcaagtcatcttcccaacaaccctgttaagcctataatagcatttccattttcatgcgaggaaactgaggataagagtaattgacttggccaaggtttctccaggtaattagtgggatatctaagttttgaatgccagtcttcagaattcagggtctgtattttttaattttttgagtgcttactatgtgccaagcactttactaggagcagggtaatacactggtatgtaaaaaaggccatggcctcatagttcttaggatctagtctttctatttaatataaaaaaaaattatgggtttagctcgttgtcttcaaattgggattcatggacttattctggtatttttaggaatccgcaagtctacacaagaatctttaaattgtgtgttttcattttgataacatagttcaagaaataataatataagctgagcacagtggttcatgcctgtaaccccaagactttgggaagccacggtgggtggatcacttgaggccaggagttcaaaatcaacctggccaacatggcgaaaccccatctgtactaaaaatacaaaaattagtcaggtgtagtggcgcacatctgtagtcccagctactcgggaggctgaggcacgagaatcacttgaacccaggggaggcagagattgcagatcactccactgcactccagcctgggtgactgagtgagaccctgtctggaaaaaaaaaaaaagaaataataatataaaaatgttattgatccctgctactcaatatctggtccaagatctgcagcatcaacatcacctggcagttttttagatatgcagaatctcaggcctcacccagtcctgctgaatcagaatctgcattataacaagatctccaggagatttgtatgtgcatttaagtttgagaagctctgctccacatcctctgaacgtgactgccttataacctagagctgctactagatgtcagtgtgcaagttgtatttaatgccaattacttttttattttcattttgaaatttgccaaacctacagaaatgtgtaatagtcaacaaacatccaaataccttcaccatgactcactaatgtttaacattttgccacatttactttctcacatatgtgtgtgtatacacatatatacacacatatacaaacatacatatatgcatacttgtatatgcacacattttttcccccattttaaagtaagttgcagacatcaccatatttcacccctaaattcctcagcatgcatatcctaagaataaggaaattttcctgcataatcataataccattaccaaagtaaatgaacattaagtaccatttaataagttcatattcacattcttccaattatcttttgtaagtatatttacaaaatatcttttgtaaatgtcttttccctcgaatccaggatctaacaaagattcatgcattgtacctggttgttatgcctctttagagtcttttatgagttcaggtcgcttgtagaatgtcccaattactggatttgctgattatttcctcaagattagattcagattaaatatgttcggcaagaatactacagaagtgatattatatgttatttattacatctacctgttgctggtaatactattttagtggttcccaaactaatgagaaaagtacagaaatagactaaatacacaggggttgcattgcagttgggccaggtgaaggccagattatatcaaggtccattgtaatcaaaggttctgaagtcactggaataatgaaaaggggaggcataactgtgttattacatgcacagcatatgctagcatagacacgcccaactcaaaaaacttgctctgtggtgatcaatactgtattcacatattgagggcaatttaatttcaacaatataatgttatctatcatattaaattgatgctgtttattcatttttagttttgtatcaaatttatatagtaagagccatgaccatcaaaagtttgtacctggttttattttatacatatttaggaaactgtataacaaaaataatttgcatcagttatgggggcaccaaaaaattactttcctttgaaagaggtccagatattattctaggaaagtgatattggtttagttgtctctgtttattaggtacttatgaggcctttagcttttggcccagagacactggccatggaaatgatgaagatagtaaatgaaaagttacttggcaattagttatcttattgtcaaactattatgtaaactgcaatagttgctattgaacaggtcagagtttagtgggtggataaccactcaggcacttttgtacagtgcgtgatgacacatgccaagtacgaaccaaggaaaaatgattttctgtgctctattttatttttattggtaaaataaattcctttgtcaggggtaggcagaagccagtaggaaatttcaagagacaggtaaattattaaaagcttcttaagttatttttagatcaaatagctttcttaatttttttcttggaaaattaagatttctgcagtagtgattaggggcaaaatggtgtattatgcaggatacggtttctggagtcagaagctttaccacttactaattatatgtaaacaaattttggcaagtcagcccttctaaacctgtttcctctcctggcaaatagaaataataataatacagaccctacccattgcacaacacaggataggatgaaaatgctttgtaagctatatatgttttaaattgcttttataaaattgagttgacttccctgttttgaaatggtcccttgtaactttataagaatctaagaatcttaaactcctgggaactgtgaagaatctctttattggaactgtgaatttctaaaagtttgtattaatatattgcccagcatgtatgaaaactaggttatggtaaaataattagagcatcattgagcagtgtctgggctatactgttaaacttaatcctaaaagtgatcaaaattgaacagttgctagaaggaaactttcttttcactagatatccttttggattgtgtattatagacatgtattgcctattcaaactatgtctttggaggagctcaaagatatgaccatgggttgctaagacatgcccagatagcagcaggatgaaactgagctatgtaacttggatggaatttccctggaaagctaggccagtggcttgactggaattgtaaaactcctggggaagacaggaggggtcacccctttgcaagaacattaataacaccaccgtatctccactttcagtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacaggtgaggcgaccctgttgaaaagtgggcacagatgtctgtgcaatctcggagtgttcagcaggatcccacaacacttggtctagagtgcagagcacagagtcttggaacagagtgaacttaacatacttttatgatggccctagcgatgttcctggccaaataccatgggtctcctttagtcagtgaatggccacattcactgatacttcctctggaagaaactatccacaagtatatggaatctgagagaatgcagttagtctgattttattcaacaagtatttattgagtgcctgttgagagtcgagcattgtgggattcagcagttactaagttacctgagtttacattgtttttgaagggagacaaacacaagtcaataaataacaatcaaaacaatttcaggagctgggcatgatggcacatgcctgtaatcccagctacttgggaagctgaggtgggaggattgcttgaggccaggagttcaagaccagcctggacaatatagtgagaccccatctctacagaaaattaaaaaataaaaattagctggacatggtagctcatgcctgtggtctcagctacttgggagtgtgaggtgggaaggtcacttgagaccaggaagttaaggctgctgtgagccatgattgtgccattgcactccaacctgggtgacagagcaagaccctgtctgaaaaaaaaaaaaagagaacacagacctactgacaatcctcctgcctcagcctctcaagcagctaatataatggtttgactggaattgtaatatatatatctaatatagctgcttgggaggctgaggtgggaggattgtttgaggccagaagtttaagaccagcctgggcaacatagcaagaccctgtctctaagcacatacacaaaaaaatacaattttggataatgttaagtgctatgaaaaaaacagagtaaaatgatattgcctggaggatgggttggtggggggtgatgattttgcttggaaccagaaatatctaatctcttcagcccttgtgctcttaagtcatttgttcactgtttcagtttctgcaggtctaaaatatgattaggaatttttaacacccaagaaaaaagtctttgctaagtgatccagatttcccacaccattgattattcacctaggatacatatgtcaacttttttttccctttttttagacagggttgcctgggctggagtgcagtggcacaatcacagctcactacaagcgatccttccacctcagccttccaagtagctgagaccacagatgtgaaccaccatgcccagcttttttttttttttggtagagatggggtctcactagatactgcccaagctggtctcagactccgaggctcaagttgtcctcccaccttggcctcccaaagtactgggatgacaggtgtgaatgaccgtgcccagcctactgttaatttttatagccaaaaaaatgtaatcttttgtcccagttctaacacatttttttacctttatgtaacttttaattaatgacatacacattctctgccaaaccaattttctttacatatctctatcactcataaatgcaaactcagcaccttaaacaaatccctcccattggcagtgaatgttttaaaattctgttattcatgttctgttggcttttccatgggacgtcacaagctgactatccaacttgcttttaacatttccttggaaaattgactcttgcttgccaacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtaagacaaataaacttactcactttgattctgggagatctgccaatttcagtactttttgctttttggaatcaagctcaagaggtagaagaacaaaagcagcagtgggcagaatggaaagtcctaaaacgaatacagtttcacctatctagagatcccagcattcttctctttctaattagtgaagagaggattagcacagctttacaggcattctttaaaataatccctagttaagatgtagatgcaatgtgttgtcacgttgattaccaaggctgattcagctgatccagctggttgggaagatatccccttcctcctttagtattttatttttagtattctgtattggtccttcctgatgcttgtacttcattgaataagacagctgccagatagatgggggagtgttaattgctcaaggatgttctcagagtttggcttccctgctagagtattctaacaaactgaagatgaaagacattgaaatagggcttccggctgggcgcagtggctcacgcctgtaatctcagcactttgggaggctgaggcgggcgaatcacgaggtcaggagatcgagaatcatcctggctaacacagtgaaatcctgtctctactaaaaatacaaaaaaatatgctgggcgtggtggtgggcaccgttagtcccagctactcaggaggctgaggcaggagaatggcatgaacccaggaggcggcttgcagtgagccgagattgcaccactgcactccagcctgggcaacagagcaagactccgtctcaaaaaaaaagaaatagggcttcccagttagaggtagctggcttctttttccagactctgtgattaccttaggagccaggacaactgactggttacgtgtcagttaggttgcaaattagtctggacactcagttgtttacaagtataaattgtcatcaatgcacaaatgactcaaatagcaaatcctcaaatgtggtctaaatggaattaggtcatacttttaaaagtgttgggcagagagcctttcactatggaagaataaccataagagaacagcattgctagaatacatagagagatgcgagggccaaagagaaattgttgcggacttcgggaccatgtctcttcaaagaagaccaggtagagaactgctgttagcattatgtagtgaccattaacttttcataatgcaagagatgaccagagacccaaacaaaaggcaggaaaacaagatggccccataaaagaaggaaggaaggacaggcaaactaaacaactgaacaagtcctgtggttgtgcatgtctttgggctgtgagacaggggatctttccacctgcctagtttcacttccctggtttaggggaaatgggggtgggtgaggtagaggaaagaaaggtagaagaaatggaaaagaagataatcagagctggtaattttttgggatggttaactttttgaagcagagagtaacaaccgatattctccagccaagtacagaatcagagtgaaaactgagctcaaagcatattagttggttctgagtgatatatttactctttgttctacacttggctacacatatacacttggtgtatgtccatctttcctctgtttctaggtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtcttttttttaatttatttatttatttatttatttttgagatggagtcttgctctgtcacccaggctggagtgcaatggtgcaatttcgactcactgcaacctctgcctcccaggttcaagcgattctcctgcctcagccacctgagtagctgggattacacgcacatgccaccacacccagctaatttttgcatttttagtagagatgaggtttcaccgtgttggccaggctggtctcaaaactcctgacctcaagtgatctcgccctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatgaaacaggattctgattcattaatcatgtcttgcccacttttttcaacaaacctgacgtcctataatgagctatacagtgtgaggcatatttcatagcaacgttggttgattgccaaggagactctgccaccgttctggataagctcatgtttcccttttccttggctgctaatagaagggcaacttacagtgcagggtcaagagcaagaagctgggggagtagaggctatacatctagcctaataatagagatctgaggtggtcaccaggagactacgttcttttgattccattcctcagcagcaaaagtacttgagttcaaatgataaaacttgaagttgtaggcttggaagagtatcagctcagtatatccttccttgcataaatacaagggaaaggccaaggaataatcagcattaacctgccaggtccaagggtcttctatccctgacttcatctgagtcacaagatttctctaataagagaaactttgctactctgaggaaaattatcccttatgggagcccccagttcagaggtaagaacagttctttcacgtggaggtccaaaattctggacttctagaaacaagtgaagtgtgctaaagtctcctatttattgtttctcttccagtattgtgccatcgattcttgcataaaattctggaatgctggctcttcatggctttcctctgtaactgcaaggaaaaaagggcaattctttttcaactctttcattagacaaactgattag

SEQ ID NO: 10398 - DNA, 16367 bp, Homo sapiens
caatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtgggtaaggagaagctgtcttcacgttgccagcgtctggcctgactcagttctttagtagcgtaattttgctttatgccatgcatttgactttaaaaaaaatcccaaaactcccaacatattttaggggtcaacagatagcacaaggaaactaaatttctgtgttcacttctaaataataggtggttgagggtgaaactttaaaaaggtctaatgcagatgttaagaatttcataagttaactaaccctgtaactggtgaaaagggatatgaaaatataaggcaaggatgtttgtggttgatgatctgaatgacaaggaagatgagacgtatgacatcagttggaagagaggagaaacctctcagaaggataggcctttgggcagctctgagacccacggggcactgctgaagcaggaagcacatgtggctgtgggtccttgctcagaccttgtacattgaaggtcctttggctccatgcgtaaggaactatgaactggctgtctcccttgttgctccttaatgctgaaggaaacatgaggaagagggatgcaggagcttccattgtgggcagcactggtcatagtgtttgccagtgtcaaagggttaaccattatcaaggctgttctgtttttctgcctatcttaatgtccagtttttattatcacaactaagcagtgggtgttgctagttcttttattaatacacatactatcatttgtttatttttactttctctaactagtctgtgtcccagcaggagaccttttttttttcgtgtgtgtgtgtgtgtgtgtatgtgtgtatgtgtgatggagcttcgctcttgttgcccaggctggagtgcaatggtgcgatcttggctcactgcaacctccacctcccgggttcaagcaattcttctgcctcagcctcccgagtagctgggattacaggcatgcactaccatgcctggctaattttgtatttttagtagagacggggtttctccatgttggtcaggctggtctcgaactcccgacctcaggtgatccgcctccctcaccctcccaaagtgttgggattataggtgtgagccaccgcacttggccgttcccagcaggagacccgtaagacccaagccttgggtgagaacagggagaaaacacatactagttgtgactagggtactctcatcagacagaaaggtggtgctatttaatctccagaaaggtgcaagcaaggatcagggtatgattctgaccaagggatcacggagaaaatctcttctcttgcctgaatctctccagactgtggcttccttccagtgaggacccctttgatcgatgaattacgcgaaaattaaacccactaaaaatagggtatgatgattattttttctaccaaaaatggttttttaaaaaaatcatcttcctagggctgcattgctgaagtaagttacaggatggggatgtgggaaggaaagaaaggatgttgtatagaaatgtaaaactaaaagttccaggaggcatttccattacaggatcagtcagaagtgaagttaaagtatctcagagaagtgccagaatcaacagcaaatgttatttgacctataagacaattgtttaaagacagtattttcagggagtttatttattatgtaatatgaaatacaccccatgttttatccaagtgttattaaaataccagacaggtaagtgtaagcaccaaaataatgcatttccaaatccaaacagaaaactttctgtttatgtgcatttggggctgtctgtggccttgaatcgatggttcaaggatgactgttaggggcgcagtgcagtgacgcctgcgtggaatgggagcttagccctgggagtctcagattctgtggctttgtgactgcactctcaggacatttctgtgttgcagtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactggtcagtccctctgagcctcttgtcctgtcctttacttggtggtgaaggctgtcagatactgggagaatgtggagactccttctttgggcacctctaccaggacagcaggttttcatgtgaagttaaagccggtcttgtgtgcggctggagggagctgagggatgtgtgggacataggtatcctaagacctgagtcacaggcaggtgccacacagactgagtcctgcttagagacatgctttctttgacctacatggtgtttatacttttttgaattagaaactcattttaaaaattgggagatttctgagaaaccatttgtatcttaaaagtctgggctttcattcccattaggcacagttgctgccccgtttaatgatgttgccttcctcaggtacccatctggtttcatttgcagaagccatttgagataatgagacttccatccaaggtctaacattatgaactagagaaattttggcttaaattattattttttatctaataatagtctttggtgatattttttaatttccaaaatgctttatcacatattacttcaccatcccccagacgttctgtgaggtgagtaggtggtagtactcctattttgcaggtgaagatgctgaatgcagattactttatgttggggctcaagaggagtcatagggcatgttgatgaggccagtctgagagtaccaagttccactgtagatgttttcttaagtgaaggcctggaaggggtcctgaggaggttgcatgatgtctttagagctgaggcaaaatgatggtggcacagccagctgaaaccctccctggcttctcttggtatctcctgtggccccagactctactccccagtctcctgagcccaccaggctccaggccagagctgacagctgttgctggctgcctctgctgggctgagggcaggttctcacatgggccttcagatcccccagctttggttggagcatggttgttgtgccatcactaagttggcgatgagtggcctgaaagcctttccttgtgcggaagctcacttctggtgaggactgtggtggttctggtgagtgagtgtggcttgtgggaaatgacctggtgagttgcagtacaggtggggtccttcgtcaggacctgtctcttgggctccctgttccatttgctgcagtcagttgtctgggtctttgcatactttctctgccattctagagtaatgcttcagactcagctaacagtatacattttggggcttcgtcccagaagtcttcaattggaggctcctgggatgggacctgggaagctggatttccggcacgcttcccaggtggttcttctgctatctacatttttttcaagcaaagcttctagggcagaagcaattctctggacatcactttaataagtcatctaatggatgtgaaatcttttaccgtaggggttggtagggatagggagcactttatctgctctgtaggacatttagcagcttctggatctttcaatattaaaaaatctatccaaggggctttattttatatttatcctttcccttcctggatagttttaagatcaacttcaaaaatttgggccaaattttgagtcttaatgcttttaaattaggttgcatcagttaatcttctttattttaatcttaccaatttggaattagaactttttgaatttaccctgaaaatgtatctagactaagccagcaaaaggaaaactaagtgaaaaaaaagttgatgacttcaccctgcattcctgtgctgtttaggttcagcagttgcatctccaactctacccttcttagtttatttcagtaaacatgtagccagtctccacagcattgaaggtgtgatggtgataggcattaagggcttcaaagatgactagcactggtccctgcacttaggcagacctgagaaccaatggacaagtaaaatgtgctaagtgcattgatagcatttgtatagagtgctctgggaataccggaaataggaagtgttcttgcaaccacagttatctctgaatgggatggttgataagacaaatccaggaacaccaataagtttcttgagttgaactgagtctggaagcttgaggagtcagcaggaggagaagcataaaagtgcaaaagtgtttgatatgtttgccaagcagaaaggagtcaagtatgactagttccggatgttgagttccagatgtgtgtgatgagagaggaaagggaccccgaagccccaaatgcagtgatatagagccggggcttgactctgtgagccaagagttttcaagctgttcttggaaccctggaagcccctcaaaggtgcctaggaggttagacatgggtgtgtgttggtgttcatgtgcacgtatgtgcacccaggagtgcagggagaaggcatgcgagggcctgggtggtcccctcttgcttcaactatgttgggcagcagaagattttgtatgaataaaaagtccccttcctttgtcctcttcttaataaagtttgaaaacctctgctgcagacagttggagaggaggtagagatttttaagcagggagtaacacaatcagatcagggtttcagaaagaaaaacccatggaggccacctggaggttgattaaatctgttgagtctgaagccaagagaccaggtagaaaagagctaataagagctaaggctaggtcagtgggtgccagaggcaaaagaataaagagcaagtggaaggaggggtccaactgtctagaagtccaggggctaggactggggctctgggggttccttgaactgtgggagggaaggaacaataatgaggacatgtgggacttttgcatttgtggcagcattggctgccttttgtttttgtaaattctaatgaaagagcccatccatcaggtagactctgatagagatgctcagtatgcgaaacacccagtgggtcctcagacacaggggtctggggctcagagaccgagcctgagagtgatcagggccctggaagagcccatggggtaaaaatgggaaaggacctgggagaacagcagcagtaagaggtgaccagagaagcaggtgagagagtggaacagagtgggcaggccagcaagaagaagagcaggagagaagggatcatggagcaggctcagaggcctcaacctgcttgaggaaagcctttggttaggatgggggtaggggtagggtggatcatttgtgacatttgctaagtcagtgaagcctaatttcagtgagatgaagtggaaggggtattggaaaaagcacaggtcagtttctagagatgtaattgactgggcataaccaagggcagaaacgggggtgatgtgggtaaatcttgtgtcttcaacctgggaacatgaaggtgtcaccaaggcatggggggattcccttgagatgagaagagtctttggccgccgaaagaagaaagccagagttacagccaggctaacctggagcaacggaaaggtctgaggtctagggtaccccttgcacagctccagtggtgtttatgtggaaggagtgcttttctgtcattgatgttgggttataaatgactaactgggttgacctgagagataatatccagcagataacacggggactgtcccatatgggtgtgttcatccaggcagatggtggcagagtgaaatgtgcttccttcaatccatgcctcttaagactggtctcttgggagctagaagctgtgacagcagctacttcattggaggggaggccctggagttgatgatgtggttttccctgtcaggaagtttggctgctagaggaagtagttaggtcactggaaagaaggggtatttgcagcaggacactggcctatatcggggggaggggctggagagcctgaggagcgggaggggtaaagctgagctggggctggaaaagaagaatgtggatgctgcttatgcatgattcttatgttttcttggggaaacagaaacctcatctgcttgaagagtgcctaggacgggatgaatgggcaagatcttgaagatagtgggaaaggctagacatgccagtctagggaaggcaggcaaggtcagagctaatgaatctacatggaattcaaacgtctctgccatgggattttttccacctcggtgttctttttagaggaacagagctagaactgggcagtggtcacagctccagtctctaacccttaactccgttttcttccccctgacttctgccgtgggtgcctatgagatacgatagctgtctaatgagattaatagccactgtacactggtacacaggttgtgatgatgctgttagtggtaatgagcccctctttggtcaccccctcatgcctggttaagcacccaactcaacaaaaattagctggatatggtggctactccggaggctgaggtgggaggatggctggagcctgggaagtcgaggctgcagtgagccacgatcatgccactacactccagcctgggcaacagaacgagaccctgtcacaataaataagtaaataaataaaaattaaaaaaacacctagatcttaggaggctgcttgggtttagtaatcatttcagaggctgtctggctttcagcagaagtaggtacttttcctactaaagtacctactaagtacttactcagtgggaaagtacctactaaggtttaaccaggcgtgagtacttagtaggtactttcccactaaagtaggtactttcctactaaagtaagtacttagtaggtacttcactgggaaagtacctacttccattgaaatctgactagagatttgatctgacaggtggtaaactagtgaacagacattagtttttattttttctatgtaattctgttagggtttgtcatacctacatcttatttctagtattcacatggcggggggtagagagggaattttaatatagtcatctttgagcatttgttaggattgggccagcacctaggccactctgtaattttttcccacagacctcagtggggtaagtcttacaatatctgctgaaaatgtttataatgctgttgcttaaatagagttctgggtgcatatatcaaggctagatatttgtaatctaccatttgagtgatattagtagcttctcactgacctgggggtctcatctaagacatctaaagcttcagactgagccccattggtcttaactggggtaacagtttgcttagaccgtctgggctgaagtagttttgaattctctctgtgatattcaggcgtttctctggaccttagataacctgggtctgagttggattttactctcaagctaagtgctgtggtcctccccgcagttagtattgtaaagaagaggaaggatagtgggaatgtgctaatgtggtttagttggctggggccctcattcacccaggatgtgtctcttttcttacttgttctctcagacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcagtaagtagagagatgtgctgctttcttctcctttggctcagcatcatttaggagaggtagggggagagagaatagcgtggtgaaggtgaggggaggcagatggaaccctcgaggttaatgcagagctgggggaaaaaccattgagcctctcttccctgttgtagcccacctgcatacatgtagcaggctccccatagcagaggatcaggatcaggggtgtccagaatcagggcagtctagggctgggcataggcctatctgattgctagcagccctgtgcatacacaagcagtgccagctcagcttggagggaaaccaggaatcccagaaagctgtttgctcttgtgtgggaatcaagtcccagaagaagtgggtagatgcctgccttgaaatctcacttaaggagagttggtcttttatgggaggattttaaatcataaagtgcattattaaggatttgccatctgggtttttcaggtataaaggctggcatttccctaaatggcttttccctgttgaaattgtgtttctaaaagtcggtggatgggacctctcacatcttcctggagcatagccttttaagcttagctgatttctgaggctgcctcagtgggctcccagccttcatgtagactggccttgtgtgggtgggtagtggccattgctagggattccagaaactactggtgtttgcttgtgttgtgtttaaacattcatagtatcaagatattcttattaatctcattctcccatagttctgtttttagtaaagagaataaaaacctataatgctctgattttaaacaagtggtaaagttttaagactaacctttaaccttgtctcagctgctcaaactattctttctctgagccttgtaataatttcctttactttttatttatatgttttaatatttaaaatatttctcttcaagtgtgatatttctcttcaagtagccacagcggtcctcttgtcagtcttttcttcttttctcatcaactggattattttctttttatgcttattattattttgttaaaaaccatgcacacacatacctaattatcttgaaattcttttgtttcttagctttttccgccctgcaatgcctagcatggtgctttgcatagagtaggtgctcgctgaatactgtacaactgaaattattgaattgaatgcccactgtctttactattttcctgtcagtctgtgcttgccttaaccacggactctacttttaaatctgcaactaattcctcattgttttctaaggatcaagtgaagggcagccacgctgtttacttcctatattttttgtactaagatttcccccaaccccttctgagaacttgtttgatgatctgtggcctgctatattgcttttccagcagataactgggtagttaaagtcccccagcaccaccagctcctgtcccaaggccacttgggtaagtctgccgaagaacaacaacaatcacatcggtaatggtgacaatgccttggattttaatggcgcttttcctcctaagagaccaaagtgcttctgcatatatcatctccttctccgctcccacctctcaaatcctcgtagaggccaatatgatatccatctaatgaatgaagaaatcagagcaccacacaggaagtgacagagctgattgttcagttagtggttgagcttgcattgcattaggaaatatttgcttctaactccacacccaccgccatgcgcttagcctgtgctacaccgtcaacttcctgatttgaaatttcatttgtgaatgtgtactcagatttttattagttctgtcctagttttcacttaatccagagagtttaaaattgtcggctgccttttctcaggcctggaaattcttgtaaatagtgttagtgggcagtgaggcaccaggtctgtagttgcctttgcctcagctgctataataaaatagcatttcttcttgtagccccacattctaactatgtgggtttccaggcttgctcaagcaacagacaccaccaaacagtagccctttcaataaatgagccaggacttggataagcgtccactgggatgacagtaggggatgagagtgaggtcctgcaagtcattcttctgcttaatacaagtgaaaggattttcttccttgatgctgcagttgcccttttaatcccttattttgaattgataacagtggggatgagtctttaatctaaagaggaatattgttgttattaatgatgatgaaaaataagtacctcatctgatcctctcaatgtcatgccctaagaagtaggcactattagtatctccattttgcacatgagaaattggagctttggtaggttaaggaagaaccacaggattacagagttaggaagtctccaaatccatccccttaaccattagtgctatagatggtgactgttcaggagcctgatcatctctatgaatcatcctggtatgagtcctgggggaggttgccctcctaggaaaattgctattccctgccccatccagaccttttatttttcacataaaacaagcaaatccagaatggatagcaggcatcctcactataataagagctacatgtggaggctcagtgctcgtctttgtttctgcttgttggggaaataaaggagagaaaagatttgattcaaatgcattgttatgtgtatgtgtgtgttttctcttggtaattgggtgtgcctcttaaaatctgggatttgatttaattaattggtttaaaattattgcatgtatttaatgtgggtggtacccaaaaattggagccaaattagttactttgtgttctttaatacttacagaccttctgaactcaatatagataattatacaaaatactacatgtataattaaaacatattaggctatctgtgatgtttataaaaacaaagagttatgtggaatagtaaaattaatcatgatcatgatgaccagtttttgaaaacctactatgtgttaggtgaatctatatgcatcatctcatttactttttaatatttaaagaattctacagttaaaggtggctctctacctgtcttacagaagaagaggctgaggcatgtcgagtttaaataatttgattgagtgaattcagatagttaagtgagcagcagaggctagatgagacagggaagggagtggaatccttatcccaaacttttgattggccaaatgtttctagaaagagagcaaaggagccccagggctgactggacaggcgggagagtggtggatgacgagctgctggctttgttttgttcctgtgtgttaatgaaagaatgaaagcccgctcctcacacactctgcaaaactagaccatctgtgctcccttattacccacacttaagcacacgttatcgtcccaatacttactgttggtttttttcccagtatttcctaaattgtcctgaaggactcaaatggcacattatggatattcagcttttatttgactgctgtagtaccgaatggtaggaagagtgaagtgaagtaggattttggagttactcttcttgctgaaaattcaacttgaaaaaccctgaactccagctgaatagattacccaataaattgttttatgccctaaacatcatgccactatgttgtatttcttaggttcttattcaggctcaggtcttagaacctcgttatcacagttctctgcacatggcaaagaacatcctagattatcaaatctaaaaccacagggagcaaagcccagaaccagccagggcttgcagcaactagggtcagagtgtttttgaccctctgaggctcaccgtacctgaatatgattccatttgcaccccttctcctgtttcctctgtggggagggcgctgtggagaccataaagcctccagggtgtttctctctccctcttcctagagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttggtgagtgagcggtgggactggcagtgggtctggcatggagacagcttcagtgtcaaacaccttatcctgacttttctcagtcagagttttagcaggaaactatggccagtcttttacctatggagtttgaagtactttcctttatgtctattttatttcttataagggtttaattaattaagatagtgctagcagggactgagggacccacagtggatgatggggctcctgagggatagcaatagctgggagctgtgactactcctagtctggctgggagagagtgatgttatcagaactctatccaggttagtgaagccacccagccatagtggtggccccaggtggaggagcatggccactgccagcctggccttaaagagagcagagtggctgagcactgtgtggcatgtctttcctgccctgctgcccaggggccagccttcctgaaagagagcagagaagggtataaaatcatctgttgtcatttatttagcatttactatgttcctgcctgatccttaacacttaagcttagttgtcccattgaatccccacctagccaagtgacagacactttcattttatggaggaaactgagactgagacacattaaatactttgcctaaggctagaagtttctactacctgacggggcccatacctaacaaagctattccctcattagcgtggaatgaaaagataccttgagatttgctaaaaccaaggaagattagatttgcttctcatggggtaaagaggcttctatcaacatttatctgcctggatataatcagtctattagattttaaacgaccagtctgtgactttgctgggaaagaaacttgttatatcaggtcttcctgtttatcaggagacatcggttgtcctcagcaactttatgtcccactccctgggactgtgtcaccaccttccttgcaggttgggatggtggtgcttttggatacttccagtaaagatggcagccccaagtggtttttgtccttaacagagtcctccattttcttacccctctgagattagaattacatttattttctaaagcttaatcctaaagattgacctgctttttgcagtaattatacagctcagatttctgtcttagaaacttcctccagtgattgcgtttcctgatcagctcagttcctgtatccatactcagcacctgtgtgaacccagtgagatggaacttgggggacaacttttggatgtccagtactggtgtgtttttttttttttttaaccatcctggaaggttaggaatgtccaatgagtgattagagttagtgaggattgtttctctagaagtaatttatgttatcaggttatcccctgagttttttcttactcaccatatgtctggtggttctcacagccaggggcactgaggggctctgccctgggatctggaggccagcactgttcacctgatctccaccactgagatacctctggctagagccataatcaggtggcccaaaggactgaacaaggaagaatgggagggcactctagactaattaaggttgtcttttcagtctaaagttaacaatgacacacatgaattttcatatcagtataattagatgcgggtcccatctaattacagtgggtcattatggctgttcggttagagcagcttgggtgctctgtgaccatggcatgtgcccgtgtcaggactagacaaagtcatttgcttggggaagctctctccccttcaggtgtgaggccaggagcacctggtgtgggtcctgtccctgaggttctgtcctacaccaccctcatgcaacacctactacacacaggtgcacagcgactgtcacaggcgcttcatgtttaaggatgggcctccgtgtcataaacttttttaaagggtatatagagatagcttatgaaatccaaatcaaaggtccagagttttcagcaaattgtacctacctatttgccaacttaacctcaccatagaaagccaaaagattcatcctgtggccagtctttcacattacagagtttaaagtactttttttaaatttctattttatttttaacaaaatatttaacaaaatatagtatatctcatgtgccaggtactatttgtaatatttataaacactgatttatttaatcttcacagagactcattttacagattggaaaacagaggcagagagaagttaagtaactttaatgtcactcagctgggaagtatcaaagtcttggctgctggctccagagtctagacctttaaccactgtgttatgctttccatgggtaaagcaacctaaaaaggcccctggaatcagttacatgtggttggagactaactctgtcattgacttactaaatgcttgatattgggcaatttatctaacctctctctgcatcagtttctacatctgcaggaagagatgacaagcctgcctgttctacaaggttgttttggggattcagtggagcatgatgagagcaaagcagttggcaccatgcttgcacctagatagtgctcaataaatactggctactgttagctttatgattgtgatcaatgtatgaatattaaacagtatttccaggctgaaggagctctgaggtactcatattgaggagtcagtattagggcttagcagtgctgcccattcaataaggaatattgagagacccacagccgctgagcctgcagaaccctgcatttaggataattgtcccaccccactggaggtccccacctgctctgtttttggatttcatgagggacgtgagaaagggactggaggccgactccatctgcttcccttctcggcaccagtgcgctaagggaccaggaaaagtggtgttggggctgtgtggttgtgttttcctcctgtgcaatggaggaaattggctttggggttttcttttcctgttctctcatggaatctcaagatttctaggagcaaccctgcctacatgcaatcagtccctgagaggattgtgatgtctaattccaggggaggagcaaatgcacgaggatctcactgggaagggttaggctagtgctgctcagggggaattgtggtgggcctttctttggagtcttggaaactcttggactgggcctcagcaggatactaaaagcaacactagcctgagagctcaaaaggggctccgagagcctctgtcccacactgcttgctttgccagctgccccattgctgatgtcatactgccctgagaaagccacatgcctcctctggttgaatctctctgctttctctccagaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaacta

SEQ ID NO: 10399 - DNA, 19289 bp, Homo sapiens
caatgtgagtggctaccagggacctcctgagcagaatttccagtggtccatttacctgccttcatcgccagagcgagaggtgcagatcatcagcaccatagactcttccttcccctatgccatctacacccagcgtgtccacggagggaagatcttcatagaaagagtccaggggaacccaaccctattgcacatcacagatcttcaggcccgggatgccggagaatatgaatgccacacacccagcaccgataagcaatactttgggagttacagtgcaaagatgaacctagtgggtaaggagaagctgtcttcacgttgccagcgtctggcctgactcagttctttagtagtgtaattttgctttatgccatgcatttgactttaaaaaaaatcccaaaactcccaacatattttaggggtcaacagatagcacaaggaaactaaatttctgtgttcacttctaaataataggtggttgagggtgaaactttaaaaagatctaatgcagatgttaagaatttcataagttaactaaccctgtaactggtgaaaagggatatgaaaatataaggcaaggacgtttgtggttgatgatctgaatgacaaggaagatgagacgtatgacatcaggtggaagagaggaggaacctctcggaaggataggcctctgggcagctctgagacccacggggcactgctgaagcaggaagcacatgtggctgcgggtccttgctcagaccttgtacattgaaggtcctttggctccatgcgtaaggaactatgaactggctgtctcccttgttgctccttaatgctgaaggaaacatgaggaagagggatgcaggagcttccagtgtgggcagcactggtcacagtgttggccagtgtcaaagggttaaccgtatcaaggctgttctgtttttctgcctatcttaatgtccagtttttattatcacaactaagcagtgggtgttgctagttcttttattaatacacatactatcatttgtttatgtttcctttctctaactagtctgtgtcccagcaggagaccttttatttttcgtgtgtgtgtgtgtgtgtgtgtgtgtgtgtgtgtgacggagtttcgctcttgttgcccaggctggagtgcaatggggctcaccgcaacctccacctcccgggttcaagcagttctcctgcctcagcctcccgagtagctgggattagaggcatgcactaccctgcctggctaattttggatttttagtagagacggggtttctccatgttggtcaggctggtctcgaactcccgacctcaggtgatccgcctccctcagcctcccaaagtgttaggattataggtgtgagccaccgcacttggccgttcccagcaggagacctgtaagacccaatccttgggtgagaacagggagaaaacacatactagttgtgactagggtactgtcatcagacagagaggtggtgctatttaatttccagaaaggtgcaagcaaggatcagggtatgattctgaccaagggatcacggagaaaatctcttctcttgcctgaatctctccagactgtggcttccttccagtgaggacccctttgatcgatgaattaggtgaaaattaaacccactaaaaatagggtatgatgattattgtttctaccaaaaatggttttttaaaaaaatcatcttcctagggctgcattgctgaagtaagttacaggatggggatgtgggaaggaaagaaaggatattgtatagaaatgtaaaactaaaagttccaggaggcatttccattagaggatcagtcagaagtgaagttaaagtatctcaaagcagtgccagaatcaacaacaaatgttatttgacctataagacaattgtttaaagacagtattttcagggagttcatttattatgtaatatgaaatacaccccatgttttatccaagtgttattaaaatacgagacaggtaagtgtaagcaccaaaataatgcatttccaaatctgaacagaaaactttctgtttatgtgcatctggggctgtctgtggccttgaatcgatggttcaaggatgactgttagggacgcagtgtggtgacgcctgcgtggaatgggagcttagccccgggagtctcagattctgtggctttgtgactgcagtctcaggacatttctgtgttgcagtgatcccagactccctgcagaccactgccatgccccagactctgcacagagtggagcaggacccactggaactcacttgtgaggtggcctcggagaccgttcagcacagccaggtgctgtggcctggctctggcagaaagttggcgagaagcccgtggaggtcatctccctgagccgagatttcatgcttcactccggcagcgaatatgcctggaggcagagcctgggggaggtgcggctggacaagctggggaggaccaccttccgcctcaccatcttccacctgcagccttctgaccagggcgagttctactgcgaggccgccgagtggatccagaatccggatgggtcgtggtatgctatgacccgaaagcgttccgagggagccgtggtcaacgtccagccaactggtcagtccctctgagcctcttgtcctgtcctttacttggtggtgaaagctgtcggatactaggagaatgtggagactccttctttgggcacctctaccaggacagcaggttttcatgtgaagttaaagccggtcttgtgtgcggccggagggagctgagggatgtgcgggacataggtatcctaagacctgagtcacaggcaggtgccacacagactgaatcctgcttagagacatgctttcttccacctacgtggtgtttacacttttttgaattagaaactcattttaaaaattgggagatttctgagaaaccatttgtatcttaaaactccgggctttcattcccattagccacagttgctgccccgtttaatgatgttgccttcctcaggtacccatctggtttcatttgcagaagccatttgagataatgagacttccatccaaggtctaacattatgaactagagaaattttggcttaaattattattttttatctaataatagtctttggtgatattttgtaatttccaaaatgctttatcacatattacttcaccatcccccagacgttctgtgaggtgagtacgtggtagtattcctattttgcaggtgaggatgctgaatgcagattactttatgttggggctcaagaggagtcatagggcatgttgatgaggccagtctgagagtaccaagttccactgtatatgttttcttaagtgaagacctggaaggggtcctgaggaggttgcatgatgtctttagacaccatcatttgtcttgaggcaaaatgatggtggcacagccagctgaaaccctccctggcttctcttggtatctcctgtggccccagactctactccccagtctcatgagcccaccaggctccaggccagagctgacagctgttgctggctgcctctgctgggctgagggcaggttctcacatgggccttcagttcccccagctttggttggagcgtggttgttgtgccgtcactaagttggtgatgagtggcctgaaagcctttccttgtgtggatgctcacttccagtgaggactgtggtggttctggtgagtgagtgtggctttgtgggaaatgagctggtgagttgcagtacaggtggggtccttcttcaggacctgtctcttgggctccctgtcccatttgctgcagtcagttgtctgggtctttgcatactttctctgccattctagagtaatgcctcagactcagctaacagtacacattttggggctttgtcccagaagtcttcaattggaggctcccgggatgggacctgggaagctggatttctggcacgcttcccaggtgattcttctgctatctacattttttttttcaagcaaagcttctagggcagaagcaattctctggacatcactttaataagtcatctaatggatgtgaaatcttttaccataggggttggtagggatagggggcactttatctgctctgtagggcatttagcagcttctggatttttcagtattaaaaaatctatccaaggggctttattttatatttatcctttcccttcctggaaagttttgagatcaacttcaaaaatttgggccaaattttgagtcttaatgcttttaaattaggttgcatcagttaatcttctttattttaatcttaccaatttggaattagaactttttgaatttaccctgaaaatgtatctagactaagccatcaaaaggaaaactaagtgaaaaaaaagttgatgacttcactctgcattcctgtgctgtttaggttcagtagttgcatctccaactctacccttctcagtttatttcagtaaacatgtagccagtctccacagcattgaaggtgtgatggtgataggcattaagggcttcaaagatgactagcactggtccctgcacttaggcagacctgagaaccaatggacaagtaaaatgtgctaagtgcattgatagcatttgtatagagtcctctgggaataccggaaataggaagtgttcttgcaaccatagttttctctgaatgggatggttgataagacaaatccaggaacaccaataagtttcttgacttgaactgagtctggaagcttgaggagtcaggagaagaagcataaaagtgcaaaagtgtttgatatgtttggcaagcagaaaggagtcaagtatgactagttccagatgttcagttccagatgtgtgtgatgagaggaaagggagcccgaagccccaaatgcagtgatatagagccagggcttgactctgtgggccaagagttttcaagctgttcttggaaccctggaagcccctcaaaggtgcctaggaggttagacatgggtgtgtgttggtgttcatgtgcacattgtgcacacccaggagtgcagggagaaggcatgcaagggcctgggtggtccccccttgcttcaactatgttgggcagcagaagattttatatgaataaaaagtccacttcctttgtcctcttcttaataaagtttgaagacctctgctgcagacagttggagaggaggtagagatttttaagcagggagtaagacaatcagatcagggtttcagaaagaaaaacctatggaggccacctggaggttgattaaatctgttgagtctgaagccaagagaccaggtagaaaagagctaataagagccaaggctaggtcagtgggtgccagaggcgaaagaataaagagcacaatggaaggaggggtccaactgtctagaaccccaggggctggggctggggctctgggggttccttgaactgtgggagggaaggaacaataatgaggacatgcgggacctttgcatttgtggcagcattggctgccttttgtttttgtaaattctaatgaaagagcccatccatcagatagactctgatagagatgctcagtgtgcgaaacacccagtgggtcctcagacataggggtctggggctcagagaccgagcctgagagtgatcagggccctggaagagctcatggggtcaaaatgggaaagggcctgggagaacagcagcagtaaggggtgaccagagaagcaggtgagagagtggaacagagtgggcaggccagcaagaagagcaggagagaagggatcatagagcaggctcagaggcctcaacctgcttgaggaaagcctttggttaggatgggggtaggggtaggggtagggtggatcattcatgacatttgctaagtcagtgaagcctaatttcagtgagatgaagtggaaggggtattggaaaaagcacaggtcagtttctagagatgtaattgactgggcataaccaagggcagaaacgggggtgatgtgggtaaatcttgtgtcttcaacctgggaacatgaaggtgtcaccaaggcatggggggattcccctgagatgagcagatcctttggcctctgaaagaagaaagccagagttacagccaggctaacctggagcaatggaaaggtctgaggtctagggtaccccttgcacagctccagtggtgtttatgtggaaggagtgcttttctgtcattgatgtcgggttataaatgactaattgggttgacatgagagataatatccagcagataacatggggactgtcccatatgggtgtgttcatccaggcagatggtggcagagtgaaatgtgcttccttcaatccatgcctcttaagactggtctcttgggagctggaagctgtgacagcagctacttcattggaggggaggccctggagttgatgacgtggttttccctgtcaggaagtttggctgctagaggaagtagttaggtcactggaaagaagaggtgtttgcagcaggtcactggcctatatcgggggggaggggctggagagcctgaggagtgggaggggtaaagctgagctggggctggaaaagaggaatgtggatgctgctcatgcgtgactcttatgttttctcggggaaacagaaacctcgtctgcttgaagagtgcctaggacgggatgaatgggcaagatcttgcagatagtgggaaagactagacatgccagtctagggaaggcagacaaggtcagagctaatgaatctacatggaattcaaacatctctgccatgagattttttccacctcagtgttctttttagaggaacagagctagaactgggcagtggtcacagctccagtctctaacccttaactccattttcttccccctgacttctgccctgggtgcctatgagatacgatagctgtctaatgagattaatagccactgtacactggtacacaggttgtggtgatgctgttagtggtgatgagcccctctttggtcaccccctcatgcctggttaaacacccaactcaacaaaaattagccagatatggtggctactccggaggctgaggtgggaggatggctggagcctgggaagtcgaggctgcagtgagccatgatcatgccactacactccagcctgggcaacagagcgagaccttgttacaataaataagtaaataaataaaaatttaaaaaacacctagctctttggaggctgcttggttttagtaatcatttcagagtctgtctggctttcagcagaagtaggtactttcctactaaagtacctactaaggtttaaccaggcgtgagtacttaataggtactttcccactgaagtaggtactttcctactaaagtaagtacttagtaggtacttcagtgggaaagtacctacttccattgaaatctgcctaaagatttgatctgacaggtggtaaactagtgaacagacattagtttttattttttctatgtaattctgttagggttttgtcatggctacaacttatttctagtattcacatggcggggggtagagagggaattttaatctttgagcatttgttaggattgggccagcacctaggccactctgtaattttttcccacagacctcagtggggtaagtcttacagtatctgctgaaaatgtttataaggctgttccttaaatagagttctgggtgcatatatcaaggctagatatttgtaatccaccatttgagtgatattagtagcttctcactgacctgggggtttcatgcaagacatctaaagcttcagactgagccccattggtcttaactggggtaacagtttgcttagaccgtctgggctgaagtagtattgaattctgtctgtgatattcaggcgtttctctggacctcagataacctgggtctgagttggattttactctcaagccaagtgttgtggtcctccctgcaattagtattgtaaagaagaggaaggatagtgggaatgtgctaatgtggtttagttggctggggccctcattcacccaggatgtgtctcttttcttaattgttctctcagacaaagaattcactgttcggttggaaacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaacgtggccaaagagagcgacagtgtctttgtgctgaagatctaccacctccgccaggaagatagcgggaaatacaactgccgggtgactgagcgagagaaaaccgtgacgggggaattcactgataaggagagcaagcgtcccaagaacatccccatcatagtcctccccctcagtaagtagagagatgtgctgctttcttctcctttggctcagcatcatttaggagaggtagggggagagagaatagtgtggtgagggtgaggggaggcagatggaacccccgaggttaatgcagagctgggggaaaaaccattgagcctctcttccctgttgtagcccacctgcctacatttagcagtctccccatagcagaggatcaggatcaggggtgtccaggatcagggcagtctagggctgggcataggcctatctgattgctagcagccctgtgcatacacaagcagtgccagctcagcttggagggaaaccaggaatcccagaaagctgtttgctcttgtgtgggaatcaagtcccagaagaagtgggtagatagatgcctgccttgaaatctcacttaaggagagctggtcttttatgggaggattttaaatcataaagtgcattattaaggatttgccatctgggtttttcaggtataaaggctggcatttccctaaatggcttttccctgttgaaattgtgtttctaaaagtcagtggatgggacctctcacatcttcctggagcatagtcttttaagcttagctgatttctgaggctgcctcagtgggctcccagccttcatgtagactggccttgtgtgggtgggtagtggccattgctagggattccagaaactaccggtgtttgcttgtgttgtgtttaaacattcacagtatcaagatattcttattaatctcattctcccatagttctgtttttagtaaagagaataaaaacctacgatgctctgattttaaacaagtggtaaagttttaagactaatctttaaccttttctcagctgctaaaactattctttctctgagccttgtaataatttcctttactttttatttatatgttttaatatttaaaatatttctcttcaagtgtgaagtaaaaagtagccataggggtcctcttgttagtcttttcttcttttctcatcaactggattattttcttttatgcttattattattttgttaaaaaccatgcacacacatacctaattatcttttttttcctggcaataaatattttaatttgtttcatttttatgatgacaaataattttcaagtttatttcctcgtttaaatacaaagctaaaccacaaacaggtataatcaagacattgtgtctcatatttacactcccatcggatcctcttccaatttgctgaccactgaccaggctagcggggggcgggggtgggagggaagactttcttaggtaacaccgtcgtaaggcccgaggtggggttgggggggaaatcaaagatgaggacaggctctcatacctgtctccattcacatttacctgggaccagggtgggcaggagacaccaggtcatggctcctgagccccggccccctggactgaagggacagtgtgtgagaatcagttctgtgaagggcgggaggaagcagccacctattcctcctgccttcacagttaaggtgaaaaccttagccctatccttgattcctgggggctgccgggccctgtgtgcccccctgcacacctgggtgtctttctgaggctggcagcatcggctggggtcaggggtcctgggctcctaggctcacacctcagctcagttgcgtccttgcaggaggacactgggtatctgacaaacacaaagcctcgacagcaggtctggaactttcaaccccagcaggatgagggggaatgggggtggatgtcaggtaagtaatttctggtcccactacaaaactttatttttgattagagtaccattctcaatctcttctacaaaaagcaaaaaaaaaaaagcaaaaaaaaaaaaaaaaagcagccacttcactcacttcaagacctatatacatgtaagttgttttctgtgttttttttaattatttttaatttttattattatttttaaaataaattcagtgttcacatttctataaagaattaacccagtttcaggaaaccctgccccagcagggcaggtaagcaacactctccctgcccacatctagtttgatttcgcgccctgatgcttcaagctgcccagaaaagcggcagcttgtggaagaggaaatctatgcctggcccgtgcttggggcccagggctcagtaagctttcgagaaaacagaggggaagactagcttactgcaaaaacctttttaaaaaatattcatacacttcagtgagtgcctgtcgagacgttaggagaacaagagcttggaaacatcccgtccaggccactgggaggcagcatcttcctcacaccccgtccctggatttcgggggtgcagggggaaggtcccggctcttccactggagaaaggagactcacctagcttcctagttcatgtttgactatttcctctaaaacctgtgctgagtctttgactgcatgcacgggaagcacaaacgttcggcttgtatgcaaaaaaagtacaaaaacaactagaatataaaagttttggtaatataaggccatctgttcaagtccaccttggaaacctgtaacagatatttaaatactacagtgaaaaggcatcttaatatactttttaaaaacatctgaagtaatccgctaagattaagtgtgtaaaaaaaaattcaattccctttgagggcactttgtcctttgaagaagggaaagtggggcggggagggcgcggggcccaccggttaatgcttcagccatgggtgggcttcaatggaagccttgctgcggtccccatagtcatacaggggctcctccccagccgcgatgtctcgggaggcgatgaggatgaggtgaggtacgccgtcgatgtcgtgcagtttggtttggcagttcccacgtttgctgtgattgatcagtcttcctaggcgatttgtctctctagttgcatccacgcagtaggttttgctcagatactgaaaatagtacatgtagcagcccgtggaagggtcctgtgcgtacagagcctcccgtttcttggcgtcggtgatctcgatgaggtccccgtggtattccaccacaaaggcaccccgggagaactgcttggtggcaatcacacccctgcctttgccatcgatgaggtcgatcttcattccttcttccttcccactttcaatcaattcatctattcttttcctttcttcagactgcagctcggctttgctcttcctggagctccttcggacagggtagaaatccgtgtttgcgattctgttgcgtttttccttgagctttttttcgggggggctgtttgcccttgatgggctttttcagggccggcttggcgatggctgcattggtggaatcacaagatgagggtggagtttttggaggttctgctgcttcagatttttggtttggaaaaggtaccaggggacgtctcctggcgtctttgatcttctgttcctcggacttcatggcgctccgtactgcgttcccagcatttcttttctcttctcgtttcctgtagattccagctaatggtttcccctggcatttgacttcgtgatgtgtaactgagttctcttcctgaagggggaaacgcattccagagcatttgttcgggctcatgtaggaatagatctttgactgcccggtaaatacgttctccccgtcggtgcggggcctccccgggcccctccgctccaccatctccgggcccggggccgtcgctgccaccgccgccgccgccgcctccaccgcgcagggcttggacatcttcccgcctgcagcccggccaggcccatggcagcgcgccctgcgccctagccgccgccgccgctgcccggccaccaccgctgccgctgccgctgctgctgctgctgccgccgccaccagcgccgccgcggcgcccccttcccccatggccggcaaggcagggcccggcacccgcgcaccgcggcagccccgggccgcccggggcgaggcacgcagggaggaaggcgcaggcggcgcgtcctcagcagccagcccgcccgctccacctaattatcttgaaattcttttgtttcttagccttttccaccctgcaatgcctaacatggtgctttgcatagagtaggtgctcgctgaatactgtacaactgaaattattgaattgaatgcccactgtctttactattttcctgtcagtctgtgcttgccttaaccacggactctctacttttaaatctgcaactaattcctcattgttttctaaggatcaagtgaagggcagccacgctgtttacttcctatattttttgtactaagatttcccccaaccccttctgagaacttgtttgatgatctgtggcctgctatattgcttttccagcagataactgggtagttaaagtcccccagcaccgccagatcctgtcccaaggccacttgggtaagtcggctgaagaacaacaacaatcacatcggtaatggtgataatgccttggattttaatggcgctttttctcctaagagaccaaagtgcttctgcatatatcatctccttctccgctcccacctctcaaatcctcgtagaggccaatatgatatccatctaatgaatgaagaaatcagagcaccacacaggaagtgacagagctgattgttcagttagtggttgagcttgcattgtattaggaaatatttgcttctaactccacacccaccgccctgcgcttagcctgtgctacaccatcaacttcctgatttgaaatttcatttgcgaatgtgtactcagatttttattagttctgtcctagttttcacttaatccagagagtttaaaattgtcagctgccttttctcaggcctggaaattcttgtaaatagtgtttagtgggcagtgaggcaccaggtctgtagttgcctttgcctcagctgctgtaataaaatagcatttcttcttgtagccccacattctaactatgtgggtttccaggcttgctcaagcaacagagcaccaccaaacagtagccctttcaataaatgagccaggacttgcataagcgtccactgggatgacagtaggggatgagagtgaggtcctgcaagtcattctcctgcttaagacaagtgaaagaattttcttccttgatgctgcagttgcccttttaatcccttattttgaattgataacagtggggatgagtctttaatctaaagaggaatattgttgttattaatgatgatgaaaaataattacctcatctaatcctgtcaatgtcatgccctaagaagtaggcactattagtatctccatttttcacatgagaaattggagctttggtaggttaaggaagaaccacaggattacagagttaagaagtctccaaatccagccccttaaccattagtgctatagatggtgactgttcaggagcctgattatctctatgaatcatcctggtatgactcctgggggaggttgccctcctgggaaaattgctattccctgccccatccagaccttttatttttcacataaaacaagcacatccagaatggctagcaggcatcctcactataataagagctacattttgaggctcagtgctcatctttgtttctgcttgttgaggaaataaaggagagaaaagatttgattcaaatgcattgttatgtgtatgtgtgtgttttctcttggtaattgggtgtgcctcttaaaatctgggatttgatttaattaattggtttaaattattgcatgtatttaatgtgggtggtacccaaaaattggagccaaattagttactttgtgttctttaatacttacagaccttctgaactcaatatagataattatacaaaatactacgtgcataattaaaacatattaggctatctgtgatgtttataaaaacaaagagttatgtggaatagtaaaattaatcatgatcatgatgaccagtttttgaaaacctactatgtgttaggtgaatctatatgcatcatctcatttactttttaatatttaaagaattctacaattaaaggtggctctctacctgtcttacagaagaagaggctgaggcatgtcgagtttaaataatttgattgagtgattcagatagttaagcgagcagcagaggctagatgagacagggaagggagtggaatccttatcccaaacttttgattggccaaatgtttctagaaagagagcaaaggagccccagggctgactggacaggtgggagagtggtggatgatgagctgctggctttgttttattcctgtgtgttaatgaaagaatgaaagcctgctcctcatgcactgcaaaaccagaccatctgtgctctcttattacccacacttaagcacacgttatcatccaaatacttactgtcagttttttttttttcgtacttcctaaattgtcctgaaggactcaaatggcacattatggatgttcagcttttatttgactgctgtagtatcgaatggtaggaagagtgaagtgaagtaggattttggagttactcttcttgctgaaaattcaacttgaaaaaccctgaactgccgctgaatagattacccaataaattgttttatgccctaatcatcatgccactatgttgtatttcttaggttcttattcaggctcaggtgttagaacctcgttatcacagttctctgcacacagcaaagaacatcctagattatcagatctaaaaccacagggagcaatgcccagaaccagccagggcttacatcagctagggtcagagtgtttttgaccctctgaggctcaccgtacctgaatatgattccatttgcacccctcctcctgtttcctctgtggggagggcgctgtggagaccataaagcctccagggtgtttctctctccctcttcctagagagcagcatctccgtgggggtggccagcaatgccagcgtcatccttgagggcgacgacctgcgcttctcctgcagcgtccgcatggcaggcaggccgcagggtcgcttctctgtcatctggcagcttgtggacaggcagaactgccgcagcaatatcatgtggctagaccgggatggcaccgtgcagccaggctcgtcctactgggagcgcagcagctttgggagcgtccagatggagcaggtgcagcccaactcattcagcctgggcatcttcaacagcaggaaggaggacgagggccagtatgaatgccatgtgactgaatgggtgcgggtggtggatggcgagtggcagattgttggggagcgccgggccagcactcccatctccatcatagctcttggtgagtgagcggtgggactggcagtgggtctggcatggagacagcttcagtgtcaaacaccttatcctgacttttgtctgtcagagttctagcaggaaactatggccagtcttttacctatagagtttgaagtactttcctttatatctattttgtttcttataagggtttaattaattaagatagtgctagcagggactaagggacccacagtggatgatggggctcctgagggatagcaatagctggcagctgtgactactcctagtctggctgggagagagtgatgttatcagaactctatccaggttagtgaagccacccagccatagtggtggccccaggtggaggagcatggccactgccagcctggccttaaagagagcagagtggctgagcactgtgtggcatgtctttcctgccctgctgttcaggggccagccttcctgaaagagagcagagaagggtataaaattatctgttgtcatttatttagcatttactatgttcctggctaatccttaacacttaagcttagttgtcccattgaatccccacctagccaagtgacagacactttcattttatggaggaaactgagactgagacacattaaatactttgcctaaggctagaagtttctactacctgatggggcccatacctaacaaagctattccctcattagcatggaatgaaaagataccttgagatttgctaaaaccaaggaagattagatttgcttctcatggggtaaagaggcttctatcaacatttatctgcttggatataatcagtatattagattttaaacgaccagtctgtgactttgctgggaaagaaacttgttatgtcaggtcttcctgtttatcaggagacatcggttgtcctcagcaactttatgtcccactccctgggactgtgtcaccaccttccttgcaggtcgggatggtggtgcttttggatacttccagtaaagatggcagccccgagtggtttttgtccttaacagagtcctccattttcttacccctctgagattagaattacatttgttttctaaagcttaatcctaaagattgacctgctttttgcagtaattatatggctcagatttctgtcttagaaacttcctccagtgattgcgtttcctgatcagctcagttcctgtgtccatactcagcacctgtgtggacccagtcagatggaacttgggggacaaattttggatgtccagtactggtgttttttttttttaaccatcctggaaggttaggaatgtccaatgagtgattagagttagtgaggattgtttctctagaagtaatttatggtatcaggttatcccctgagttttttcttactcaccatatgtctggtggttctcacagccaggggcactgaggagctctgccctgggatctggaggccagcactgttcacctgatctccaccgctgagatacctctggctacagccataatcaggtggcccaaaggactgaacaaggaagaatgggagggcactctagactaattaaggttgtcttttcagtctaaagttaacaatgacacacatgaattttcatatcagtataatttgatgtgggtcccaaatgtacaatgggccattatggctgttcagttagagcagcttgggtgctctgtgactgtggaatgtgcctgtgtcaggactagacaaagtcatttgcttggggaagctctctccccttcaggtgtgaggccaggagcacctggtgtgggtcctgtccctgaggttctgtcctacaccaccctcatgcaacacctactacacacaggtgcacagtgacagtcagaggtgcttcatgtttaaggatggacctccgtgtcataaacttttttaaagggtatatagagatagctcatgaaatccaaatcaaaggtccagagttttcagcaaattgtacctacctatttgccaacttaacctcaccatagaaagccaaaagattcatcctgtggccagtctttcacattacagaatttaaagtacttttttaaaatttctatttcattttttaacaaaatatttaacaaaatatagtatatctcatgtgccaggtactatttgtaatatttataaacactgatttatttaatcttcacagagactcattttacagattggaaaacagaggcagagagaagttaagtaactttaatgtcactcagctgggacgtatcaaaggcttggctgctggctccagagtctagacctttaaccattgtgttatgctttccatgggtaaagcaacctaaaaaggcccctggaatcagttacatgtggttggagactaactctgtcattgacttaccaaatgcttgatattgggcaatttatctaacctctctctgcatcagtttctacgtctgcaggaagagatgacaagcctgcctgttctacaaggttgttttggggattcagtggagcatgatgagagcaaagcagttggcaccatgcttgcacctagatagtgctcaataaatactggctactgttagctttatgattgtgatcaatgtatgaatattaagcagtatttccaggctgaaggaactctgaggtactcatattgaggagtcagtattagagcttagcagtgctgcccattcaataaggaatattgagagacccacagccgctgagactgcagaaccctgcatttaggacaattgtcccaccccactggaggtccccacctgctctgttcttggatttcatgagggacgtgagaaagggactggaggccgactccatctgcttcccttctcagcaccagtgcactaagggaccaggaaaagaggtgttggggctgtgtggttgtgttttcctcctgcgcaatggaggaaattggctttggggttttcttttcctgttttctcatggaatctcaagatttctaggagcaaccctgcctacatgcaatcagtccctgagaggattgtgatgtctaattccaggggaggagcaaatgcacgaggatctcattgggaagggttaggctagcgctgctcagggggaattgtggtgggcctttctttggagtcttggaaactcttggactgggcctcagcaggatactaaaagcaacactagcctgagagctcaaaaggggccccgagagcctctgctccacactgcttgctttgccagctgccccattgctgatgtcatactgccctgagaaagccacatgcctcctctggttgaatctctctgctctctctccagaaatgggcttcgcagtcacagccatctcccggacaccgggggtgacctacagcgactcctttgacttgcagtgtatcatcaaaccccactaccctgcccaggtccccgtgtcagtgacatggcggttccagccggtgggcacggtggagttccatgacttggtgaccttcacccgggacggaggggtccagtggggggacaggtcctccagcttccgaacccgaactgccaccgagaaggctgagtccagcaacaacgtccgcctaatcatcagccgagccagtgacacggaagcaggcaagtaccagtgtgtggcagagctgtggtggaagaacta

SEQ ID NO: 10400 - DNA, 525 bp, Homo sapiens
gagaaggcaggcagaagtgaccttggagaacagtatctgagccagaaggcaggaggtcagcgggggagtcttgagtgggaaactcaagggtagcctgactgtccttgtcacaggtttagctgggcactgttagttcccccctttgtcagtttgtgggaatctgggcatcagggatctgtttcagcccttcacatttgtgtttgggtgtgctcagcttaaaacgatagcagcctgcaggagcttagctctgcctccatttatggagggaagagaaactaaggaatgccccttggggtggtgttggggagcagctacatgggaaattgaagggtgcagcaccagtaaaaaggtgctcccaggactccctcccaccagcgctcagaccaaggaagaagcatttaatttcagccagatttctagatggttgcttttatttgttttcatctgaatttgtgccaaggattcaacttttcctgctcattttattaaaaacttcatacacagcattaataaatagatataaaa

SEQ ID NO: 10401 - DNA, 524 bp, Homo sapiens
gagaaggcaggcagaagtgaccttggagaacagtatctgagccagaaggcaggaggtcagcgggggagtcttgagtgggaaactcaagggtagcctgactgtccttgtcacaggtttagctgggcactgttagttcccccctttgtcagtttgtgggaatctgggcatcagggatctctttcagcccttcacatttgtatttgggtgtgctcagcttaaaacgatagcagcctgcaggagctcagctctgcctccatttatagagggaagagaaactaaggaatgctccttggggtggtgttggggagcagctacatgggaaaatgaagggtgcagcaccagtaaaaaggtgctcccaggactccctcccaccagcactcggaccaaggaagaagcatttaatttcagccagatttctagatggttgcttttatttgttttcatctgaatttgtgccaaggattcaacttttcctgcttattttattaaaaactttatacacagcattaataaatagatataaa

SEQ ID NO: 10402 - DNA, 221 bp, Homo sapiens
gatcacgaagttaggagttcgagaccagcctggccaacatggtgaaaccctgtctctactaaaaatacaaaaattagctgggcctggtggcatgcatctgtaatcctagctactgaggaggctgaggcaggagagttgcttgaacctgggaggtggaggttgcagtgagccaagatcacgccattgcactccagcctgggagacagagcaagactctgtct

SEQ ID NO: 10403 - DNA, 7282 bp, Homo sapiens
cgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtaggcgctcccgggccaggacccggctggggtcgggggcgcgggacggggtggtaggcaaaggtgcttggggtccggccaacgcttgggctgggcacagggcggatcagtagattgggtcagataagacgccatttgaccaggttcacgtttttgtggatcgaggggtttcccatggagtgatataatgggggcgcctagaggaagtgcagtgttcagtggctttctctatctgttcctttcctcagcgcccagtgtagcgcgtggcgttccatataagttgtggaattgaaatggattccagggccatgccattccccttctctcattctcctcgctctccaccccccctcccccgccaatgtcctggaaggacgccctttagtgggtgcctcctaggagcttggagcagctggcagctctcttgccgggcttgcacggcacccgggctcagttgtaggtggtaagggggctggaagactgtgtccggctcctgccttggggattccgaattgaatccgcgctgagactagaacacgccctcccaagggagcagtcccagagtcatccacccgaggcggaggaatctgctcggagtagaaatgttgaaaagcccacaccggccaggaaccctcgcttcgattcactttattttccagccagcgattttcctttgaacatagggatcccatccaggaggaggagacacagctcctagaaacaggatccgccgggtcctcctcctgcgcgggtagacgcagaacgttcccacagtctactttatgcgagcgtggcacccctgcttgaggcaccccagagcaccctcgggccgctccttttcacccgaaagataggatcaccccccagttaagtcgcttctgggttttccgcaactcacctgacactcccaacaccccgaccccgtcccggggctcgctgctgccacctactgcccaacccgaatgaaatttcagacgcatgatcaagcccagtttaatagggaggaaaaaaaaaccttttcttctccatgactggggctaagagctgttctgggacaagcatgtatgtgtgtgtggtgggatgggatgggatggggtgggaggagggggcagcaggggatttttctagctggtgccagagcagccaggcctcttagaggtggggtgagtctggccattgtgcaaccccttccagttcctctgagcagataatagctgaatccagatggtgacagcccgtgtgtcaccgtttccagttgagtctaggatatgagtaactggactgaacaaaaggcctttaaagagaccagccagcttcctagaagagaggagatgctactcatttctaggggtggggtcgggtgtggggggataaacaaacaagtggaaaacccattcgcaggattccatacccttcctgtgagaattgtaactcaaggctgcttacacttgagtcggactgtaggcaggttgcttaaggctgcattgtcccagcctccccctccaagtcatctgttccttctgattaatgacagctctgcatgttctctggcccctgcttccccttggaggctgcagagtcaccacattctgtgccctttctgtgttgagcactttgggtctgcaggaggcacatgcacgtccagggactgcttttcagctcctggacaggccaggggcttccttctatcagccactcaactagtgtggcctgcaaacaggaaagggccacagagggtggggggtttgcttagctctcaggagctgacagaagatgggaacatgtacaggagacagttctttcaaatcatctgtgtgaaagcgggtaaccctttgggtatttgcaagtctagagctttaggtgttactggttttaaaggtgtcaggggcagctggggctgcgtaaggtaaggtggcagaggaaaggagtaggtgaatggaacttactcacatcctaagcccacaggttgagaacttctgttcagctccctcaggggtttgcgaggctgcctttgcttttctagccccctaaacgggccccccttctctctacaggtgtttcccattaaacactaccaggacaaaatcaggccttacatccagctgccatcgcacagcaacattactggcattgtggaagtgatccttggggaaaccaaggcctatgttttctttgagaaggactttggggacatgcactcctatgtgcgaagccggaagaggctgcgggaagaggaagccgcccggctcttcaagcagattgtttccgccgtcgcccactgccaccagtcagccatcgtgttgggggacctgaagcttaggaagtttgttttctccacggaggagaggtgagcggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaaggttggtttattctgcattctcttggacggggcctggggacaccgtggcgcttctatgggatggcaagtgttgacagggtgctcttcctctcctaccccaggatcaggttcattccccattgttgtcagaaaggtcagttgtctggggtacaaatattaaactgccctttacgatattgccttctgaaggaagtgttcaaatctttgcttatgccaagtgctgttttgtacctggaaggtttcacagagctagtgagactgtcatatatgcagaattccaccctcttgtttcacacagcattcctctcccatcccagtccaggttctctgtaacatcacattctctggtgactttttagacagcttgtttggatccgtcttcagaaaatagccacattgaatagtaaatggaagttggttaggatggattgctaaatatagatcatagcttacctcataaagaacaagatgagcttgataagagagtaatgaggcattaagattcaaagctgaggtttcagctagagaattcaggaagccgcatgagatagaccacacttgattttaagagccagccacatcccttgtggaaagattacaagcagtaaggctgtaacattgtagaggtgagagtgagttagtttgttgtaagaagtgggcttatctcacctgtgcatttttacctttgactccagagcatatgaaacagtacagggttgagctgtcataaagcatgactttgtatctgacctcgcaataattattggaacacactgattagcaaagaaaagcaaactgttggcaatgaagaagtttctaattcctggaacatgctcctttgatatggtgatgcattttctgaaacatgccttacacacctccttactagcttttgaaatctgcattgcacaggcgaatatcatgggcatggggtttggcaacccgggggttaagcaatgtcaggctgacgctattcgtgtaaccagcacaggtgcagggttttagtgctgtagcagccaatcaggggcagacagtgtgggttgagtcatattttccgtttacagaaccaatgggtattttacataacgacagggaggtcacgctgaggacatactgaagttagcacatgtatactacactccagggaacaggaaggcagaaaaaaaaaaaaacagacctttgagaggaaaaggaattgacccatcagccagtaccaaatgtttgcatttaacttcacaagtgacttactgaaacgggtatttcagagaagcaggcagagacagggtgtcactggatatcagagcttccccaccacatggctttgagctttgggggatccaggagacttgggtggctggttctgaataaggaggcacctgcagcttcataagagagcctttgactgaaggtgttttagactttcgttgttacctgaacagagaccccccctgtagaatacatatgctcacatgttgatgtgccatcccagggggagtgtgtgtccctgtgtaagaatttcagggtccctgcgtccctgaaatccatcagccacttttgtttgctcgcataacctctctgtccaggcaaagtgttctttgcagttaaacaccccaataaatgtaattaacattccttgcaactttcccatcctaattgttgcagcctgggcccaggtggacaaagtttgctctgtgtgcatgtatcagtgtgggcaccagcgctgatgacctgtgtgtaatagcagtgactttgggctccgtgttctgtaatgcagtgtgggtccaggtagccctggcagtcataagagggaagatgggttcgtaggatgctcaggccctctctgaagaagtaggatatgctgctcttccctgctagcttttgtagagaatgcagcattctgagacaggctcccagttctgcaatgggaacttagtaaattgcgtaactcctattaggatatctcttgtaagctccagcattatgaatactatttggggctttgcctcataccctccaccccaggcgctctgccgatactttgcaaacatttattgcagttcgtgttagtttgtgaaatcacgagccctcggtagttgcagggcactgcttactggacgaaggggtaaatagcattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaata

SEQ ID NO: 10404 - DNA, 352 bp, Homo sapiens
gcccattgggtgttgatacgtgctttgggttgaatttagactcgggaaacattttttattttttatactctttcatagcagaatcagaatcaagaaacgtttgaaggtgagcattcataaattaaccttgagttgtaaaaatcagcttgtcttttttgggccgtggacccttgagaatttgataaagctatgaccactcctgagaacagtgtcacatgtataaaacaaaattttgttatcattgcagaggttcacacagatctctgaaggcatcatgggacttccgattgtgaaccaatccctcttcattagacttaattaaaatggctaagcaaaccattttctttttttt

SEQ ID NO: 10405 - DNA, 414 bp, Homo sapiens
gcggccgcccccagcgaggctccgggagcccttgcctgcgggggtccggggactcgagccggcctccgccccccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcgg

SEQ ID NO: 10406 - DNA, 26059 bp, Homo sapiens
tagactttatcactgtataaaaatgtacagtggttttattgacatgtacattccaatatgtttacagctgcaagataatgaggcacactcagtattgcacttcattaaaatttcaggctcaaacttaacctagaagtttaaatgaaattgcatttgtaatttagtaattcttatacaggacaaacattgatatgtttatatacagtgtgatacttattacatttatatgctgtcctaacacaatgttttttttttttttaaataacagtctaggaaataaaccagaatattcctctttttatccccacccgtgatgcaattgtacaggattacaaaaaggcagtatacaataaacaatgattatttttcttttttgcttgaaagccagcatcgttcttagtccatgggcatggcgattcttttatatcaattatctataaatgtccaatgcttcacaggccaatgacggtaatggccacatgcaaacacctcacaagtttgatgtcatttgttcaaaagaagataaaccaaaataatggggaaacttttcatagcaagaattatgtacatggtatttggtatccttcttgcactgtgaatggttcattttcatggatgtaaaaatggtcccgtccttatcctgagcagagtttaaacttcaccgcatcctcttgggggatgaaggcaatttttctctctgtagacaaaggatctgcgtgttctaaaaagtgtgggcatttctgcacactccacatcccagagcaaactcttccccagtgggtggatgaacaacatggagtggacattcagttccttctaactgcttgcctttgggacctgtataaatttgaaggaggcaaaggaaaataatgttttaagaatacacacatataaacctcacagaaatataaatcactgataggttattcaaagaaataacatgactatggttatacaaatataacatttagaaatttttcttctgatcacaaaagtaaaaaatgttcactataaaaaattcaacacagatatgtacaatggaagaagtgatggggtcccttactcactatatcctgcctagagaggatcacttcgagctacagatctttttctattaataaatgcatcagatatatcattttaaaacagagtaatgaacaaaaaaggtcacaaaacccctcaatttagtctggcagaacattatttttctgaatagaaaacagggagatttttgtgtagaatgtttttctataagtaaaaacatttaagtttaaagaagccatgttttcccttttatttttactgatgaaaaagcccacactggtaaaatgggaaggccaatgattcctgtaatttttaaaagtacctgaaggatattagcaggaaaatgaaagttatcaggttaaaaacatgaacaatgttataaaatacaatgtggaaaaaacactttggggaagatatgaatttgttgataataatcaaagtaggcctatcaaatgtaccaaaaacagtattttaaaaaagaaaattattatattaatgtgcttcacgtcatgggtttcatatcatttagaaaagatttttagttcctttagaaaccaggaggcttactttgtcagaaaaacacgctaggcttatacttgaaagcagagtccctatttaatagtagatgaaggaataggaactctgcattagttttctacagctagttttcaaaataataaatctaaattctgattgtgcttgagagaaaaatatcacgagattggatggaatgagcttacactgatcaatgaggaatgacgtctcatttactttaccttttctaggtttaaaaacatttctgacataagagaaggaaaccatgatggataaaaggctagcatttataaagctcttagactgcacagtataatacccaataaatgttggctattactactattactgaacaaccacaaactgaggcctgatctagaggaataaaaagtaagttctgtacaagagtaagaccaagacattagagtgtcaaactgaagacagctaatctcagagaagtcaacttcaggttagagctaacaggcatgagagtggcaatgagtgccacctcagacaaatgcaggcacagacctcaggatgggtcagcatgggaggatgccagaggtttgctagaaagttaattattcctgttagaaagtagttcagtagctcctgctccaaatcacactgcagattggtgcccaccccaccagtgggtgggggagagtgcgcaggatggggacactcaatggcagatctagttcagatacacaacatatcaatggtggtgacacaaactgcagcccttgggttttttcaaggaaaaaatgagtcatttactcaacaaatatttaccgcatgcctaatatatgaagggcattcttaggtacttgggattaaagatgaaaagtgcatggctcccatcttcaaggtgttcacaatccaacatggtggtgagaaataaaaatagtgaaaacacacctgcaaacatctgagtgcttactactgaggcactgttctagtatatcagctacttaaccatttaacagtcataggaggcagaaacgattatcctcattttgtagatatgaaactgaagtaaaattattttttctgattcttagatacctcatctttaaaatagacacagcaatacctaactcatggggtgctgtgaagattaagtatcctggcacgagaaggtagtcaataaatattttagaaagaaatggatagagggattatgctatggtctggatgtttttgtgctcctccaaatttatatactgacgtgttaatgaaaggagttagtttgccttaggtagatagcaagggaagggtccccagagagccccaggtccacaggtcagtgcctcatccccatataacataaaaagcagttggggaaaaaaagtcaagctgcaggcaccgatgagggaactagcacagggcattgtgcctaaagacatgcccacggctgcacagacagaaaaaccttcaatcagataaaggacaagacctgggatagaaatgcctttgtcctttgtatagtcagggggctctctccttttgtgggcataggcacagtgggctccagtgggttcctgggccagggtcccgggccaagctgagtcacgctgcgggccaagacagcccacagactaagcacattccttcccctttccagtccataaaaaccctgggccccagcctcacgggagcatcctgtttgggcccccctctctgctggcagagagctttcttcttttgcttattaaactttcgctctaacctcacctttgtatctgtgctccttaatcttcttggaggtaggacaaagaactcctggcattatctcagacaatgagagactgttatatcttggtgcactgctgagactacaacattaacaccaatgttatggtgttaggaggtggagctgtgggaggtgatgaggtcatggggtggaatccatgaatgggattagtgctcttcctatcaatgagacccaggagaggccccctgcccttccacgacagcaagaaagtgccacctatgaggctgagagtgggtcctcaccagacacctcgactgctaattcctagatcttagacttcctggtctccagaactgtgagaataaatttccactgtttataagctacccagtttacagtattttgttatagcagcttgaatggatgaagactgattatctaaaaatattagaattaacagggttgagagtggttagagaattgcttcttctgtccttctaagtaaactgtatatggccatcttccctactcacatccctgtgggatctcctttattctattccagttctctaaatgaatggatgagttagagggatgtgtgaggctgggagagtatacctcaatctcagtgtatgttcttaggccagttcattaacctccctagccctcaattttccatttgataacatagggataataccatctactcgcagattgtaaaaatggagcaaatatgtgtgaaaatgcccaggaccgaggtcattccttccttctgccaactctggctcctcccccgcctccctcctgtgattcctttgtgttggctgccctgatcctgtgaggaaacctgaccctcctctctcagctactacccaccactgagttctctaaagtgtttcattgttaacttccttatttttagcattcttatttctgttttttaacatagaggaaactttaagtaaaatctagatttcccctgaagatactgcttgccttaaatctttctcaactggaggctggttatctcccaagctcctccaggtcatatggctacaacgtgtgactgatttttctcttggctcctatttctttccagaccacaacctacaactttcattcaataattgcccttcctccaagctcaagtcatctagagtcatctagaatactgccctttccacactcccttcacttgctgacctccagcacatcaccccctccctccaagcatggctcacatctctgttctgtccattatcctccataacctggcttcacatcattctggccttgcttctttcaaagcctgctacttctattaaaaaaaaacagtatttgaggagaaacagtaaaacaatttttatttgacatgagcaaatggtaaaaagtagtcatacttgaaaaaaccctacttatctttattttgaaatggatagtatatgtttcacatggtttaaaatcaaaatgttaaaaatgataacacaattggaagcaactttccctagtctctaccctcatctttttcttgcttttcccaatagttaatcaatagtattagtttcttgagtatctttccaggggtttctttatgtaaatataaacaaatatgactagatagtctcattttccctcttacaaaaggcagcatactgcatactctgttctgcaatttgctttttttttttgaaacagctctgtcgcccaggctggagtgcagtggcgcaatcttggctcactgcaacctccgcctctcaggctcaagtgattctctggcctcagcctcgtgagtagctcggattacaggtacccgccaccatgcctggctaatttttgtacatttagtagagatggggtttcaccatgttggccaggctggtctcgtactcctgacctcaagtgatccacctgcttcggtctcccatagtgctgggattacaggtgtcagtcacaccacttggcctaatttacttttttcatctgatgctatctcctgaagatctttccaaatcagcacacagaaacaccatcctcactcttttttttttttaaactgatgcgtaatattagccactaccctactggacactagcattgtttatacatttttattatcatagcaaagctgtagttaataaccttgtttatttgcccttttttactgtcctcacatttgtagctatatccctgaagagggagtgctgaagggttgatacgctggtaattttgagaggcactattaagctgttttccggagaggtctatcacttgcactctgataggcagcagatggcagtgtgtgttttctagctttgacaacacggtatattgtgttgtatgtacttgtgcatgtattttcactaatttcagatatatcttatgtaaaattctctcctatggttgcacggacctctccttccacttctctcacttccgtgaagcctggtattccacctcaccgttgccactagcctcctgtcctcttccagtattttcagcttctttttggtttcatacttctttcccctcagcctgctttccatagacaataatttctcctgtattctgagtggtttctttaattcccttgactttctgatgctcactacactactgattcccagccattctagattaaatcacttggttcattttatggcaacggttccaggcttcgttaaaaaaaaaaaaaaatcacagaatccttttaaatggttctgtaatattgaacttcatatgactttttagtgctgaacagccatcttttcaccaatccttagtagacttcattctcactccccatgagatctgctccgtcacagctaacttctcactcatgatgatgagcctgcttcctaattcacccagaaagtcataagcttacaaggatcaaggaattcctcctgcttctttaggctagtttgaattgagtttctgtcacttgaaacagagctttcatataatgtttacataaaactatggtatatagatcataatcgtgattttaaaatattaaaagcatacctgcaggacagtgtggtagttcttccttaggaatgctagtcattctttgaaaatcatcatgacaagcattacaaaaatgtgttgttccaaaacagaaaaaaacagccactgaacagcagtagcgacatttatattccaaaaagtctgtgccatgtttgggacacatctatagcaaaagagaagagacagacacaagatcatagtgagactatttcaatcacacttaagataggcatatacatagacagctccttaattcatattttgagggcctacataactctaaaaattgattgaaaaactgatgatacacatgtttgaaaactaacaaataaatatgtggcctgtccaaaaggtctggacaaagatccaagttctaattccatttccatcataatctatctgatttaataagcaaggtacttaatttctttatgaatgttttatggctggtcaaactgaaaattaatgaaattaacctctcttataatctcacagatgtactgtgaacatttcactgaagaggggaaaacctaaaagtttcactgcacgtttaagaaactaagaaaataagaaaatttattacattgtttaactatggtgatcatttcatggaagacaaaattataaaataaaaatatcgcccaaaggaaataatatatatgaaataatgtgaaaaattatacaacactgaacaaatatcagaaaatactgaggagaaaagcctgatttacattcccaccatattattgtttaaaaaataatactatttaacatttctaaactgttgtttctaataaaatgttctgcctacctgagccctggaaacatcagaacaggcaccacaaatgagctctctgggatcataatcatctccccgtccagcctcagcatcgcagcgagcttcaccaccaaaatatgcctgtggagaaaacacatctagattacagcaggaaaaaagaaaactctggcatgggagatacagtatgggcatagtgaaagtaagatctaggggttttagaaaataccattatctactagaccatcccttgaaatgccaagtgcatgcccatattgcttgctgactgtatgtagggtggatcagggtaagaaataaagctatttcttctttttctttcttcccctcctaccttccttccctccttcccttccttcccttctcttctcttctcctcttccacctctctctctgtttctttgagacgggctctcactctgttgcccaggctggagcatagtggcgcaatcatggctcccgacagcctcaacctcttgggctcaggcgatccgcccaactcagcctcctgagtggctaggatcataggtgcacgccaccacacccggctaattgtttaattatttgtagagacagagtctccctatgctgcccaggctggtctcaaactcctgggctcaggtgatcctcttgccttggcctcccaaagtgctgggattattggcatgagccacatgcctggcctaaagctatttcgactctcaaatggattcaagcttaaagtaggcagttacattgtcctgtcaaaacaaaaaagtataatattccaagtaaatatcaacagaatattaagtagtaaaagctatgcttttttcagggtaaagtttgagaaatttttctcattttgaaatattaaaatacatatccccttctactgttttaataaatatgcttagcagttcccaatttataatactgtagaacaaaatatacataaagtaattagtatagaattataattccaaggctaatgggaaagaaaaaagtaattttaagcatcctctgatcacacattttttaagaagaaaaggccggctgggcatggtggctcacacctgtaatcccagcactttgggagggtgaggcagacagattccttgagctcaggagttcaagaccagcctgggcaacatggcaaaacccatctctatcaaaaatacaaacaaacacagaaattagccaggcgtggtggtgaggacctgtggtcccagctactgagaaggctgaggtgggaggcttgtttgagcccaggaggtggaggctgcagtaagctgagatcatgccactgcactccagcctgggtgatatggtgagaccccgtctcaaaaaaaaaaaaaaggcaaatttgataattctgttcagaattctgctcatagttataaagttatgcagtaggcaggaactcaacagtttccaatacagacacttgcataaatagaatttgaataaataaaattatcatgaataaataaaaatatcatgatgggtgatttatctgtatttgccctgggcagagattaagtgaggccaaggaactgggacaatttgcatgcactgattgtctcatagtcaaaaagctatgtccggattgggaataaacaaactgagtcaatataaatctattatctatactagaaaaacaggtccaaagacaggatccattgatgcagaggttataaacggtcgttcaccagctaaacctaaccctggaagtatttcggtttgtcttggggactgcttactccagctgtttcacttttctatatcctctgcttggcttcctaagcatttgactgctaccctgtaatagcacaatattcatttataatgtttagtacatgaaacacacagaaatactattttattatttgtaacaatacaagcttcataaatgtgcactattgggtgtgcatgtatttatctgcctttctggctatcatctctctacttagacatccattcatcctctgtattttctttttgctacattgggagactatgcacctttctcatgtagtcattctttcactcatttattcattctccacttaactttgtatctagtaagtgcaaagtactagagatagaaaaatgaaaaaacatactctttgtcctcatggaacttatcaagtagggcagagagataagtggtccagtagtcataatgcagaatagggagttctatgctagatgcctgcaagataccaaaatcatgtggtggtggtgttgatggaagtgagatgggggtatgttacagaggaggtgaaacctgagctgaagcccgaggtatgacaagacagattaggctctgcatgacagcatgtgtgtatggggttgggggtggcaggtcagagtaaaatatgcagggggaggtagagaagagcatcctttaaacaccaatggcctgtgcaatggcatgggggtgtcagtgggtgagcagacagggctgagtttgggaaatgcaagttatttggtatgtggcagcaaatggagagcaaatggtagcatcttgggagatgagactggagagggagactgggctaccgtattataagtagaagagtgatccagttagattttagatctagaagtattaattagcagcagtgtaagggatgcaacagaggaattaggggttctacacccgagctcaggaagaaggctactgtaattaccaaggaaaatgattaggtttgctggagatgtaatggaaagaaaaaaggactcaagagagatctggagacagaattgataggattttgtcaataaagatcagagattggtaaagtctttttttttttttttgagacagggtctcactatgtcacccaggctggactgcagtggcacaaacacagctcattgcagcctcaaccccctggactcaagcgattcccctgcctcagtcccccaagtagctgggactacaggcagatgccaacctacctgtctaatttttgtatttcttgtagagatggggttttgccatcttgccctgggtggtctcaaactccagagctcaagaaatctgcccaccttggcctcccaaagtgctgggattacaggtgtgagccactgtgcccggccaagattgatgaatataatacctgacatgtgaactctgaagtatgtgtgagagatccaaatgtctggtacgcagttggttatttgtaactaaatctcaaaaattttggggggtcataaacatatacatggtaggtgaaggtatagatgtaaaagaggtcacccaaggtaaggaagtatttattaagtaggcaagaatggagctctaggaaaacaaatatgtaaggggtaggttaaaaaaaaaaaaagaagaagtagttaaagataaatgactagaaaggaaggaggacagaaaaagagtgtgttgtcctggaagccaaggaattaagggttttaaggaaggaatggttagcagagtcaagtgagagaagtttattcgagaaggaattgccctgggccaacaggttattactgatgggaagcagcttgtatacagaaatactgcatgtttcgaaaagtttgttcaggttaaataaagaatccccaaacaagttaagtaaacaagttttactggaaacattgggaaacattgtaccaagctatcttatttttaacttcaggcttaagatggaataattagatatcactgtacaatttgaattcttaatcatataggtaagctctagtttttaaaacttctcagtataatttatagcatacctttctgcatttgtagcacacataatatgcatatctattcattgcatagccagctgggtcattataaaacctcacaccaggagttgtgatagcttcactcttatgcagaccttcatattccaatctcattaaggcttttcttctgacatcctcatagagttcttttattggatcaagtaggtcttttagtactatgtgattaattttgttctgcaataaaaaatgaacactctttagcagaatcatttattaaccaactcaacaaacacttagcatgcacctaagtgccaagcattgtgctagaagataaccagacagcacacatattctaaataaaatgtcatttgaaaaacattctgtaaattctttagaagcccatatttttccaagagcagggaaaatggggcaaatgggacacagagcatgaaaattccattttattagctttatatttcctgcgtctgaaatatatctcctgttgccctagctattgtggaaacaaagttaccttgttgccacaaataagacacgctctgtgtttggtgtgtgtgtgtgtgtgtgtgtgtgtgtgtgtgtgtgtgtgtgtgtgtgtgtgtgtgtgttttgcttccttgaggggaaggcagaacgccaggtgacagaagtgaacaggtagtatttgctgtaaaactttcatgtatctattaatatttgtagcaccatatgataggggagagcaaaatactacaatctttttgattattcctcagtctatctagacaatgattgtgctaagtctttccacattctaccctttatattagtttgcaaatacgaagataagaaaatagggagagcttaatagaacaaaaaggggcgatgaattaatagggaaagtactgccacattcttcaaaaacagctttttgttaatcattattagcttgccaaaacaacttcctacttgctgactacctttgtacaaatgtgtcaaaatgccaagaactttctccttgttttaactaagctctaaaagaatctgttctagtggtactgagggttccaatttcactctttaatggcaggtatcagtttctacaaacaccagaggatcattcttctttttggtagccgttgtcatgttatgtcaactgagctctctagtggtctgagagtagagatgcatgccctttaatgcatcacgatgtttaaatgaactttctcatgtaatatgtttaacagaatgtaatcagttttaaatggacaattactgttttgagatgcattataacagagagattatattctcaggttccacatgaatgagaagggaagaaactgctaggggctggtgggtaaaaccaagagatactgacatatgtttattttgaaaggtgaaaagaaagaacaaaagaaaaagaaagtacatgatttcagattctttccataccttgcaaatgggacaagatataaatccaaatgttatccttgggccaagccatcgattttctaatactcgccgacagcactgtaagtggaatatgtgactacaatccagcttaaataaacaaaagaaaaggacataagcaaatataataatgataaacagttgagtgactgggagattatttaatgcaaggcactacttaaagcaggtaagagaaaaatcaagaaatttactataatgaaaattcattgggacactgaaattgggacattattatttactaaatttcattacagtaaattgggatactattaactaggcctttggcttctcctgctttttaacattcatgccacttatataaagtaagctaggttaggaaaaaaagtaaaattattcaattttgtatctcacagaaagaagaagaaattactgacttatgattttcttttggagactattattatcttggaatcatgagaactgaaaatataagcaatgggcaaaagttaaaaaaacctatttagtgcacagtaacttgtgtatgtatagaagtatgtatcattatgtatagatcaattatataatgttgtaaaaataccattctggattttggaaattaagaagagccttagctactgggggataatctaattatttccccctggcttctgaatattttatacattctgttgattacagaggttcacacaaatcacaaattaaagctgagcatgcaacatagaaagcacagcataaagaggcagaatttgctcctcattagcctggtacatgtatagattaaaagaacacttctgcctagtgatataaaaaaagatttcaatcaactgcttttttttttttttttttttttgagacagagtctcgctctgtcaccaggctgcagtgcagtggtgccatctcagatcactgcaagctccgtctcctggcttcatgccattctcctgactcagcctcctgagtagctgggactacaggcacccaccaccacgcccagctaatttttttgtatttttgtagtagagacggggtctcactgtgttagccaggatggtctcgatctcctgacctcgtgatccacctgcctcggcctcccaaagtgctgggattacaggcatgagccactgcgcccggcctcaatcaatgtttatttgacaaatatattccccatcttaatgtctggatacattcaatactttaaaagctgaggcaacctgaatggctggtgctgccgagagcgcttcggtgaaacatatcatgcacatgtcatcggcgtcttgcttcaggcttgtggcacttttgtcacagccgtgtagacagggcagacagtgctcttcgtttttaacacccccgcatggatggccacaaggatgcgtcttactacaggctatcttagcgtattcctgttaaagatgaattacaatgttacacaagtatgtaaaaaagcacacattctggtaattttccttattatataaatttccaaagattactttcccacaggaagtatctatgcaggccaagtaacaacaaagtaaagttatttctaatctttgtttgaatataaattaggcttcttaacaaagttttttttttttgatgcgatttttaaaaaatgccactctctataaagggaatgctgataagtgaattataatttcatatttgtcatcatgcacagctataaagcaaaaagttcctggctgggagtcgtggcttacacctgtaatcccagcactttgggaggctgaggtgggcagatcacgagatcaggagtttgagaccagcctgaccaatatggtgaaaccccatctctactaaaaatacaaaaattaaccaggcatggtggcgcgcgcctgtaatcccagctacttaggaagctgaggcaggagaatcgcttgaacccgggaggcggaggttgcagtgagccgagatcgtgccactgtactccagcctgggcgacacagccagactccgtctcaaaaaaataaaaaataaaaaaagttccccaatgtataatttcccagtcaccactctccgcatcaccaaaatgcagattttttttttttttaaaaaggtacctttgactctctgagcatatccacattcttattaattgagaaaccaaaaacatttggacaacatagaatatgtttatatatgttcaggattaaagaactcttagatgttgaaaatgtattttaaggaaataagtgaataatgtctgtaagagataaaggaaatacagttcataaatttttaactgtttctagtacaaaagtagatattaaatacatatgatcatggtaactgagaaacatacaaaaagagtgtggtttgggcttgagagccttatttgacccattcttcaactttggtaaggcatttgatgcttcacataggtaatacactcatttaggaagctggagtgacgctgagctaaaactcttttctgtatgaagtaaaggtgtcacaggggaacatggacaatgggatggcctgtgtcactatatactcacctggcaatctgcatcagaacaaacactgccaacagcagataactctgttccactcctggaaccacagaagcgacatgcttctgagctactcgtggtgggtttgcctaggttcaagcagaaaaataaaaatccttcttatggatgttttctagatatgttaacagaactaaattttaaaaagcaaactaggtttgtataagttgctatccttgggaaatcagcctgacagttttagaacggaaggtttctaagttgtcctaattataaagtaaataatgacacacaaaaaaagaaattaaagacctatctgaagccaaatacactctcgactaatattttttttcagtgaaagaaacagactagacttctagtcaagttaccagactgagcagctgttacaagcccctgactccaaatgcacaataccataaaaaatatgataaccaaaaattaaataaaaatacacagaagttagggaaatctttaactatatataacaaaattataaggcatggtataaagcctatcatcagagtatgaaacttgaaaaacagaattcctacctcaggaactctgcaatttgaaaaggaatttaaatatgtttgaaatacttaaagaagaaacagaatcaataaaacaagaacagagcaataagaaaaagaacgtgaagatttgaaaattacagaccaagctgatttttaaacacagatataaaaatctaactataattaatatcaatatattgaattcagcaatatttacagaaaaatctatttaaaaaggatggtttacaaggatggtttgacattagaacatttattaatgcagtatacagcactgacagattataggaggaagaaatcaactatgagaaaagaaggtcatgctcttgcagcatgcaaagtcaccctagaattaaattgattcggatttacacctaactccaacactggaagttcgtgtcagtcaaatggcagactgcagatgtgctgaaaactgagaatttgtaagattcaacataactttgaactaggaatatacaagatttactttagaaaagcagcaaaatgaaaactatgttttagagataaaaatacatttaacatacataggttaccttttgttttatgtctattcatttttgttaattattttattgctatcaatggaaacagtaccattcacaacaccttcagaagcattaggtctacaaaaacctctaaatatcataaaatcatacaaccttataataaatagagatcttagtgatcatctagtgcagcaatttttattgtggggcaacaactagcagaactagaagggaattatcaatagaaatgtattttatctatggagccccattagttgtgatcctctcactttataaatgaagtcaatgagttccagaggttaagtgacttgctcgacaccacacagctagttagtggcaaatcaggtttcttgacttttggtctaatgctctcttcaccatagaacactctatatatttagtaaatatatagatcaatgatgtcataattaaacatcagaatatcactcaaaattattcacagtttaatcagttggcacggtttaatctttttttgtgggttttaaaggcatggctcaatctttaaaccttttacctgtgtgttctcggaattccaccattgccttcattgttttagaatctgccagtgccatcaaccagaacaatttggttctaccacaaccttcatgaaggtcaacctttatagcttcttcttcttctttgaagacctattatttcattaaagaacagggaaaaatatgcttatttatcactctgaaagggagagtataaaatttaattattcaataataataatggctttcatttaagcactctaagaagttttgaatatttccaatcttctctttaatcttcacagcagtcccttttttataaatggagaaattaagtgtttctaaggataaaacaacttgctatttatagatggtaagcgagacagctgtgaactcaaccaaggtctttgattccaaagtccactttttccccctactacacaaagcctctttcacacatttatttcaaaattcactgaacatattttatgctccagagacaaaaatcttcacctgtctttgatgagttttggttcttcgatgaaggtgaaggaatctgtcacagtctgtacataaatttccacagacattgcataaaatgattgctgcagtttcaccatcatcatggttatcacacataggctaaaataagacatttccacgttacttagattaacaagcaagtctcagactctcatacaaattgaatataatttatttacaaaaataaaccgttattcggaagtctattaagaatttagaatctgaatattaaacagaattattgcaaatgtacttaactataaaaatctctcaaaactccaaatccaatcattaatgtgctttgcaggttcaatgattaatacaatgaacaggtatactttgttacttagagacttaagaaatgtctgccccattatatatctaaacattctgtatgccaaaggaagaaactgtttatttttgaaacttgaacattaataagaaaatggtgaaagggcctatataaagttttcctttctagtgaacttaaagatacccatcaaacctacttaagtatatatgtgaacaggtggtgtgtcatgttgcctgtgttattgctttatttccttcctaccataagactgattacattttagtaaaatatctagtcactaaatcagactctggctaaaaataaattttgatatgatgcaaacatgactcagagaagaagaaagctctttaatatacttaaataaaagcccctaaagtttccatatactatgaagtagggactctctgaaatagacttgtgagatgaacttggccgaagggacacaatctttcaagagatccactaactgtttatgttgatgtgttttttgtttgtttgtttgtttttaagctaagctaaagcttactgtaaaggaaagcaagataaattcttacaaaattctgatcttaccatttgtttttgttgtccatcctttcccatccatctccccgaggagagacgatctacgtggtcctgatcaagaacacatagggatgcgagagcaagccagagctgttgaaagggaaggctgttacaccactgaatttttaggaaagacttatgaaatgctgactgtgacacatcacaacagctcaataaatgctggctgattttgaaaatacatagatactcagtggcactcaagtcttcctgatgtggtagcaggcatacacgatcactgtcctatgtgccatgcacacaggaggcactcagatatctactgaacaagtgactgtttctctgatgaaccaccctgtcttctatctgacaaataaaattatcctttattggtctactatgtaaacaacatatgaataaatgaattggcatatttaatatttactactaatgtcttctgaatatttttccatttagtatcattaaatgccaaagaaggtggtacagcaactgctaaattgtgtacagtcccatgagtagtcaggtacacattaaatccttctagataataaaagttcctcagaagtctttgttgccccttgttgccccagaaagcctaatactatacttggtgcactttgtcagaaatacatacatgtctaaaagctttagaaaactgttctccaaaatagggccgggcacagtggcacatgcctgtaatcccagcactttgggaggccaaggtgggtggatcacctgaggtcagggggttatgaccagcctgactaacatggtgaaacccagtctttactaaatacaaaaaaaattagccaggtgtggtggtatatgcctgtaatccgagctacttgggaggctgagacaggagaatcgcttgtacctgcaggcggaggctgcagtgagccaagatcgtaccattgcactccagcctgggcatcaagagtgaaactctgtctcaaaaaaaaaaaaaaaaaaaaaaagacaactgttttcagaaatagttaaaaatttctgaggcttaaagggtaagcttcagttttatatagaatgatatatcccctcattaatgaagaatagaaaatgacttaactagctcaactctaagaagtgcatgtgagtgttattggatacagaaagcaagagatgttaaaatagggacagaaaaatagaaaaagaaataatgcatgcaaggaggaaggggaatgcagactgaaagaaagcaacacatgagtggtaggaaaggattactgtcaaaaatacctatttcaggtgtcacagtcaataatagcaagatagcataaattgactttttccgccctagggatatatagtttatcttcttcagatttctgaggattaacctaagcaatttttaccagcattcacttcttcctaacgttgtcagactgccctccttcaaggaaatctcaaatctcttctggaagtatatgggacatgaaatctagcaggttaaaacttactataaatgtgtcatctgaagaatgcaatctcatttcctcaaagatttccaccctgaccctgccctggacaagcacttcttgctttttagaagtaagacctataaatcctgtaagtaagttacagggctctacattaggaacaaccaggcataggcaggggtcttgtctccaaaggaccttcggtctatcacagcataatgctggcactaaacttactgtggtaaactacagcaaacagatcattagaaagacaacacgcaaacaatgtacaatgtaattagccttttctaaccagtgtacccttggcttcctaaacaataacaaaaacaagtgacacagaacacataacagtgagaagtaacgactagttcataatataaaagccctttatactttttcaataaatacggtatttggttaaaaaataattatgttgacttagtgattaaaatttgtttaaatctattactaaaaaagaacacgcaatgatacacaccaaatttaaaacaaaacaaaacaaagcaaaacctactctagttgttgcaatacatctcactggagacctaaattcttcttccatcttggtcaaggcaatgatggtttctgcaatagcattttttgtcactcgggaccaagcttctgacagatgaccctattgagcagaacagagtattttaataagtgaccagaaatgtattaccatagtaaactcttttttcttaaataacatctcctatcaaaggaaatatttgtttttagtgagaccatggaattttagattatgggcacaaacttttgaactaaaatttcttcgtgatcctatggaaaattcaacttctaatcatcattttgatatttaaaaataaataaataaaaaattaagttctcaatactcttttcctggaaatcaagggcaattactctcacatctgataaaaacataacagaaatactaaggttatctatgtttgagaagtttgtcacttagcataaaatttacacagtgaagctaactgctttagatgagtattacaggaacctaaaatataaacaggttcaaactgcaactacctttatttgctaccttgatttgtaatgaacaaacatttaactatcatataatttaggtgttcctaaatattactcctaaatattttaattcaatgaacaccctgagaaagtctgtttgccacagaggttgagaaaatatccacgctgttgggaaaagtgatagaacttcatctttcccccagaaaatcctcccacttctcatatccacatgatttaaggggcagttcaattcctcctccttctccaagctgccttctattccttctgactctacattccatactatcttgtccttctcaggctgccctcctagaaataatacaatgtgtggaaaatgacaaggagcaactaatcagagccaggcattctgtaaagtaactccctgtcctccacactcccagatctcctttggaagccaccatcttaagacagagggtatatgacattaataaagaagaataaagggtttaaaaaccatgaggactgaggagaatgagaaacttccactttcgagagctctcttcctctttttttcctttaggttttttgaatcaagttctttcttagggtctgaaagagcatattttattttattagattttaaagtcacgtaacaattcccacacaaattaactggaaaatttgaaatgaacatggtttacataaatgacaaattatcactcactgaaaagacaaacagcatgatagttaacatactacaaatagtctttaagtaaagttacactaatctacatctcctatcaattcagcagagtaagctgttttgtgtcagcttcctgccgcacttcactgccaaaacagaagaatgggaacttactgctgccatatccttgataagtttaatgatgatctctgagatctgggtaggggttgagcccttcatccaccaatgactttcacctcgtcggagataactacaagaaaaattagcacttaaaaagccaataaattatcagtagtagtaacaaatgaaaaagatgaaaatgttatttcagaatgcagcattttagatttttaagtgactgaatcaattaaaacatttaaaaagaaaattcatcaaaccattaccccaaatcccaagacagcagttaaggttatttgagttccctttcaagtatttctctgtttgcacattatttctgtgtgcatcttttagaagtacagtccagggaccacacacgacttatttctagggcacatgcggataatgtggagcttaaccggaatataaattcactgtatcactaagcacactactatttagttcagctgacttttttcctagcaagactacaggaaagaagtgatacaatgattaacattctgatgttatctgcatattgtcatggattggctctacaagtagcactgttcagatgtctctaattctctactgttacacacaattacagaacatccttgcatatataccttggtgcaaatgcatgaaagttttagaagtagaattggtaggtcaaaagatatgcatatttaaaatatagttagatattataaacagatatccaaaaaggctgcagcaatttatatgagatgaaaatgcctatttcctcataatgttgccaaagcatcaaagatattttgcaattattttaatctacatttctctgattagtagtgaggtgttttcatttgtttactggcatttataagtttttttctgtgaactgactactggcatttataagtttttttctgtgaactgactgttcttgtcatttattattcttatcagttgtttgcctttttaaaattgatttgtagtcatacttctatattatgctaacaagtcattgtctattatataggtttaagtatttttctaagttatttccctatattttaaaacatttaaatattatcacctatcaagtaattttcatttttatatagtcaaatctataaatatcttcctatatgattttgggttctgtgttttgtttaagaaggtcttatcaaattgaagattacaaaaatattcttctataatttgtcccagtacagttttaaaaagaaatgtacataaagctttagttgacctgaactttactttattcccccatatttatttctttttattgtggcaaaaaaacatattacctaaaactgaagtttaattttgtatatggtgagaggtaggtatctagaattttttttaacatggatatccaaatattctgacatcacatattcagcctactttctattccccactaattataaatgacacttttattatatacatgacctttttagatattagccagttgtttatggattttatttggtgagtaacctaacaaggtaaaatctgaaattatgtcttaaatttctgaacagtagctcactctattctgttttggtactaaaatagaggcaataactaacctggaattgaaaatcatcggaagagtaactgttgtaactcctttgcccacagtggtaccagctgttccagtgatggtggttcctttggcttttagctgtacagtgagtgctttggcaatgcatcctagaaacatgtccaagatacccagcttattccagtctcctttctctgttgagtgaatgatatcactgatatctgctggggggagggatttcactcctatgatgctggccagacgactaggggttacttcaggcaaaactcttcttagtaaagaggttacctggtaagaaaaataaaatgagagaattccatgtaaagactaatgttttaaggtttcttttatttctcttttctttttttaaagacagggtcttgctttgttgcccaggttggagtgcagtggagcaaccacagctcactgcagccttgaactcctaggctcaagggatcctcccagctttgcctcccaaagtgctgggattacaggcataagtcactgtaccccatcccaggcttcattttttaatgtacctaactaccattctgtaacttcaaaatctttaagaaaagaaatatgatttaaacactattttacattttgtgaaggaagaaaatatgatatacatactattcaaatggtaatagtagtggtaattactaacccaaggcagcacgaaaaaaaataccttttctttctggtcagggctaaatgacattatatatttcatggtaatatggtaatcagtagccagaatactctcttatcacaacacattaataaaatggaacatattttactattctatactctcactataaacagtaaaaaagggagtaaaatacaggccccaaacaaaatataacaaaatacgaaataaaaatctatacttagggtccttagataattctctttgcattgcaacttttaacaatgtttcaagtaacaaaagcaatggaaaggctgtagtgtgatcagtcacctgtctctggactctaggagaggctgtgtgaagcagcgagaagagatcctgaagcagggttagctgttgagccagatattgccggccaacgttagagccactcagtgctaaaaccatagagagcagctcaaagcagtaggcatcagaggaggcatcttcatcatttggctgagaattggcattttctttgcttgatatagcatgttcccattcttcacggactctggtagcttccatgcgaatagcttggacaatatgagcacacacctatttaaagttaacacagaacatgtaaaaatatagggttagtttgatttactactcctagcaaaacaagcaaacaaaagaataagacaagaatgtaaattgatactcaatttaatactattctcccagttaattctccatcatatgtcattctcttaactcatctaagaaacaagtaaagctaagggagccacaataaaaatggaaatatttaaatcaactactatgtgcaaactgattatatgcaagttattaatgcctatgcttacagtttagcacgtcaaaaaccaatcaccatattttatcactgaaggcactttttctcatggtttaccattatgttcataaggtgctttatagctgataagattcacaatactgaaattatacatgacattttacaattgaaagcatctaagattcaatgaaacactgctagaaagataaagcaaaaataaattcatgttgtagttcattgaaaagaataatagtgtagaaagttagaatagggctgggtgccgtggctcacgcctgtaatcccagcaatttgggaggccgaggcgggcggatcatgagatcaggagatcgagaccatcctggctaatatggtgaaatcccgtctctactaaaaatacaaaaaaattacacctgtaatcccagcagtttgggaggccgaggcaggtggatcatgaggtcaggagatcgagaccattctggctaacacggtgaaaccccgtctctactaaaaatacaaaaatattatgcctgtaatcccagcactttgggaggccgaggcgggtggatcacgaggtcaggagatcgagaccatcctggctaacacggtgaaaccccgtctgtactaaaaaaaaaaaaaaaaaaaaaaaaaattagccagccgtggtggcaggcatctgtagtcccagctactcaggaggctgaggcaggagaatggtgtgaacccaggaggcggagcttgcagtgggccgagatcgcaccactgcactccagcctgggcaacagagcgagactccctctcgaaaaaaaaaaaagttagaataataggttaatttaaaatcaatattttatttgacttttgaagtgatatttttatgttatgtagcaccccattatatgaacaatatagcgctatttcctcacctggttatatttaaaaatattaacactggtatagttaacactgttaattgctcagccaacacacagaagaatgggggaaaagaaatatgggaaatgcaaatcaaatctgatatagctgggtatttgacaccaaataaaaaatctacccataacaaatagcagcaaggtaagcaagttttcataagtaaaatctttaaaatgatgaaggtatgccaaaatactcattcctctctaaaaaatggcaggcacattctgcaggacctataaaagggcgagcataaaaaagccttcataaatttttcaaaatactttataccaagctcatccaacctgcagccgggggactgcctgtggcccaggatggctttgaatgtggcccaacacaaattcataaactttcttaaagtattaggagatttttttttcttgcaattttttttttagttcatcagctattgttagccttagtgtattttatgtgtagcctaagacaattctttttcttcaaatatggcccagggaagccaaaagattggacatccctgctttataccctaataacaaacaaacagacaaacaaacaaacacacacacacacacacacaaaactaatgaagacaatgaaatagctgttaaccaacctgtttttgtaagttagtcagcttactcctgctgaatatgattccaaccatatgttctttcaggtcagcatctgatgttgccttt

SEQ ID NO: 10407 - DNA, 6103 bp, Homo sapiens
tgatgagttttggttcttcgatgaaggtgaaggaatctgtcacagtctgtacataaatttccacagacattgcataaaatgattgctgcagtttcaccatcatcatggttatcacacataggctaaaataagacatttccacgttacttagattaacaagcaagtctcagactctcatacaaattgaatataatttatttacaaaaataaaccgttattcggaagtctattaagaatttagaatctgaatattaaacagaattattgcaaatgtacttaactataaaaatctctcaaaactccaaatccaatcattaatgtgctttgcaggttcaatgattaatacaatgaacaggtatactttgttacttagagacttaagaaatgtctgccccattatatatctaaacattctgtatgccaaaggaagaaactgtttatttttgaaacttgaacattaataagaaaatggtgaaagggcctatataaagttttcctttctagtgaacttaaagatacccatcaaacctacttaagtatatatgtgaacaggtggtgtgtcatgttgcctgtgttattgctttatttccttcctaccataagactgattacattttagtaaaatatctagtcactaaatcagactctggctaaaaataaattttgatatgatgcaaacatgactcagagaagaagaaagctctttaatatacttaaataaaagcccctaaagtttccatatactatgaagtagggactctctgaaatagacttgtgagatgaacttggccgaagggacacaatctttcaagagatccactaactgtttatgttgatgtgttttttgtttgtttgtttgtttttaagctaagctaaagcttactgtaaaggaaagcaagataaattcttacaaaattctgatcttaccatttgtttttgttgtccatcctttcccatccatctccccgaggagagacgatctacgtggtcctgatcaagaacacatagggatgcgagagcaagccagagctgttgaaagggaaggctgttacaccactgaatttttaggaaagacttatgaaatgctgactgtgacacatcacaacagctcaataaatgctggctgattttgaaaatacatagatactcagtggcactcaagtcttcctgatgtggtagcaggcatacacgatcactgtcctatgtgccatgcacacaggaggcactcagatatctactgaacaagtgactgtttctctgatgaaccaccctgtcttctatctgacaaataaaattatcctttattggtctactatgtaaacaacatatgaataaatgaattggcatatttaatatttactactaatgtcttctgaatatttttccatttagtatcattaaatgccaaagaaggtggtacagcaactgctaaattgtgtacagtcccatgagtagtcaggtacacattaaatccttctagataataaaagttcctcagaagtctttgttgccccttgttgccccagaaagcctaatactatacttggtgcactttgtcagaaatacatacatgtctaaaagctttagaaaactgttctccaaaatagggccgggcacagtggcacatgcctgtaatcccagcactttgggaggccaaggtgggtggatcacctgaggtcagggggttatgaccagcctgactaacatggtgaaacccagtctttactaaatacaaaaaaaattagccaggtgtggtggtatatgcctgtaatccgagctacttgggaggctgagacaggagaatcgcttgtacctgcaggcggaggctgcagtgagccaagatcgtaccattgcactccagcctgggcatcaagagtgaaactctgtctcaaaaaaaaaaaaaaaaaaaaaagacaactgttttcagaaatagttaaaaatttctgaggcttaaagggtaagcttcagttttatatagaatgatatatcccctcattaatgaagaatagaaaatgacttaactagctcaactctaagaagtgcatgtgagtgttattggatacagaaagcaagagatgttaaaatagggacagaaaaatagaaaaagaaataatgcatgcaaggaggaaggggaatgcagactgaaagaaagcaacacatgagtggtaggaaaggattactgtcaaaaatacctatttcaggtgtcacagtcaataatagcaagatagcataaattgactttttccgccctagggatatatagtttatcttcttcagatttctgaggattaacctaagcaatttttaccagcattcacttcttcctaacgttgtcagactgccctccttcaaggaaatctcaaatctcttctggaagtatatgggacatgaaatctagcaggttaaaacttactataaatgtgtcatctgaagaatgcaatctcatttcctcaaagatttccaccctgaccctgccctggacaagcacttcttgctttttagaagtaagacctataaatcctgtaagtaagttacagggctctacattaggaacaaccaggcataggcaggggtcttgtctccaaaggaccttcggtctatcacagcataatgctggcactaaacttactgtggtaaactacagcaaacagatcattagaaagacaacacgcaaacaatgtacaatgtaattagccttttctaaccagtgtacccttggcttcctaaacaataacaaaaacaagtgacacagaacacataacagtgagaagtaacgactagttcataatataaaagccctttatactttttcaataaatacggtatttggttaaaaaataattatgttgacttagtgattaaaatttgtttaaatctattactaaaaaagaacacgcaatgatacacaccaaatttaaaacaaaacaaaacaaagcaaaacctactctagttgttgcaatacatctcactggagacctaaattcttcttccatcttggtcaaggcaatgatggtttctgcaatagcattttttgtcactcgggaccaagcttctgacagatgaccctattgagcagaacagagtattttaataagtgaccagaaatgtattaccatagtaaactcttttttcttaaataacatctcctatcaaaggaaatatttgtttttagtgagaccatggaattttagattatgggcacaaacttttgaactaaaatttcttcgtgatcctatggaaaattcaacttctaatcatcattttgatatttaaaaataaataaataaaaaattaagttctcaatactcttttcctggaaatcaagggcaattactctcacatctgataaaaacataacagaaatactaaggttatctatgtttgagaagtttgtcacttagcataaaatttacacagtgaagctaactgctttagatgagtattacaggaacctaaaatataaacaggttcaaactgcaactacctttatttgctaccttgatttgtaatgaacaaacatttaactatcatataatttaggtgttcctaaatattactcctaaatattttaattcaatgaacaccctgagaaagtctgtttgccacagaggttgagaaaatatccacgctgttgggaaaagtgatagaacttcatctttcccccagaaaatcctcccacttctcatatccacatgatttaaggggcagttcaattcctcctccttctccaagctgccttctattccttctgactctacattccatactatcttgtccttctcaggctgccctcctagaaataatacaatgtgtggaaaatgacaaggagcaactaatcagagccaggcattctgtaaagtaactccctgtcctccacactcccagatctcctttggaagccaccatcttaagacagagggtatatgacattaataaagaagaataaagggtttaaaaaccatgaggactgaggagaatgagaaacttccactttcgagagctctcttcctctttttttcctttaggttttttgaatcaagttctttcttagggtctgaaagagcatattttattttattagattttaaagtcacgtaacaattcccacacaaattaactggaaaatttgaaatgaacatggtttacataaatgacaaattatcactcactgaaaagacaaacagcatgatagttaacatactacaaatagtctttaagtaaagttacactaatctacatctcctatcaattcagcagagtaagctgttttgtgtcagcttcctgccgcacttcactgccaaaacagaagaatgggaacttactgctgccatatccttgataagtttaatgatgatctctgagatctgggtaggggttgagcccttcatccaccaatgactttcacctcgtcggagataactacaagaaaaattagcacttaaaaagccaataaattatcagtagtagtaacaaatgaaaaagatgaaaatgttatttcagaatgcagcattttagatttttaagtgactgaatcaattaaaacatttaaaaagaaaattcatcaaaccattaccccaaatcccaagacagcagttaaggttatttgagttccctttcaagtatttctctgtttgcacattatttctgtgtgcatcttttagaagtacagtccagggaccacacacgacttatttctagggcacatgcggataatgtggagcttaaccggaatataaattcactgtatcactaagcacactactatttagttcagctgacttttttcctagcaagactacaggaaagaagtgatacaatgattaacattctgatgttatctgcatattgtcatggattggctctacaagtagcactgttcagatgtctctaattctctactgttacacacaattacagaacatccttgcatatataccttggtgcaaatgcatgaaagttttagaagtagaattggtaggtcaaaagatatgcatatttaaaatatagttagatattataaacagatatccaaaaaggctgcagcaatttatatgagatgaaaatgcctatttcctcataatgttgccaaagcatcaaagatattttgcaattattttaatctacatttctctgattagtagtgaggtgttttcatttgtttactggcatttataagtttttttctgtgaactgactactggcatttataagtttttttctgtgaactgactgttcttgtcatttattattcttatcagttgtttgcctttttaaaattgatttgtagtcatacttctatattatgctaacaagtcattgtctattatataggtttaagtatttttctaagttatttccctatattttaaaacatttaaatattatcacctatcaagtaattttcatttttatatagtcaaatctataaatatcttcctatatgattttgggttctgtgttttgtttaagaaggtcttatcaaattgaagattacaaaaatattcttctataatttgtcccagtacagttttaaaaagaaatgtacataaagctttagttgacctgaactttactttattcccccatatttatttctttttattgtggcaaaaaaacatattacctaaaactgaagtttaattttgtatatggtgagaggtaggtatctagaattttttttaacatggatatccaaatattctgacatcacatattcagcctactttctattccccactaattataaatgacacttttattatatacatgacctttttagatattagccagttgtttatggattttatttggtgagtaacctaacaaggtaaaatctgaaattatgtcttaaatttctgaacagtagctcactctattctgttttggtactaaaatagaggcaataactaacctggaattgaaaatcatcggaagagtaactgttgtaactcctttgcccacagtggtaccagctgttccagtgatggtggttcctttggcttttagctgtacagtgagtgctttggcaatgcatcctagaaacatgtccaagatacccagcttattccagtctcctttctctgttgagtgaatgatatcactg

SEQ ID NO: 10408 - DNA, 773 bp, Homo sapiens
catgagtggtaggaaaggattactgtcaaaaatacctatttcaggtgtcacagtcaataatagcaagatagcataaattgactttttccgccctagggatatatagtttatcttcttcagatttctgaggattaaccgaagcaatttttaccagcattcacttcttcctaacgttgtcagactgccctccttcaaggaaatctcaaatctcttctggaagtatatgggacatgaaatctagcaggttaaaacttactataaatgtgtcatctgaagaatgcaatctcatttcctcaaagatttccaccctgaccctgccctggacaagcacttcttgctttttagaagtaagacctataaatcctgtaagtaagttacagggctctacattaggaacaaccaggcataggcaggggtcttgtctccaaaggaccttcggtctatcacagcataatgctggcactaaacttactgtggtaaactacagcaaacagatcattagaaagacaacacgcaaacaatgtacaatgtaattagccttttctaaccagtgtacccttggcttcctaaacaataacaaaaacaagtgacacagaacacataacagtgagaagtaacgactagttcataatataaaagccctttatactttttcaataaatacggtatttggttaaaaaataattatgttgacttagtgattaaaatttgtttaaatctattactaaaaaagaacacgcaatgatacacaccaaatttaaaacaaaacaaaa

SEQ ID NO: 10409 - DNA, 86 bp, Homo sapiens
gctccttgggaggctgaggcaggagaatcgcttgaacctgggaggtggaggttgcagtgagccaagatggtgccactgcactccag

SEQ ID NO: 10410 - DNA, 303 bp, Homo sapiens
cagtggctcacgcctgtaatcccagcactttgggaggccgaggtgggtggatcacgaggtcaggagatcgagaccatcctggctaacgtggtgaaaccccatctctactaaaaaaaatacaaaaaattagctgggcatggtggcgggcgcctgtactcccagctacttgggaggctgaggcaggagaatggcgtgaacccaggagtcagagcttgcagtgagccgagattgcaccactgcactccagcctgggcgacagggcaagactccatttcaaaaaaaaagaaaaaaaaaaaaaaaaag

SEQ ID NO: 10411 - DNA, 555 bp, Homo sapiens
gcttctgacagatgaccctatgagcagaacagagtattttaataagtgaccagaaatgtattaccatagtaaactcttttttcttaaataacatctcctatcaaaggaaatatttgtttttagtgagaccatggaattttagattatgggcacaaacttttgaactaaaatttcttcgtgatcctatggaaaattcaacttctaatcatcattttgatatttaaaaataaataaataaaaaattaagttctcaatactcttttcctggaaatcaagggcaattactctcacatctgataaaaacataacagaaatactaaggttatctatgtttgagaagtttgtcacttagcataaaatttacacagtgaagctaactgctttagatgagtattacaggaacctaaaatataaacaggttcaaactgcaactacctttatttgctaccttgatttgtaatgaacaaacatttaactatcatataatttaggtgttcctaaatattactcctaaatattttaattcaatgaacaccctgagaaagtctgtttgcc

SEQ ID NO: 10412 - DNA, 1275 bp, Homo sapiens
tttacattgactggtttatgaatgttaaaccagccatgcatttttgggataaggcacatttgctcagatatattctttttcttatcttccccagtttctctcattccccataatgctccagaatttctaattgccaaaatgccctttaaatacttgttcatgggttttatctctcacattctctccgctccttcttcagaaactcttcacctgtttcacttacctagtaaagagtctgaagcagatgactgattttacatttttctgggaaattcaagcagttcattgaagattatcttttggcattaagaaaatgcaatcaaggtcaggcgtggtggctcacgcctgtaatcccagcactttgggaggccgaggcgggtggatctcctgaggtcgggagttcgagaccagcctggaccaacatggagaagccccatctctactaaaaatacaaaattagtcaggcgtggtggtgcatgcctgtaatcctacctacttgggaggatgaggcaggagaatcacttgaacccgggaggcggaggttgcagtgagccaagatcatgccactgcactgcagcctagataacaagagggaaactccatctcaaaaaaaaaaaaaaaaaaagaaattgcaatcaagtgtcacttaatgatggggatacattctgagaaatgtgtcgttaggtgatttcttctgatgggaacatcgtagaacatacttacacaaatctagatggtataacctactgcacacctatcctatatggtataacctagtgctcctaggctacaaacctgcacagcatgttatgtactgaatactgtaggcaattataacactatggcaagtatttgtgtatctaaacctatttaaatatagcaaaggtactaccgtagtaaacttttatgggaccaccatcataaacagagttcatcattgacctaaatgtcattatgcagcagatgactttattcaatttatatttaaagagaaccacagttctgatatgttagacattagtaatgccattcaaaaacttgagtcaaaaactacataaatatttctgaaaatttaaaaaatgtaaatgtatattacaaaaagccaaaagaagtagtaaaaagccaaaaaagagtaatatcaatttcatttaaaaataaactgaggtggctgggcacggtggctcacacctgtaatcccagcactttgggaggccaaggtgggcggatcgtgaggtcaagagatcgagaccatcttggccaacatagtgaaacccc

SEQ ID NO: 10413 - DNA, 102 bp, Homo sapiens
acctgtagtcccagctacttgggaggctgaggcaggagaatctcttgaacccaggaggcggaggttgcagtaagccgagattgcaccactgcactccagcct

SEQ ID NO: 10414 - DNA, 3557 bp, Homo sapiens
tttttaattttttaatttttttattttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtatgttctcattgttcaattcccacctataagtgagaacatgcagtgtttggttttttgtccttgcgatagtttactgagaatgatgatttccaatttcatccatgtccctacaaagaacatgaactcatcattttttatggctgcatagtattccatggtgtatatgtgccacattttcttaatccagtctatcatcgttggacatttgggttggttccaagtctttgctattgtgaatagtgctgcaataaacatacatgtgcatgtgtctttataacagcatgatttatagtcctttgggtatatacccagtaacgggatagctgggtcaaatggtatttctagttctagatccctgaggaatcaccacactgacttctacaatggttgaactagtttacagtcccaccaacagtgttaaagtgttcctatttctccacatcctctccagcacctgttgtttcctgactttttaatgattgccattctaactggtgtgagatggtatctcattgtggttttgatttgcatttctctgatggccagtgatgatgagcattttctcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtattttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttgataccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattatgtgaagaaagtcattggtagcttgatggggatggcattgaatctataaattaccttgggtagtatggccattttcacgatattgattctttctacccatgagcatggaatgttcttccatttcttggtatcctcttttatttcattgagcagtggtttgtaattctccttgaagaggtccttcacatcccttgtaagttggattcctaggtattttattctctttgaagcaattgtgaatgggagttcactcatgatttggctctctgtttgtctgttatcgttgtataagaatgcttgtgatatttgtacattgattttgtatcctgagactttgctgaagttgcttatcagcttaaggagattttgggctgagacaatggggtttcctagatatacaatcatgtcatctgcaaacagggacaatttgacttcctcttttcctaattgaataccctttatttccttctcctgcctaattgccctggccagaacttccaatactatgttgaataggagtggtgagagagggcatccctgtcttgtgccagttttccaagggaatgcttccagtttttgcccattcagtatgatattggctgtgggtttgtcatagatagctcttattattttgagatacgtcccatcaatacctaatttattgagagtttttagcatgaagggttgttgaattttgtgaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcggtttgccagtattttattgaggattttcgcatcaatgttcatcaaggatattggtctaaaattctcttttttggctgtgtctctgcctggctttggtatgaggatgatgctggcctcataaaatgagttagggaggattccctctttttctattgtttggaatagtttcagaaggaatggtaccagttcctccttgtacctctggtagaattcggctgtgaatccatctggtcctggagtttttttggttggtaagctattgattattgccacagtttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgcttgctcttgcttttctagttcttttaattgtgatgttagggtgtcaattttggatctttccttctttctcttgtgggcatttagtgctataaatttccctctacacactgctttgaatgtgtcccagagattctggtatgttgtgtctttgttctcgccagtttcaaagaacgtctttatttctgccttcatttcgttatgtacccagtagtcattcaggagtaggttgttcagtttccatgtagttgagcggttttgagtgagtttcttaatcctgagttctagtttgattgcactgtggactgagagacagtttattataatttctgttcttttacatttgctgaggagagctttacttccaactatgtggtcaattttggaataggtgtggtgtggtgctgaaaaaagtgtatattctgttgacttggggtggagagttctgtagatgtctattaggtccgcttggtgcagagctg

SEQ ID NO: 10415 - DNA, 2317 bp, Homo sapiens
cactatcaaataaaaatagggcatttcttatggtagatgggagtaagaaatatcatcttctgtttttaaaaaatgtaactatataaatgttaagaaagaaatctattgaataaaagttggagaaaaaagaggatggttgattttaaactctactgacttggttgacttttacttgatatgtgctatctgaaaaaatggacaatggccactccctcatttctttttttcttccttttattgaattttaacagcagttttgtctggctcttttcatttctgtgtttatttcctgtaaaattgtgatgcataatcagagtaagtttttgtttgtgtatgatttgccatgaaaagtcactgtgtatctgaagccaaaattacacttagtatttcatgcggttttggctgatttcctttctattttcttcattaagcaagtgccatcaaggccagcagtacccatattatatgtccagagaagagccaggccagatgggaactgcgtgaaagcaaccagttatcttgctaattatgccagctagaaccagttgtattgcattaaaaaatgtggaatccaacaacttagctgttcacactcaattagcagtgtgctggagaatggaaaactcaagcaaggagtccatgtgctccaggaagtgacagctgcttccttacccagcatttaatatccatgtaaaattttttcaataaacgttgtgataatttttgcaagaatcatgtatatgttatgtctctaattcatctcataatttaaaaaaaacataaagttcagtggtctatctccactttataacctttctttagcccacatgaagaataaagtgcaaaagtaagccacaaattcttgacatgttttcaaaaagaagaaatcagtagagaaaggagaaaaaatcaggaagacaacaattagcgtatttatcataaatgaaggaaataaaacatcgagactaaaagaagactcaagtgtttcatttgtacatcttctgagataaaaatagctggaaacggcaactcacttcactggcatttttcgttccactgtctgtcacagatgatgccgagtttctctttctgactgatcttcaagctgaaggtaatgtgacagcaggaacattacaattagtatgcgaatacctatcccctgggttacaaattggcattctttaaattctgctattctcagcttttttatttttgttattaacttttcattggtcaaaacacttaaacttctaagtaataaataactctttgaataaatgtgacatttctctgagtctgtggcataattgaaataaattccatctgaaagttttttctgaagttcatattcatctgtttgcaagacaactattgttcacaggaggttaaaccaatatataatgatatacatattataaatatacatatttataattaatattcacctttaagtctttaatctgcctaagagatcattttgttttcctttgttctttgattttcagagaatctgaggagggctctacctttagtatacttatcttaaacaactatatatgtttaactatttaagcaattttattcatgaactaaaatgttctaatataagacattgcagttttctttgaaatttatgcagtttttattgcttaataacatacatttctctcttttaaccatggatctcaagtcattttatgccaatatttctttatgcaatatgatgtttaatgtaataaggctaatatatttatcaaaacaaagaccatatattggcaattttaattatagttaaagttttataacttcatgctttgtcaagcttttatctcaatgtaatacagttctttggtagtaaaattcaactggtatgtgtttatgaccctcaatgtcaattaaaaactcttgaaagattgacaatttttcaggtgggagaaagaaagcagtcaaaagaaggtaaaaaatgttcttctccttgacttaccgtggaaatgccctagttgatctatagaaatggttagtatcagtggccctggactaatgaaactgagagaagtagaagaaatgacctaaaaagtcggtgtatcattaagaagggaaatcatcaatcagcacgatcccttttgttaattcaagcaccattaagtaatgttcttaggataagcaaaaactgaatcattaaacatattttcactttttgttttgctcaggggggataatgaagtattaattttataatatatgcttgaaaatagtacagtttggaaaatacactgtcaaaatttaaagaccctcttggttaaaaaaaaaaaaaaag

SEQ ID NO: 10416 - DNA, 2317 bp, Homo sapiens; identical to SEQ ID NO: 10415

SEQ ID NO: 10417 - DNA, 1893 bp, Homo sapiens
aagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttcttttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaagggtgaaacccgatctctactaaaaa

SEQ ID NO: 10418 - DNA, 1628 bp, Homo sapiens
gaactgtcagactctcaagtaaaagcagccagaaaggggaaaaaaaggtaacagattcagcattgtccaaaagttccagaccagtgattaatgtgtaagataatggacttgggaaatgagtaaacactccccatgctccctgctttgtgcttgaacgacttgatgacaagggcagagcaaggtgagaatttaaacaggaccacaggaaaaaaaaaaaaagacaaagactggcaacaacataatgcgagggagggggagtttactggtttgcagtctaaaaggtacataataactttcttcaaagcaggccttaacagtgtactaatttaaacttcaacatgggcatggaattacccgtagaaattatatgccactcagtcatcttttaatataccggatatttatatgtacttgttttcatttatttgttgttaacttccttcggcagacccattaagcatttagatacatatttgtgttcagatgtatcatcctcagggaaaggagatgctgtattttgattaagtggtgcgtttcaaggtatttcaagctattcttaaataattatataggcacattttagagtattcctccataaaaaaatatttgaggatctggatgccttgctagctgtcgcactgcatttcttagcaatctgtcatcacttgaacttacacttttcttgatcacattgaagaccttttatatgtataaaacatttatttactttgaataaaacttgttttgtttccaggttctcactccctgtatttctttagacacctacagaggtgttttccagggatctctttttataggatcagtagcttaaacatgttaattttgtcagtcttttacataaaaatctatttctgctctgtcaatctgttttaaatgcacacatcacaactgacacccactgaggatttatttgtctctaaaaaaatcctgacaatttctctggacaaatgttacccatcaccttaaacggtgcttaatgaactttgagcaatggccatggagagactgtgttcacagccctaaatctctatattgttgtcaggtaatcaagtcttcggtggtcaatttaaaaatatttgaaattatcatattggttctgaatacaatattcatcatttttcttttaatcatagagaggtttgtaattatgtttatgtatattttgtaaattaagtccataatttaaaaaatcttgatattgcatcttcctaaaggcacttcagtgattcaaccctgaaaagcatgataatacagaaatgccattgtgattatcaacaactggattgctactttcaaagtacctttaaggccaggcgtggtggctcacacctgtaatcccagcacgttgggaggccgaggtgggcagatcacctgaggtcaggagatcaagatcagcctggccaacatggtgaagccccatctctacaaaaatacaaaaattagctgggcataatggcgggtgcctgtaatcccagctactcaggaggttgaggctggagcatcgcttgaacctgggaggcagagattacagtgagccaagattgcaccattgtactccagcctgggcgacagagcaagactctgtctcaaaaaaaaaaaaaaaaaaa

SEQ ID NO: 10419 - DNA, 1628 bp, Homo sapiens; identical to SEQ ID NO: 10418

SEQ ID NO: 10420 - DNA, 256 bp, Homo sapiens
ttgggtagacattcagccattttcagatataatgggagaaattaatgcaaatgagtcaatggaatgaaatgcattttaatgcagatttgagggactatcctgaactgcttgataacaagtcgctttaagaaaaggcttacattgtgaggactcattttttccccatttcttctcactagtgcctcataagggccctttgttctctaagtaaactctttctaaactattgacattgctcatttatgtgaatttcaga

SEQ ID NO: 10421 - DNA, 256 bp, Homo sapiens; identical to SEQ ID NO: 10420

SEQ ID NO: 10422 - DNA, 1833 bp, Homo sapiens
gctggtctgatctcagcactccttagtctgcttgcctctcccaggacgcctgcacattacctctccatactgcagccctttatatggaaacttcctacatcactttgctgtgtgtgtttacacatgtgggttttgctgtacttgccctgacagcacacgggagtgcaggccacaccccaacccacaccaactgccactgaagacagagccttggtgggcacagaaccaagaaccccacccctgccagcacctaacccttgagctaatgctgtgcagataaaaagggaccttcttataccctgagtgaccacagttgctttgaggggcacagagaaggcaccatggcctgcactggccagcagcccaccctgaaccaacactacctccagtgcaacacacacacagcaggggacccctggcccacaccccagctgtcttgcctccaccactgggtgaacgccctcagggaggcagggaattttgcatccactagcattctgccacagttgccacactttggtcccctcagtgcagtggactccaaacctccaagagccagagaacaaagttggggcccaagacaagttccccagatttaaagcacacagtccaggaattgggagccgcacattggcccccctaaaatcctccaaaaacaaagccagttagttgaatccaccttatcccacaatgaaactctcaagatcatcaaatacaataaaagaaaaatactctgtccgaaagtcagcaacctcaaagatggaaggtggataagcccataaagatgagaaagaatctgtgtgagaacactgaaaactcaaaaagtcagaatgccttctttcctccaaatgactgtatcaactctccagcaagtgttcagaactgggctgaggctgagatgtctggaatgatacaagcagggttcaggatatgcgtaggaacaaagttcactgagtgaaagaagtatgttgtcatgcaatacaagtgagctaaaaatcattgtaaaacattgcaggagctaacagacaaaatagcaagtataaagaagacataaccgacctaatagagctgaaaagcacactacaagaattttcataatgcagtcacatggtgattatgtgtgactggattatgaaaattattgtagtgtgtgtgggcacccgagattgccctgtaagcaggtgtggccagacaggggtcctgggagaggcaagcagactaaggagcgctgaggtcacaccagttccatctcatgtgcaagaccacccagcagaatagaccaagctgaggaaagaatcccagagcttgaaaactggctttctgaaataaaacaggcagacaagaatgggggaaaaaagaaggaaaatgaataaacaaaacatccaagaaatatgagattatataaacgaccaaatctatgactgattagtgtacgtgaaagagataaggagaatggagccaacttggaaaacatacttcagaatatcattcatgagaatgtccccaacctatccagacagaccaacattccaattcaggaaatccagagaatctcagtaagataagccacgagaagatcatccccaagacatataatcatcagattctccaaggtcaaaatgaaagaaacaatgttaaaggcagctagggagaaaggcagtgtcacctgcaaagggaattccatcagacttagcagacttctcagctgaaaacctacaagccagaaaagatattcaacttcttaaagaaaagaaatttcacgtagtatggcagagacagatataccatataataacatggtgttattataaatgatttaaaaaaaaaaaagaa

SEQ ID NO: 10423 - DNA, 1784 bp, Homo sapiens
gcctgcacattacctctccatactgcagccctttatatggaaacttcctacatcactttgctgtgtgtgtttccacatgtgggttttgctgtacttgccctgacagcacaggggagtgcaggacacaccccaacccacaccaactgccattgaagacagagccttggtgggcacagaaccaagaaccccacccctgccagcacctaacccttgagctaatgctgtgcagagaaaaagggaccttcttataccctgagtgaccacggttgctttgaggggcacagagaaggcaccatggcctgcactggccagcagcccaccctgaaccaacactacctccagtgcaacacacacacagcaggggacccctgacccacaccccagctgtcttgcctccaccactgggtgaacgcccgcagggaggcagggaattttgcatccactagcattctgccacagttgacacactttggtcccctcagtgcagtggactccaaacctccaagagccagagaacaaagttggggcccaagacaagttccccagagttaaagcacacagtccaggaattgggagctgcacattggcccccctaaaatcctccaaaaacaaagccagttggttgaatccaccttatcccacaatgaaaccctcaagatcatcaaatacaataaaagaaaaataccctgtccaaaggtcagcaacctcaaagatggaaagtggataagcccataaagatgagaaagaatctgtgcgagaacactgaaaactcaaaaagtcagcatgccttctttcctccaaatgactgtatcaactctccagcaagtgttcagaactgggctgaggctgagatgtctggaatgatacaagcagggttcaggatatgcgtaggaacaaagttcactgagtgaaagaagtatgttgtcatgcaatacaagtgagctaaaaatcattgtaaaacattgtaggagctaacagacaaaatagcaagtataaagaagacataaccgacctaatagagctgaaaagcacactacaagaattttcataatgtagtcacatagtgattatgtgtgattgcattatgaaaattattgtagtgtgtgtgggcacccgagatttccctgtaagcaggtgtggccaggctggggtcctgggagaggcaagcagactaaggagggctgaggtcacaccagctccatctcatgtgcaagaccacccagcagaatagaccaagcagaggaaagaatcccagagcttgaaaactggctttctgaaataaaacaggcagacaagaatgggggaaaaaagaaggaaaatgaatgaacaaaacatccaagaaatatgagattatataaacgaccaaatctatgactgattagtgtacgtgaaagagatgaggagaatggaaccaacttggaaaacatacttcagaatatcattcatgagaatatccccaacctatccagacaggccaacattccaattcaggaaatccagagaacctcagtaagataagccacgagaagatcatccccaagacatataatcatcagattctccaaggtcaaaatgaaagaaacaatgttaaaggcagccagggagaaaggcaacgtcacctgcaaagggaattccatcagacttagcagacttctcagctgaaaccctacaagccagaaaagatattcaacttcttaaagaaaagaaatttcacgtagtatggcagagacagatataccatataataacatggtgttattataaatggttaaaagaaaaagaaa

SEQ ID NO: 10424 - DNA, 1784 bp, Homo sapiens
gcctgcacattacctctccatactgtagccctttatatggaaactccctacatcactttgctgtgtgtgtgtccacatgtgggttttgctgtacttgccctgacaccacacgggagtgcacgacacaccccaacccacaccaactgccattgaagacacagccttggtgggcacacaaccaagaaccccacccctgtcagcacctaacccttgagctaatgctgtgcacagaaaaaaggaccttcttataccctgagtgaccacggttgctttgaggggcacacagaaagcgccatgggctgcactgtgcagcagcccaccctgaaccaacactacctccagtgcaacacacacacagcaggggacccctgacccacaccccagctgtcttgcctccaccactgggtgaacgcccgcagggaggcagggaattttgcatccactatcattctgccacagatgacacactttggtcccctcagtgcagtggactccaaacctccaagagccacagaacaaagttggggcccaagacaagttccccagagttaaagcacacagtccaggaattgggagctgcacattggcccccctaaaatcctccaaaaacaaagccagttggttgaatccaccttatcccacaatgaaaccctcaagatcatcaaatacaataaaagaaaaataccctgtccaaaggtcagcaacctcaaagatggaaagtggataagcccataaagatgagaaagaatctgtgcgagaacactgaaaactcaaaaagtcagcatgccttctttcctccaaatgactgtatcaactctccagcaagtgttcagaactgggctgaggctgagatgtctggaatgatacaagcagggttcaggatatgcgtaggaacaaagttcactgagtgaaagaagtatgttgtcatgcaatacaagtgagctaaaaatcattgtaaaacattgtaggagctaacagacaaaatagcaagtataaagaagacataaccgacctaatagagctgaaaagcacactacaagaattttcataatgtagtcacatagtgattatgtgtgattgcattatgaaaattattgtagtgtgtgtgggcacccgagatttccctgtaagcaggtgtggccaggctggggtcctgggagaggcaagcagactaaggagggctgaggtcacaccagctccatctcatgtgcaagaccacccagcagaatagaccaagcagaggaaagaatcccagagcttgaaaactggctttctgaaataaaacaggcagacaagaatgggggaaaaaagaaggaaaatgaatgaacaaaacatccaagaaatatgagattatataaacgaccaaatctatgactgattagtgtacgtgaaagagatgaggagaatggaaccaacttggaaaacatacttcagaatatcattcatgagaatatccccaacctatccagacaggccaacattccaattcaggaaatccagagaacctcagtaagataagccacgagaagatcatccccaagacatataatcatcagattctccaaggtcaaaatgaaagaaacaatgttaaaggcagccagggagaaaggcaacgtcacctgcaaagggaattccatcagacttagcagacttctcagctgaaaccctacaagccagaaaagatattcaacttcttaaagaaaagaaatttcacgtagtatggcagagacagatataccatataataacatggtgttattataaatggttaaaagaaaaagaaa

SEQ ID NO: 10425 - DNA, 1153 bp, Homo sapiens
ggagaaacaagatccttttcagacaagcaaatgctgagagaattcattatcaccagatctaccttacaagagctcctgaatgaagcactaaatatggaaagaaaagaccatcaccagccactacaaaaatgcaccgaagtacacagactagtaatgctaaaaaccaaccacatacacaagtctgcaaaataactagctgacagcatgatgacaggatctaatccacacataccattactaaccttaaatggaaatgggttaaatgctccgattgaaagacacaggggggcaagctggataaagaaccaagacccatttgactatgccgtctccaagaaacccatctcacatgcagtgccatacataggctcaaaatgaaggaatggtgaaaaatctttcaagcaaatggaaaacagaagaaatcaggtgttgcactcctattttcgacaaaacgtatataccaataaagataaaaaaagacagagaaggacattacaaaggtggtcctgacctttgataaatctcattattgattgataccaacctgggctatctttattgcccaaaccaacaggataatttgctgaggttgtggagcttctcccctgcaaagagtccctgatctcccaaaatctggttgagatctaagtttgattttgctgtacaactccttttctgaagttttactcatttccaacaaggaagacaagttttcctgcttctttgatgatggagagcaggcacctcctttcctgagtttcagcttgcttctgacagggaaggtgagtgtaagttgtttccagcttctaagatggcaaagaacgatcaccaacctgagccttgtttccaggtaagtagctgaattagagttttgttttaaaatttttccttaatgactaaaatttaagattactcaccagctgcttttaatttctgcttttagtttctctttaccattagaacactcagtaatcatatgaattgtgcatttgttgttttgcttaactctttttgtttgtttatgcttggggctttattgttgttgtttcacttttctcctgtctcttcctgacttggtcaaatccaaaggaattttccaaattgtggggagcaaggcctctgaattggctaaaactcctatggctgcaaacaa

SEQ ID NO: 10426 - DNA, 206 bp, Homo sapiens
gcccagagggcagggacagctatctctctaggctccacgtgcccttgtgagatactttatcccagcactttaggaatgctaagttcagatcagccccatctcatgttcaagattgcccagcagagatcaggtcccagagttcccctcttcaaaaaggggacttgcttaaaacagaagcctggccatgtttgtgtaaagcagctatg

SEQ ID NO: 10427 - DNA, 747 bp, Homo sapiens
tggaaaacagaagaaatcaggtgttacactcccagtttcgacaaaacgtatataccaataaagataaaaaaagacagagaaggacattacaaaggtggtcctgacctttgataaatctcgttattgattgataccaacctgggctatctttattgcccaaaccaacaggataatttgctgaggttgtggagcttctcccctgcaaagagtccctgatctcccaaaatctggttgagatctaagtttgattttgctgtacaactccttttctgaagttttactcatttccaacaaggaaggcaagttttcctgcttctgtggtgatggagagcaggcacctcctttcctgagtttcagcttgcctctgacagggaaggtgagtgtaagttgtttccagcttctaagatggcagagaacgatccccagcctgagccttgtttccaggtaagtaggtgaattagagttttgtcttaaaatttttccttaatgactaaaatttaagattactcaccagctgcttttaatttctgcttttagtttctccttaccattagaacactcagtaatcatatgaattgtgcatttgttgttttgcttaactctttttgtttgtttatgcttggggctttattgttgttgtttcacttttctcccgtctcttcctgacttggtcaaatccaaaggaattttccaaattgtgggcagcaaggcctctgaattggctaaaactcctatggctgcaaacaa

SEQ ID NO: 10428 - DNA, 747 bp, Homo sapiens; identical to SEQ ID NO: 10427

SEQ ID NO: 10429 - DNA, 6844 bp, Homo sapiens
aacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtaaaacattgtttttaatgtttgctctaagtagtctggtatgtaatgttacagaaaatatatactggttttgagtatattttttatcttcttagaatcattaaaatttacttttaaagtactctatttttagcatatatttaagagcagaatgatgagattatcctcaagtatttaaattttcaaagtatcactaaagtcaaacttcttgtccttaaattcgcatattcagtaatacaaattagatgttatccattactgaataaaatatactagaaattactataccattcctctacattctatgcatgggtagggaagacttaattagcaaaaatgacaattttttaaagtttttcattccttttatctatgagttaatatttttctctagaacttgactcaatatcaatgtaactataccttttttaaccaggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggtaagaacattgtttcatttgcttttaaaatttatttttagttatataagtaatacttaacatattctcctataaaatataaaagcattacaaataatattaaggaaccttaaccttcactcccaattcaagttccagcttcagaaaatgccagtgttatcagtttggtggattttacattttgttatcaaatacgtatctgtttggaattgatgacccaactaaatgtcttagaggtctttccgtctatgctcagatagatctatctcattttttaagttctgcttagtattccgtagtatggatattccataatttatttagtatctcctttgatgatgggtgtttaggtagtttcaattttagacaattaaaaaacaagtttcagagaagatccatgtaccctcctccttgtgcatataaataaatctttcactaaagtagatatcaagaatggaattattaaagtatagcttatatacatctttagaacctaaaatgtggtctctgggtcagcagcatcagcatcttctggaagcttcttagaaatgcagaatcttaggcctcagatttactgaataagaatctgcattttaacaagatccataggaattagtgtacatattaaagtttgagaaacattgatatgcaattttaaattttcataatactttttaatttttgtttattatttgagacaggattttgctctgtcccccaggctagagtacagtgatgcaaacatggctcaatgcagcctcaacctcctgggcttaagccatccttctgcctcaacctcctgagtagctgggaccacaagcatgtagcaccacacccggcttttaaaaatttttttatattgcagagtcagggtcctaccatgttgcccaggctggtcttgaactcctgagctcaagcaatccttccccctcagccacccgaagtgctgggatcacagacatgagccaccatgcctggcctaaattttcattatactttaatttgctgtccaaaatggttatgccaatttacaatcctctcagaggtatacgctagtactttttgctccttagccttcctaacagaacattcttttttgcatgaaataattattttatagcataaaataattgaatttccagtaaaaaataaaaagaattactatgcccttaaatttgttacaattttattctacttaatcaaaaaatatctgttgaatggctggtgtgtgtcttgtgcaaggtgttgaaaagataagaagaaacaagatagacaagatccctgagctcatgaaccttacattctaaccaggtagacagacatagtaagaatgtacattagttatagattgtggtaattactgtgaagtaaataaactattgagatggaaaacaacagaaagcacccattttagatagggtggtcagtgtaggcctattttaataggagacagtgagtttaattaatgtgaagacctgacttctaggtagatggaagaatcacacaaatgtaatttcactctttcttgaaactccactagaaaaaagtaaggcactaagcttaacaaattctacagaacaaaagacttggattcctcaacaaataaattatcggattaggagtgaatagagaggtatctattcacagccaaagatgactttctgccccaatcccacccctaccacagactatcacaaccttcagcgtgttactggcatctagtgggtagaggccaggagttcacagatagtctcccgccccccacaatgaagaaatatcctgctcaaaatattgtagtgccaagattgaaaccctgctataacctaaaagagattgaaaagttatcagccagttgcagtgtggggtctggggactttatttttatttttatgttttgtgacagggtctcgttctgttgcccaagctagagtgttgtgacgtgaacacggctcactgcagcctcaaactcctgggctcaagtgatcctcctcccctatagctgggagtacaggcgtgtaccatcacacctggctaatttttttttttttttttttttttagaggtggagtctcactttgttgcccaggcatgtctcaaaattcctgagctcaagtgatcctcctgcctcagcctcccaaagtgctgtgggggctttatttagatcctgattgaaacaaataacccagaggaaatgttttattatctttattaactaattagaatgttgaataccaaatattaagaagctattattgcatcttagggctgataatagtgttgtagctattttaatggaggctttatcactaaatagatacctctgttaaattaaatttagataccactaaatatcttttagatattgctaaaagataccgttgatatttatgaatgaaatgattgatttattacatttacttcaaaataatgtgaaagattgggggtgaacaaaattggccatgagttgataattattgaatgtggataatgggactgttgtatatacttgtattctataattttaaaataagcataaactctcaaaaatgggagaggaaacggcaacaagattttggaagctggaggcaaatatattagtggtaactgatttaaccaacctgagagggctgaatcttaggtcagcagtgggaaaggcaaactgctttgctttacagatttcccaaatgtcttaggaatttgtgacatcaggaacctctggaagtgggtgtataaggatagaagctttcattcaaagcggtttaaaaaaaggccctaaataccctcttcagttccatgtagccaggatgaaaactgactcaaaattttttctctggaaagagtaaaatagaagtctggattgcactggtagttgagttgtagagctactaaatagggattaaataactgtgtgcattctggttgttctattactcaaggaataaaactaaagggcttgccccaaacctaaagataatgacaggagaaaaaaaaaaaacccagccagttacccttcagtgagcccacaatcactatgctccatcccttcagtctccctatcaccttttttatttgtcacacttaaataagagcaaaaacagccaaggattatcaggcatctcaggaaagtctctaacatgaaagagagagacaaaaaaccattggctgggcacggtggctcacccctgtaatcccaacactttgggaagctgaggtggccagatcacttgaggtcaagagttcaagaccagcctggccaacatggtgaaaccccgtctctactaaaaatacaaaaattagccagccatggtgacatgtgcctgtaatcccagctacttgggatgctgaggcatgagaatcacttgaacctgggaggcggaggttgcagtgagccgagatcacgctactgcactccagcctggctgacagagcgagactctgtctcagaagaaaaaaaaaaagaaaaagaaaaagaaaaaaaaacattaaaatgaacttgaaggaaacaaggatttcaaaaaggaggacaccttttctttaactatcattaatatcttcaaagatacttcaaatataccatgacttcgaaagaataaggtgctgtaaaaacagtgaaagcagaagcctataaattataacaatatataatgaaatgaaaaagtaaaaagaagattgaatgatgaatctgggaaaatcttgttaggaagaaaattggaaatacagaatatctgtagatttcattaggaaaatttaagcatgtgtatttttaagtatgtactatttcgaaccaacaagggtggagaagattggaatacagaactatttatcattccagcaaaacaaagaaagaaggaaggtatgataaacaataaaattgtaaaactaaatatataaacatatgtatgcagcctatgtatattttcacctgttaaaagaggaaaattgttagatggggggaaaaataaacattttatactttaaagagatattattaaacaccaaacaagcttaaaagtttatttagtaaaactacaccatgcgactactaaaccgtacaaaatgttgtagtaccattaacatagaacaaagtgaatttaagatggaaggtatcaattggaataaaaaaaaagggacactacctaataattaaaaagaataatccatagaagaaactataacaagtatgaacttacatacatctaaaatagtctcaaaatgtaaaggcaaaagaaaaaaaaaacctctgccaaaattataaggaaaaatggacaaacccatacagtgcttcaatgtaccattgtagtggagtacccacctgttataaaatggcaaggaaaaggtaaatgaggtacaagaattgcaagaggagtcaaaactgcattattaataattgtgaaaaattacaagcaaaacagctcaaattcatggaagattaataaataggaggtggtatagttatgtaataaattattatacagaaacaaaaatagatgaattagagcctcatgagtcaaccaggataaattttttaaaagttcagagtaataaataaggtgcaggcttacatttataatataatatctgaaaacttaaatactaaatacttatccaacataggtaataatagttcaaacatgcatggaatggaaaaacaaattcagggtagtggtaatctctgggaaggaatgagtgaatttgataggagaggactacatagggacttcaactatgtattatttcctttaataaaaaactaagtgtttgtgaccagactggccaacatggtgaaaccctatctctactaaaattactaaagttagccaggcgtggtggcgcatgcctgtaatcccagctactcaggaggctgagggaggagaatcacttgaacccagaaggcagaggttgcagtgagccgacatcacgccactgcactccagcctgagcaacagagtgactctgtctcaaaaaaaacaaaacaaaacaacaaaaaaaaactaagtaaacatggactatgtgaacatgaagagtggcagtacgtttttgtagtttttaaatatttcacaacaaataactcaaagaactaaaatgagtttagctatcttgaagaggatggctaacctaatctatctaaatcaattttgaaaagcaagagtagaggtcaaaacatatcttttagtatctaggaaagcaaaagtaaagcagagggcataagtttgatcttttgggttttatatttgtaaaaaaataatctgttttggaacaaaaaggaaatcagaatgattaatatgagatgtagaattgttagctatttgggggaaatatgttttaatatgtataaaaccatcatcttgatttgtggttgggtcagtattgttactaatattttaaagatctctgaacagacctcagaaagtctccagaaatttcttgcattgaaacaatctttcagattgcaaatttttatacaaattattcctaatttatatgtccttattttaacaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataagtaggtatagggtattttaaacacaactctttaaatgtttactgttctgaatttattaatactctttaagcttgctgattttgagtacagagacagcatggtctagggccaatcctaatcctaattttacaaggtatcctacaagcaaatcatgatacctcttgtgtcattgttctcaccaacagataagtaaaactggcctccaaatgagctcattatatcttacttgtatatgaaataatgatgattatgaagattttggagaagttctttatatatatggtagtaataagattcatttaatcagaagtaatatttcattattttaaaatctgtacacaaattccttcct

SEQ ID NO: 10430 - DNA, 3388 bp, Homo sapiens
ttttttttttttttttttttttttttttttttgagacagagtcttgctctgtcgcccaggctggagtacagtgcctcagcctcccaagaagctgggattataggcatgccccaccacacctggctaatttttgtatttttagtaaagatggggttccaccatgttggccagctggttcccattgatcttttaggtcctagtttagacttccatcagtaatgttcctctctggtccccatgcctggatgggttgcttctctgtgctgtgatatcactctgcacctgctctcaccacactgtctgttgaccagctagccctccccactaggctggaagcccaggagaggatggccatgccttgtcttatagatcactggcaaaaaccagtgcctgttagtagcacagcagctaacacatagtagacactatttttttttaataaaatgggggtcatcattgtctactctgcacttcacattccttctagctcgttcagtctcacttatgttcagacttgtctctgtgcctttgctctcattctgttcactgccccaccctacccaggaaggcctttccattttcctctctgcttttatagattctggtccagctcacatcccatcccctctatgaagctacttttatttaaatcaacactgccccctcactcccttccctgaattccagcagcacccatctgtctgttccactcatttgtttaaaaaactgaggaccactgggttctatgctaaccactgaggatgctcaggtgaatactaagagttaacaagacactgagtgcctgtgagtcagctttgatgctaagtcaaaagctttacattttttctgatgcacaaaacaatcctaaaaggcaggtatttgcatccccattttacagatgagaaaattgaggctcagagaggggaaggaagtgaaactgcacaaggtcataaagccagtaactctggaggcaggactgccaggtgtgctattgcctgcacagcccgtgctcttacccttgtcccttggtagggtcatgttgtctaggagaagcagataacctaggtacaaaagtcttgagatgggtcaaacatgagagacaggggcaacgtcaaagggcacaaaggggaggcacacctttccagtggggatcagaggagcttcctggagagggacacttcctggagttaggtctggaaggaagagcaggaagataaaggggcgagatggagcagggaggatgttccaggcagagggttcaccacgtgccaaagtagggaggtacagaacagtttttgtgccatcagggaatagcatgtaattcgtggctaggatgcaggtttgcaggggaagcagggagagagaagtctggagagaaagatgccccataggtagatctggaggttgtgatcagctctgttttctggtttttttgggggaacacttcacacatttgcatgtcatccttggacaggggccatgctcatcatctctgtgttggtccaattatagtacatgtgctgctgaagtaagcacagccctgttttaccatgtggagggtggcttagtacatggtcctcacctctaggtgcacattagaatcacccagcagctccggaccagttgcatcagactcagaggtaaggcccaatcactgggttttggtaccagaactccaggtgattttaatgttcagccagctgggttagatggaggcaagactgaagacaaggagacaagccaagacccatcaaagaagggatggaggtgattagaacttggaaaaacctgggtaccattaactagtccaagcaggtcaatgaagataaagaccttaaattaggcagggacagtaagaaatgaagatgatggatttgagtgatcatttgcaggcagaatcaatcaatatcactttttttttttttttttgagacagagtcttgctctgtcacccaggctggagtgcaatctcagctcgctgcaacctccacctcctgggttcaagcaattctcctgcctcagcctcccaagtagctgggattacaggtgcctgccaccacgcctagctaatttttgtacttttagtagagctggggtttcactgtgttggccaggctggtcccaaattcctgacttcaagtgatccacccgcctcagcctcccaaagtgctgggattacaggcgtgagccactgcacccagcctcacttatcattattaaactctaacatgtgttgatcacttaaaactctcgagttgtactgtgtgacatgtgatagctaccttatttcattacttcatttattcccttgaggcttggagactgatgcgtgagggaggagtctgagggctcctgggccctcgcccatgggagctgggtgcgtggctgtcctgttgttaggacaagctgcagggagagactgtgtttccttggccatgtcccgtggggcccagcatgatgtcctgagtagcagaaagatgggtgagggatgggctgcctggatgatgactggctgatgcattttctgccctcagttttcaccgtggccaggatctcttcagagtcatgattcaatggaatttataccaagtgtgccctgatttgggggtgtttctcagatgatgtgtagtgcccccactcagaggagccagaagccaaagaaactcagatacacttgattctctaattcattctctcacaggaattgtcttctaaactgcaaatattaaacagcgcagagaatggtctcacaagctcagaagggatctgggaggaaatgaactgctaagagggttattttcagctactttcacttactgctttaaactgtgcttctattgtttgaggtttttgcagtgagcacatacgacttatataataaaaaaaattccattttgaaaacaaaacaaaaagtgtgcaggtttatcgtagaaaagattttattcctaacgactgatggtgatgttatgtgctaaaattgtctggggcttatccttcaatttcaaggatccaggctgtggataactgctgggtgaagctctaactgccctgactctccctgtacaccaacttcccccactcctctctaaagaaatcgctcatcttttttttttttttttttttgagacagagtctcgccctgtcgcccaggctggagtgctcactgcaagctccacctcctgggttcacgccattctcctgcctcagcctcccgagtagctgggactacaggtgcctgccaccacgcctggctaatttttttgtatttttagtagagacggggtttcagcgtgttagctaggatggtctcgatctcctgacctcgtgatccgcctgccttggcctcccaaagtgctgggattacaggcgtgagccaccccgcgcggcc

SEQ ID NO: 10431 - DNA, 21209 bp, Homo sapiens
cctacaaattccacagttttcacagtgatactgcttcttatctttgtcaaacaaatggcatatatcgcaataatattctccaaacaatgtgctacattcttcacaagtctgttgggcctaaaaaagaaacataattaaaaactgcaataaactaaacattttgagttaccatttgaatatctagaacttatgttcaactatatgcagtttatttttataagttttgaaacacctaaaccaaagatattgcttattctagaagttaaagaaatcttatttatgatacttttgattaaattttttcaaaccaccttaatacagcttttaaaaagaaaatagaaatgtcataaaatcttacatgttgaattttttcacagtttatgcactgcacttccttcactttaaagcgatctagttgatgatcttcattgttatcatgacacaagcggcaagtataaagcttgtcacagcaaggtgcctaacacccacggagaaaaaagagatatagtaagaagcaaaagaaactaagtgtgcaatacaaaaagaaaatttcttcctcctcctcctggatggaactgaaagattacaaccaatagatcagttgctaaactgatcctaaacataacatttcactagtttcttggcatattttatgttaattcttcccttcaacatcactacgtctgtatgaagttgaacacaactttaaaacaaaagaattatgaaggaaatccctagattgaaacactaatcccacaacacctgatatgctttggctgtgttcccacccaaatctcaacttgaaatgtatctcccagaattcccacgtgttgtgggagggacttagaaggaggtaactgaatcatgggggccagactctcccgtgccattctcgtgataatgaataaaatctcatgagatctgatgggtttatcaggagtttccacttttgcttcttcctcattttctattgccaccaccatgtaagaagtgccttttgtctcccgccatgattctcaggcctccctagccatgtggaactgtaagtccaattaaacctctttttcttcccagtcttgggtatgtctttatcagcagtgtgaaaacagactaatataacaccccaatttcattctgagcctaaacagcaaacaggcaacctcttcttagacatttccagataaattcatttacattaaaaataataaagattatattcttattttactagcttttattaatcatcaacctcatatctaatattgcacaaaatgcaacaaatgtaagagacagcccttgttttcaaacacggcaaagactgccagttgtccaccaaaatctatcctctccttcctgggcacaattgttcagctatatcagacagatggccacatgccctaaaacatgacaaaatgatacaacagaaaaatctcatccctggagtgaccatgtggagcaaagcctcatcaccaacctgcatcactcgccttggaattgttaaatggaaagaaataaaacctttactctttaatctacatcactgttgggttttttcattacagcaactttaccattacaagtatatcaagagatttccaggccagtgactttccaatacactgtgaccttgcagatccactcatttctgaaggcttcctatgccttgacttaccataacgtagttcattccttaaagattttaacacttaactggcttcctttttctgcaactctcagttccttaactttgtcatttccaataaccttgtcctccaacccactattctcatagttataccgcagaacagtagttctcaaatggtttggtctcaggatcccttcacactttttaaaattactgagaatcccaaagagctttggtttatgtggattttatctattgacatataccacatcataaattaaaaagaataggtttttaaaatattacttctttttaaaagtaacaaactcattacttgttaacataaataacatgttttaatgaaaaataactatatttttccccccaaacagctgaattcttctatctgcttatgcattcaaacagttgtggctgaagtacaaaaagaaactctggcctcacacaaatatgtacactggaaaagaaaggagtattttaatagcctttttggagaattatggatatcattctctgatattacactagaacaacaactcttaaagggtagttgcaacatgaaatctgaaatcgtatcaaggaatatgattgatatgatgcctcttttcttccttggttacattaaaatctattgctctatcttgcacttcaaatggatgttttactcatgcattggtcatctggagaataccagttcagtgagttatttacatcttctaaatgttcacacatttaacatgcaatatcaaaaaatcatattcattaaaagtctttaggtattgaagaaaatctcaccaaaaaaagtcttttaaaaagcttccaacctcacaaaagctagtaaaagttttccaaaattctaatttttgtgtgaaagcttgaattttatcactggcaacaaatactgtcattttcatttgtagtgagtctcacttttctcctttttgagaaaatgtctgccaactacccaaatgtgaatgactacaattttttcaagtaaaaaatgctgttccatgaaaaaaagcaactagttcactttacaatccaatttgcacaagagcttttcctcaagacaaccctctaatttcagtttgcagaagtgtttgatcaaaacttcccatgtcattgaacagcatattaaaagatatattcaagggttgagatttggttaaaattaacgattttactgctttatcaacatttttaagtgaagctggctttttaaaaaaactataggtgtagtatagttcagtgccactgtcttgattcaagctaagatactagcaatactaaacagtgcttttccaccatcaatgcgtgtgtcaacagactgaaaaaaaaaaaaaacaaatatcttagtgttcatagaaagtagttttggccttgcagagcccctgaaaggacttcaggaatccccagggttccattcaccacactttgaaaaccaatgctacagaacaacggcaccctctttgcatctcaattccaagcatgaaattctctaaccattacctcctccctaacttactccaagtctccccttgcaacaccctagttcccttctcagttcctctacactcatagataacaatcccaaccctagttaaatcctatttgacttctatcagaagcaggtgaatatggctagagaaaaagcatcaccgtccttgctggttcatatgaggtggacacttactaccacgtttccctggtcaattctctcattcttccagagtctaagacctaagatttagatgatcatttcacttcttctcctctggctttaaaactctaacaactcttcctccttaacactctgctgatgaccttatttcactataaaaacagtaaacatacttcctgctgacaggcctgaaaagaacatcctcctattatctctattaacttacttgcaaatatacctcattctctgccttcccttaggaagaactgacagtctatgtttctaaggccaactccttcacttgtgcactggatttcatcccctttggctactcagggacaatgcccttacagttttctcactctctcctgcattataaaacgttctcactctattgtatcatttcctagaatatacaaacatgctgtaatacttcctctcttaaagaggaaaaaatatggtgccagatctcccagcaaccacatcttttttttgctcccctttacagctaaaccccaagaataccctataagtgctattttcaattccactcctcccattctttcctaaattcactctaatcctgatctctccactaaaactcctcttgtcaagatcaccagtgacctcttccttgccaaatccaaagggcaattctcagttatcttactcaaacagctgcatttgacccagctgaccacatcctccttgaaatacttcacttggcctctggtatttaaggggggggggggggcgggggaaggcaaaaactgtttgacacctagggcgaagtatcttagtgctatgatacacagatctaattgtgtggtttatggggggcaccaaaaagtaaaattccgttttagaccttaaggtttgaaagaataataatacatctcagtagaaattgaatcataaggatagcattcaatttccttacacaacacttggtggatgaccaacatttttaaggagcttcatccagttcagtggagcaatgttcgtcaagccatgacctatagaaaagagtttaggatgcacgtacaggcctgagacttgtacttgcttctaataatgaggcagtgaccagcaaggctgacttgtgaagtgaaagaacaaaaaataataatactcagattgacgatgatagtaacagtcatggtggtatatatttactactcatttacttcagggaatgcgccctgttaaacactatacacgccctttagtatataatcctcatacacttttatgaaacaggcgcgatcatctccattttacatacggggtagagaggagctagctaaaatcagttattaaagaggagagctaagatttggggatagggcggttgaggttccaaagctcaagttttctaagcaaaatttttgtactgtttcttgcaaggaaaatcaggaaacttcaattgaatacgtgccaatttaaaaaaaaatacagattaagaagttttctcagagtaacaatacatgcttattaggcactttcctatgcataatttcctatttaatggcaattacatgattgtcttcttttttgggacacacgttttctcctacgtctgaacatgtgcactgcctttaacatgaagctggcaggctataaaactttaccacaggagctgaaatcgtattcgggttctccacttgcttatttccattatctccacttccattatttcatcacacacctgaacggaaaaccccagtacaggcccggggctgcctcagtctacttcggcagcaaaagacgaataagcccactggcagagaccactgtgcaagcctaatcacttcccaagaagggttttgctttaaaggtacgaagcaggtaggaaaggtggggcttatcgccttgccaaaaacgttctcctcaagaagaacccagttccaggtggaaaaggtatcctgaaaatcaggttaacctcaaacttaaatccaagcctaaccacctgcccagcccgccccagcccaacctgacggaagcttgtcagggaagagtccatagaaggcgtcacctttaggagacatcctctgtcatagtgctcgcagccccgctgacctcgctcttgaccgctggcgccatcttcccgggccgtcgccgccatctcctccacctcccctcacattccaccgatccttcccccaggataaaaaccacgcccagagaagctgcgcctctctagcacacccctcccagccccagcggccactagcgacaatatggctcctaagcacgtgacccggggcagacggatttccggttcccggggctacgaggcggaagcgaaggcagacgcagtctccgtcgttgacgttagtcgcagtcttcgctgctaacggtaataactcttaggttgcctgttttcccccaatcgctacccgcccaaatctcagggcgtagttcggcgcgaggttggcggcagcggcgcggagacgctggttggccccagaggaaaggacgctcactgggcgcatcgttacctgtgacgggtcctccctctctccctccggtggcggggagcctggagaaaggggcggagctcggcccgggccctgggctcagcgggtcccgcgcgctgctcttggacgccagggtgctcgctggcacctcgaagtgcttcttgcttcctccctttcccgtttacttgctgttctttcaaaatatgtactgacattcactattgccagtcaccagctaaaccgtgaggacaaaaagtaaggaaaaatagacacactccaccatgacctcatggaactaacaagactggtggaggaggaagacattaataagagcaatcactgcaataaatgtaagattacaacctggagaagtgctaggaagaagtgtgtgtcctgtgagagctaatattagagcagctctgacaatctgagtgtcagtgagggaaggcttccctggggaagcgatgcaagccgagggctgaaagatgggtaggagttagtgtgcaaaaggctttgtggcacaaagaacatggtacctgttagaaggtggaaggaaaatgtacaagccaacaaaattgaaatcatactcggggtacacagctaaatatgtttctccttattaaagagtcaaggccctggaaaatgatgtaagcaaagctgcaggtgttagaagaagatatttgtctttagctttctatcctgattttgtgtttcctaaaacaccgggaaagggaaaatattccccttcagctttccggttactaactcttaacattctaattttctttcagttttgttatgagttgctaaaatggtgaaatgctgctccgccattggatgtgcttctcgctgcttgccaaattcgaagttaaaaggactgacatttcacgtgtaagattttgctgtagttaagccaaatactttggccatgttataaaaagcaaaagacagttctacttaagtcttcaattttgaactttagttcccgagtcctttttaaataacctttttgttaaatttgaagtgacaatgtgatacctttacatgtttataatttagtttaaaagttttaagatatcagagactttaagatatcagagactggtttacaaaaaataccataaggctaacttttgctaatattattactttgtattttatcacaccgccaaagaaattcaatgttgtttacatgtagtttacaatctgaatgaaggagctttgctcgaatatattgccctctctatttagaagtagatcaagcataggttatagagaaaaaatacaaattacaagttaagaccaagggatctttagctgtgttgcaaataaatcaaaatgattttagtttcatattttagccattctcttgacagccatgaaggagtaagtgaaggagtaataagatttaatagttgttcacttgttaaaggtttattttgctgcttttgtgccaggcactgtcctatgtgttagagaaagatctcctagctattttgttagatataataaatcaaaactgagcatatatatcctaccttattttagaaaaatttgaaccagcttgaaaattgagtaagatatggctattaggccttcatatctctcaaaatagctctgatctccagaactccacactgcagctattctctgcattcattcactaagcatctgtagacctgctatgtattaaatgctgtactaagcaattttctggtgctgacagaagaatggaattacaaggggccctttttatcgaggataaattctggatatcatttcagataggaaaaggcccaagtgataattcttttatcatctatagatgaataaataccttcaattgtggatcttactataagatgctaaatatccattgaaacttttcttccttataatgtgagaaaaaatgaaatgagggccatatatctgcagcatgattggcagaaaatctgaatattaaaacggaaagtaacaaaagcatgaattatggtttcctaaatattataattctcaagactaataaactagttaacgaatcaatttagtcacagttgtataaggcagctttaattcaattatatagcaatagtatttgattttaaaatattttttgtattttttttctagattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggtttgtttatgagatactgtttaccatcattgctcacttttttttttttttttttttgagatagagtctcgctctgtcaccaaggctggagtgcagtggcgcgatctcagctcactgcaatctctgcctccagggtttaagcaattctctgcctcagcctcccgagaagctgggattacaggcacctgccaccacacctggctaatttttgtatttttaggagagatggcgtttcaccatcttggccaggctggtcttgaactcctgacctcgtgatccaccctcctcggcgtcccaaagtgctgggattacaggcatgagccaccgtgcctggccattgctcactttttatgatactattgaagaaccttcaccactcttgctaacatttttattgtttgcttattcatttgaagtctgttcttgaagttttaaatttgtagactgcatcttcaacttttgtaatgtgtagtaggagtattttaccagtaaccactcataaatatttgtatattactaaggtttgatgaagtgggctgactttaggaattagcataactgaagatttttgtctaaaaatggaagttaacgtaagaaggttgaactgatgttccaagttggcagtccttaacactggggcagaagtcaggagtagaaccactaacaggactaaagtacttgtaagagccacatacatgcaagcataaagtctaggtaggatcaaaaggaagaaaaccaaaaaagagatctaagaacaggagaagaaaaggtcaggaaaagaaagaacagtcaaataagtaaacgctaattgaattccatgttttttctgggtaatattcccatgggttggctgcctcaccctcagtatctctcttgactttgtatacctgaaagtgaatttctagaacctatagacattgattgattgattccaatgtggaaaattcagggagagcctccattgaaagggatctccttcctggcaactaaaaacaagagaagtagccaaaagcgtacccgctcccatgcagtcctggtcactttctgcagttggtcatattgtagaacctgagtgatcaggtagagaatgcctcactttcttcggtgctaataaatatacagtatcttgggaaagttggtctagggcttttgttttttttcctaccaccaaggtgtcatctagccgtaatgttaaggggaccttaagaaatatgggcataataaatcaaataaaccataagttaccaactttcaaaaactattgattttcttataacaaataaatttttcattttagaaaataagattataggagcaaaaataaaataatcacataatccatagataatactgtgaacactttgatctgtatctttgtaattatccgtaaatatgcatctatacttatatagataatcttctggaaatagaattatactgtataccttttcctttatttgctttattgggttttttaaaatagtgtgtactatgtgccaggcactattccaagtactttacatgtctattaactcagtccttgaaagaaccatgtcaggtaaatactattattattttcattttatcacttgagaaaactgaggcccagagaactagaatgcccttcccagggtcacacctctattaaatggcagaggctagatttgatcccaggcattttgacttcagagtctactattaactactactctccatgacattaaatattttcctacaccgtagctttcaaactttagtctacgtaaggattatccagtgagtttgtttaaaatacagaatcctacatcttccagagaattagattcagtaaattggagtgtactttctaaaaaagcatcccaatctgtttgtgctgcagatctatggatcacatgtttaagagaaacctatgtagaacatcacttttttttaactaaactttatgttgaagtaaaatatatttgtggaagagtgcttgtaagtgtacaaatcaatgagttttcacaaagtgggtacactcatgtcactcccctcagaccaagatataaaacattgcaagtgacccagaagcctccctcacatgctttcccagtcactactgtcttgactttatcactgtcaattatatacatggagtcctgtctacagtatgtactctggcttctttagctcaacatcttgtatgattcatccacattgtagcatgagatactggtccattaattttctttgctgtatggtattgcattgtacaatttcttcattctactattgataaatgtttgggtagtttttcacactggggttattataaattgtgcagctctgaacattttggggcacatcttttttttttttttaattatgctttaagttttagggtacatgtgcacattgtgcaggttagttacatatgtatacatgtgccatgctggtgcgctgcacccagtaactcatcatctagcattaggtatatctcccaatgctatccttcccccctcccccgaccccaccacagtccccagagtgtgatattccccttcctgtgtccatgtgatctcattgttcatttcccacctgtgagtgagaatacgcggtgtttggttttttgttcttgcgatagtttactgagaatgatgatttccagtttcatccatgtccctacaaaggacatgaactcatcgttttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggagtcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatatcttcttttgagaagtgtctgttcatgtcctttgcccactttttgatggggttgtttgtttttttcttgtaaatttgtgtgagttcattgtagattctggatattagccctttgtcagatgagtaggttgcgaaaattttctcccattttgtaggttgccggggcacatcttttggtccatttatgtacacatttctatagggtatatatacgcttcaattagaagtgggaattactggtgatgtggatgttcagcttggatacatattgccatagctttccaaagtacttttgcaaatttatagtcttaccatcagcatataagaattcctttggttccatatccttgatagtagttggtggtgtcaattatatagacgattttttactgaccatatagtagttgatcctacatatgaacaatagtatgtgtaatcagtcttcaatattgtgtataggctgtcatctttccttattttaaacaggactaaaatgaacattattgtagctggcttatatccttatttccttgaactaaattctgcaaataaaattgttggatcaaagactatatacactttttaaagatttgctttcaataaagatcatccaaagcctcattagaaggcttgcaccaatctatccccctactagctatgtgtaagaatgtctgcctaccctaatcgttggtataagttgtgtttgtaaactttgctaaaattgataggcaaaatgttatctttttgttttaatgtatctatgaacactcgtgcgtgtctatgttttttcatgtgtttattggatatttgtattcttttgtgagttacttattcaggtcctcttctattatctttttctatgctgttttgtaaaaacactggatattgaggataggaatcatttaactgccatctacattgcagttccttttttttctcccctttctcccacattccttcccagttactttttattgtttgtcttcagttctagttacggcatgggtttattttttttttgaaattcaggcttttttcaatgtagtcaattctatattttcttgtgttatatgacgttagcctttctcactttaagattatataaatattctttatattttttctacctcctcatggttttcttttttacataaaatttcagtacatggaatttcattgtggtttattatgtataaaggatacaactgcttctcttaattagttgatttttacatggtttgtcgccttactctacttatttagaatgccacctttatcctaaaggcatctatctacttgatgatctatttctaggtttttctgtctagtcctaacaaaagaacacactgttttaattattgttactgtatattatatttttaatagcttgtagggtgtttcctttttaggaaaatttgtgttttcagataaccttagagttgatttcagaaagttcttttaaaattatctgggtggaatttgctgacttttaaaagcaatttccatgaaaagaaatgtggtattaacttcactatacaaagttaagaaggaataaaaatttaagaaagaacaaaagtatctcacttgatgattattattaactactcttaacaggggaaaagagaaaaacttcattgtagaaaaaacttcaccctcaaaaccgttccagccactaactacaatcaccatcttgttggtgcttcctcatgtattgaagaattccaatcccagttcatttttgtaagtaaattacttgctgagctcatgttaattcttttaagatgaatatgtcctctccattacaatcaaatttttcagaatcctagcaaaatctaggggttaatatgtaatatctacaaataatattgcttcctagagtcattgtaatttatatatatgcaacagcaaaatagaggtagttaatcctttggttacatatgtagttcactgaagaaggcttttgcaaggatatttctaccaaggaaataattcttccctctaactgctataatttccgtatgaaatatgtaataaaaaatagctatttaagttttctcagtcatacacatacagagtattcaagcttgcatttatttattcatctcattgcttattcatgttagaggcaggcatggaatctagatctcttttactatcttgattaatacaggtttataataattttttctatttttgtgggtacatagtaggtatgtatatttataggatacatgagatttatttaggtatacaatgcatgataatcacattagggtaaatagggtatccatcacattaagcatttatcttttatgttacaaaaaatccaattatacttttagttatttttaaatatacaataaattattgttggctatcgtcaccccattgtactatcaaatactagatcttagtctgtctaactatatttctgtacccattaaccatccccacctcccccccatcctactacctttcccaatctctcgtaaccatcattttactgtcctgtccctgtgggttcagttgttttgatttttagatcctgcaaataagtgagaatatgtaatgtttgtctttctttgcctggcttatttcacttaacataaagttctccatttctatctgtgttgttacaaatgtctaaatctcattttttttaatggcttaatagtactccatggtgtttaagcaccacattttctttatccattcatctgttgatggacacttaggttttttccaaatatcggctattgtgaacagtctgcaacaaacatgggagtgcagatatccctttgatgtactggtttcctttctttggaaaggaaagggtgtataccacacccagcagtgggattgctggatcatacagtagctctattttagttttttgaggaacttccaaactgttctccatagtggttgtactaatttcccccgacagtgtacagggttcctttttctccacatccttgccagcatttgttgttgcctgttttaggtataaaagccattttaactggcatgagatattttcttattgtagatttgatttgcatttctctgatgatcagtgataatgcgtaccttttcatatgcctgtttgccattcctatgtcttcttttgaaaaaatgtgtattcagatgttttgcccagtatttaatcgaatttttagatttctttcctgttgagttttttgagccccttatatattctggttatcaatcccttgtcagatggatagtttgcaaacattttgtcccattctgtgggttgtctcttcactttgttgattgtttcctttgctgtgcagaagctttttaacttgatgtgatcccatttgtccgttttgctttggttgcctgtgcttgtgggatattactcaagaaatctttaggccgggtgtgatggctcatgcctgtaatcccagcactttgggaggccaaggtggatagattgcttgagctcaggagttcgagaccagcctgggaaacatggtgaaaccccatctttaccaaaaatacaaaaaaattagctgggggtggtggcatatgcctacccagctgctcaggaggctgagtgggaggatcgcttgagccctggagatcaaggctgcagtgagcttgatcgcattcactgtactccagcctgggcaacaaagtgagaacctgtctcaaaaaaaaaaaaaaaaaaaaagaaaagaaatcttagcccagaccaatgtcctggagagtttccccaatgttttcttgtagtcgtttcatagtttgaggtcttagatttaattctttaatccattttgatttgatttttgtatattgtaagaagtaggggtctagtttagtttttctgcatatggatatccagttttaccagcaccgtttattgaagagactgtcttttccccagtttatgttcttggcacctttgtcaaaagtgagttcgctgtaggtgtgtggatttgtttctgagttctcttttctgttccattggtctgtgtgtttgtgtttaagtttatggcatctttaacttatcacaggctatgttaaagtggtattactcccctttatgtacaaaaatcttatagtcgtatactttcgtttttcctttctcaatctttgtgctattgctgtcatgcatttcacttttacatatgctatagactccacaccattattgttattatttttgtttaaacagtaaattattctttaaagagatttagataataagaaaaaaattgatattatccatataggtgccatttccagggcttttcattcctttgtgtcagtccatatttccacctgttatcattttgcctacaggacttactttaacatttcctatagtgcaactatgctggtgatgaattctttcagtatttctgttgcttaaaaagtttaatcttcacttttgaaagatattttcactaggtaatcaaattctaggttaacagttttgggggcgggggcagttgtttttggtactttttaagacgttgccctgctgtattcttacatgcaccatttctaatgaaaaatttaattaatgtcatactcacctttattctctgtacctaatacttctttttttctttgcttttaagaatttttctttttttaaattttttatttatttatttttggagacagggtttccctctgtcacccatgctagagtgcagtggcacactcacaactcactgcagcgtcaacctcccaggctcaagcaatccctccacctcagcctcctgagtagctgggacttacagacatgtgccaccatgccaagctaatttttgtttgtttttgtagagaccagatttctccatgttgcccaggctggtctcaaactcctaagctcaggcgatccccctgcctcggcctccctaagtgctgggccaggcgtgagccaccgtgctggacaataatttttgtttttttctactgcttttgcctaatctgatgatgatatgccttggtttcattttcttcatatttcttgtaattaagatttgttgagcttttttatttagcagtttatactttttatcaaacttggaaaaattttggccatgatttcttcaaatatttctttctatcccaatttttcccctccttcaggaattctaattatgtgtatattaggctgtctgaaattgtgcaacatgttactgatgctttattttttttctatctccttttctctctgtagtccatactggatagttcctgttgctgtaactttacattcacgaaatcttttcttcttcaaaaaatacactgccattctctccagtgtatttttttacctcacacatcagttatctgtagatattctattagagtcttttttatatattttatgtacttaactttttgaatatatagaatacaattttaataactttcttaattgtctgctaattctaacatttgtgtcagttccggcttggtttccattgattgatttatctcttattatgactaatgttttcctgcttatttgcatgcctggtaaattttgcatgccatgaattttgggttttaatttgccagatgctagatatttttgtatcatgttttcttgagcattgttctggagtacagttagttagaaactgttcgaccctttcagattttactttgtttgacaagactgttttgcatacttagtgtccatgaatcttgacattttcaagtctggctagtgggaatagtggctataccctgtgagcacagggcactcctaatctctggttgttctttcctcagccttgagtagtttcctcatgtgcatgtgctgatcttactccatggaatactcaaaggggagcctctgaagatcttgagttttttctgtgcagctctcacctgtctagtactttgtcctgtgaactgtagctactttggtctccctggatgttttgcactacctcctcagctcagtctgctaagctctgcctgggtttcccttccttgccctgaggccgagaaactctcaggcagttagctggagcagtcttaggtctcacctctttgcttcccatctgtccacaatagctgctgtccttgccaaatatccattatcttaagagctatttttttctgtcttttagccttgtgttggttcttggaggtaggggtcaatccagtctctgttacttcatcttggctggaaataaaagtcttctttactaattttaatattaaataatagcttttcaaaattattttatagtacctttataagctatgtcagtgttattttccctattctcaaatgaaaaaggaataaaagcatacccagcaaatttaagcataaccataataaacaccaagaggagttgtctcttgaaaattccaagaccagagtcctctctaaatccccaacaccgagcctgagaacctgctgcagtactcttttcctgtcacaccttatcaaatgcaatagccatccaataaagtaacccagttaaaaacttaatttaaatttgtttgataggtaaaaattaaacttagcagcaccacattgaatgaacaaaagctgtagagtcattgcaagtgtcatgctattcatagagataagtgcttcccatccataatattctgcagtctttgtgtatgcctggccttagtaaaaggagggatgcccttagcaccctaaatattgcttctacccccatcttcttcctgtgttccttaaacctctatcaccaacttaaaaatgttctccaggcattgtaaatgaagaaacagcttagacctagttataagcttttatccaactacatatctgtctgatttaataacttggtgtttatgtttttaggaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattccaaaccttccctctaaatgggatttaacccacatctgcgagatcagcgttatgctaagaggaaatcactgaggccatatctttttacaatctgaaaaaaaagtagtaaaaaggtagttaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaa

SEQ ID NO: 10432 - DNA, 1552 bp, Homo sapiens
gtgagaagctagctgagagaatgctagcagtgttccttcggatcaagttgagactagctggtacagttaagcctaagtttctttttgtttctttccttgcccctctcatttttctagactttgagaaatttacagtttggtagttaaggactatgtttgcaagcctaattcaaagcttttggggaatgagttgttttgttgtgcaaaagacaaataggaagtatatgactgtatgccttataggaatagaaggcagcagatagtatagctattttccatatggggaaactgaggcatgggagggttacttaatgaagtccctgatctctcaagaggcaaacattaaaaaaaaaattagagaaagacgtcattatttgaaaatagaggtgagccctcctaaagctggtcttgagctgtttcacgtgttagtgctggcaggaggtaaccaggacggcctaaatcttgctttctgaaactcgttcatcaggcatttcctgagtggatgtgagtactgagatacatcatcagttctcccatgtgccacgtcactgctgacacgtccttagaaatgtctgatgtggtgttggctgatcttggtattgatcagttgtgaaagtggaagaggcatgagaagagacacctcttggggcacgctaaaatgacatatcgtgggggtccctggacaactttttattaggactggagccagacctaggaatatgtgttttaaataagtcttttaggtgattctgacgtaggtcatccaggaactcactttggaaagcattgtactagacatgaaataggagtggctggatgaaaaacaataaggaaaatttgccccggtgctgtggctcatgcctgtaatcccagcactttgggagacagaggtgggaggatcacttgagcccaggagttcgagaccagcctgggcaacatggtaaaaccccatctctacaaaaaatacaaaaaattaaccaagcgtggtggagggcacttgtagtcccagctgctcgggaggttgaggtgggaggatcacttgagcctgggaggttgaggctgcaatgaattatgatggcaccactgcactccaacctaggtgacagagatcctgactcaaaaaaaaaaaaaaggaaaattttcacagattggtgaaattaaactgagaaccacttttgctttacatatgagctcagcagagcctttaaatcacgatcaggtttaatttactatctaattttcagaaatacatttgtcacctgcagacagttagacctagacagttgtagaaattttcagcattcccaacttacagaaaaccctgacagaaagaatacacagctgacccttgaacaataccatctgaacttcgagggtccacttcgactcaggattttttttcaaccaattgcagacagaaaatattgcaggatgtgaaacccatgtgtgtagaggcccagcttctcctataagcgggctctgcagagtggactttgagacttgggtatgtgtggattttgccattggtgggattcctggaaccagtcccctg

SEQ ID NO: 10433 - DNA, 1552 bp, Homo sapiens
gtgagaagctagctgagagaatgctagcagtgttccttcggatcaagttgagactagctggtacagttaagcctaagtttctttttgtttctttccttgcccctctcatttttctagactttgagaaatttacagtttggtagttaaggactatgtttgcaagcctaattcaaagcttttggggaatgagttgttttgttgtgcaaaagacaaataggaagtatatgactgtatgccttataggaatagaaggcagcagatagtatagctattttccatatggggaaactgaggcatgggagggttacttaatgaagtccctgatctctcaagaggcaaacattaaaaaaaaaattagagaaagacgtcattatttgaaaatagaggtgagccctcctaaagctggtcttgagctgtttcacgtgttagtgctggcaggaggtaaccaggacggcctaaatcttgctttctgaaactcgttcatcaggcatttcctgagtggatgtgagtactgagatacatcatcagttctcccatgtgccacgtcactgctgacacgtccttagaaatgtctgatgtggtgttggctgatcttggtattgatcagttgtgaaagtggaagaggcatgagaagagacacctcttggggcacgctaaaatgacatatcgtgggggtccctggacaactttttattaggactggagccagacctaggaatatgtgttttaaataagtcttttaggtgattctgacgtaggtcatccaggaactcactttggaaagcattgtactagacatgaaataggagtggctggatgaaaaacaataaggaaaatttgccccggtgctgtggctcatgcctgtaatcccagcactttgggagacagaggtgggaggatcacttgagcccaggagttcgagaccagcctgggcaacatggtaaaaccccatctctacaaaaaatacaaagaattaaccaagcgtggtggagggcacttgtagtcccagctgctcaggaggttgaggtggcaggatcacttgagcctgggaggttcaggctgcaatgaattatgatggcaccactgcactccaacctaggtgacagagatcgtgactcaaaaaaaaaaaaaagtaaaattttcacagattggtgaaattaaactgagaaccacttttgctttacatatgagctcagcagagcctttaaatcacgatcaggtttaatttactatctaattttcagaaatacatttgtcacctgcagacagttagacctagacagttgtagaaattttcagcattcccaacttacagaaaaccctgacagaaagaatacacagctgacccttgaacaataccatctgaacttcgagggtccacttcgactcaggattttttttcaaccaattgcagacagaaaatattgcaggatgtgaaacccatgtgtgtagaggcccagcttctcctataagcgggctctgcagagtggactttgagacttgggtatgtgtggattttgccattggtgggattcctggaaccagtcccctg

SEQ ID NO: 10434 - DNA, 1550 bp, Homo sapiens
gtgagaagctagctgagagaatgctagcagtgttccttcggatcaagttgagactagctggtacagttaagcctaagtttctttttgtttctttccttgcccctctcatttttctagactttgagaaatttacagtttggtagttaaggactatgtttgcaagcctaattcaaagcttttggggaatgagttgttttgttgtgcaaaagacaaataggaagtatatgactgtatgccttataggaatagaaggcagcagatagtatagctattttccatatggggaaactgaggcatgggagggttacttaatgaagtccctgatctctcaagaggcaaacattaaaaaaaaaattagagaaagacgtcattatttgaaaatagaggtgagccctcctaaagctggtcttgagctgtttcacgtgttagtgctggcaggaggtaaccaggacggcctaaatcttgctttctgaaactcgttcatcaggcatttcctgagtggatgtgagtactgagatacatcatcagttctcccatgtgccacgtcactgctgacacgtccttagaaatgtctgatgtggtgttggctgatcttggtattgatcagttgtgaaagtggaagaggcatgagaagagacacctcttggggcacgctaaaatgacatatcgtgggggtccctggacaactttttattaggactggagccagacctaggaatatgtgttttaaataagtcttttaggtgattctgacgtaggtcatccaggaactcactttggaaagcattgtactagacatgaaataggagtggctggatgaaaaacaataaggaaaatttgccccggtgctgtggctcatgcctgtaatcccagcactttgggagacagaggtgggaggatcacttgagcccaggagttcgagaccagcctgggcaacatggtaaaaccccatctctacaaaaaatacaaaaaattaaccaagcgtggtggagggcacttgtagtcccagctgctcgggaggttgaggtgggaggatcacttgagcctgggaggttgaggctgcaatgaattatgatggcaccactgcactccaacctaggtgacagagatcctgactcaaaaaaaaaaaaagaaaattttcacagattggtgaaattaaactgagaaccacttttgctttacatatgagctcagcagagcctttaaatcacgatcaggtttaatttactatctaattttcagaaatacatttgtcacctgcagacagttagacctagacagttgtagaaattttcagcattcccaacttacagaaaaccctgacagaaagaatacacagctgacccttgaacaataccatctgaacttcgagggtccacttcgactcaggattttttttcaaccaattgcagacagaaaatattgcaggatgtgaaacccatgtgtgtagaggcccagcttctcctataagcgggctctgcagagtggactttgagacttgggtatgtgtggattttgccattggtgggattcctggaaccaatcccctg

SEQ ID NO: 10435 - DNA, 1075 bp, Homo sapiens
cattgataatattggtcctattaagtggtggtgtagagaagtattcacaaatttcaaaccaaaaaattatgtgaatagtaggggaattctttctgtacccttgagttattttatcactgttgtgtttacaccttataagaaaattccactctgagaatgagcacaaggaacagataggaaatgtgcagctggtgctgatgtgtagccctgcgcccttcaaatccatgtgtgcaggcagtcacttcctcagtcattagcttttcatctgaaacaacaaagctagtggtaggcagcttctgagatggttcccagtgaagcctgcccgctggtgtgcactcttgtttaacctcctgtccttgggtgtgagctgcacttagtaacctgcttctaaggagtagaacatgggggaagggagagagcacacctgaggtttggtggcagaaaggctctggcttctgtctcctcgcccactcttaactttcatgctttcctgctcagaaggtgaggtgttctttggaaaggcccatgtgacaagaagcagaactttccagccgacagctaacatggaactgaggccctcattccaacggcctccaactgaatcctgccaacaagacatgagtttggaaggggatccaccccagtggaactcctgagatgattgcagccttgtgagagacaaaccaagatgtttgtttaagtgctaaacgtggggataatttttatgcagttacagataactaatacaaagctagaaaaagaaaaaggcataatacaaatttcagcatcttaatgagtctgccagcatctgaagaactgaaataaggcgaactggtcttcctcccgcatgagcacctgtcagctatcttagtcttaccttaaataaaaacacttaaccaaatacattatctctctcaaggacagcaaaagatattgaaatttgatgattctgtatttgaaatgtaaatcagattacaattaaactctaactcttgaatactgtcccttttaagtcaccaaatctcctttgagtaagatgaaattatctaaaaatgaataaaggataaaattttta

SEQ ID NO: 10436 - DNA, 308 bp, Homo sapiens
tcacagagtgggctggagagccaagctgttctttcggggtgcacagtgcaccagccataacacagcttagaaacatggatgagtatacctcaagacaggtgaacacggagtggggagcaaaagaaggcagaaactcctctgagtttcacaagcatcaggcacagatcagggcacagaggaagaagaaagaaggtttaccactggtctgtctctgtaaattgttacagagcaattttactttgtgttatttaggatcaagaaacaagtgttatttaaaagttctcttaccctccaacctttgtcatact

SEQ ID NO: 10437 - DNA, 256 bp, Homo sapiens
tctgttgcccaggctggagtgcagtggtgtgatctcggctcactgcaagctccgcctcccgggttcacaccattctcctgcctcagcctcccgagtagctgggactacaggtgcctgccaccacgcccggctatattttttttgtatttttttagtagagacggggtttcaccgtgttagccagtatggtctcaatctcctgacctcgtgatccgcccgcctcggcctcccaaagtgctgggattacaggcatgag

SEQ ID NO: 10438 - DNA, 1619 bp, Homo sapiens
agcacgtcatagccaccatacggagaagagtccagttccttttccctgggaacccccaacccacactcttcatcaggcaggtcccctggctcatgaatgcagaacaatcaccgcacccatggctgagcgtacccactggtagtggcctggagtttccctagggagaggctccaagaggcatatggctgtccctctgccactgccacagcaacagttctatccctacttccctcagcctggggaagaaacaaagagcctgaggcctataccaagtttacagcacaccacagtcaccatgtggagaagagaccaatctctcctcctagtgagccttcaactgcctttttccccagtaagtggaaccccacgctcatgccagcagtgcagccatgccaccccacagactgaacactcccagtaatagctgctctgtgtttcttgggggtggagcccccaggggcaactaaaagcctgtctgccattgcctctgatgtggtactacccctactactctcagactaacaaaggagcaagaaaataaatgccttatccacacttccaacaagctgcagtcaacccaaggagacgaggccagtctgtgtcccatgggtcctgcccatcccccctgctcatcaccaagcagggaacccacaacttgggcacagagcacacactctctatccttggctgattgcactgtgaaattgctgacctgcatctctctggggtggagcccccaggagacaagcaaaaggcccttggccacaaccattactaaggtccctttctctgtcctacttagggaggaaacataaaccatgagatcacctcaaagctgtagtgggcagcctgggagtgctaaactgcaatgtacagccaacattcatgtgggcgaggagcctacactttgagagctttgacagggagcatggttgcaactgtgaggaaatataggggagccacaagaacttaccaactgaccactacacctaagtgtcacctacaggataacattcgaaagcttcaacaccaaaaatatcttactgacatacacccctgcgaaaccaaagatgagaagtcagctacaaataaaggccctgcacgaagccatggccttgtgaaaacatccagaaaataagtctattgaaagtaaacaatttacactgtagttaaaggaacacctaaacacagaggtgagaaagaatgaatgcaagaattccagtaactcaaatgaccggagtgtcttatgtccttcaaacgaccacactagatctccaacaagggttcttaaccaggctgaattggctgaaatgacagaaatggaattcagaatatgactaggaatgaagatcattgagattcaggagaatggcaaaacccaattcaaggaaactaagagtcacaattaaataatacaggatctgacatatggaatagccggtataaaaaagaacctaactgatttgatagagctgaaaaacacattacaagaatttcacaatgcaattgcagggattaacagcaaaatagaccaagctgaggaaagaaactcagaaattgaagactggctctcttaaataagacagtcagacaaaaataaagaaaaaagaatgaaaagg

SEQ ID NO: 10439 - DNA, 346 bp, Homo sapiens
tatttcatagccttcactattgataccttcaggaaccgaaaaatcccaggtgactagggactggagcagatcccagcatactgcagcagccctatggaaaagaggccagattgttatgtgggtgcccacttccatatctcctcactgggtagttcttccaggtctgggtctccagccactgccaactggggctatggagccagtggcagctctgcaactccctggacaagagctcccagtgggaggggcgggttgccatttttgctgtctcacagcccttgcccttgctgtcttcaggctctggagagtcatggggaccaaaggctggtccagacccccacacaga

SEQ ID NO: 10440 - DNA, 6998 bp, Homo sapiens
gaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccaggtgagccaagggaagtgcgcaggcgcgggtcggggtgggtgtggaggtggcaacgactccccgggtaggtcgcccccagtcaggggtcatactgctcactgtcccgggtcgcttagggagttcgtggagcgggaggtgatcgacttcgcccgacggaatccaggggtcgtaatatatgtaaactcgcgtccgtgctgcgtgcccagagtagtggccgaataccgtgagtggggccgggctcgggctggagggcgggatcaggggctcgacccgctatcctccttctcgcttggtcgcaccggccagcttccacccactctcacccctcttctgccagttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcacatttcaggtctgtcttcaaaatgtgtgcatatgttaagcacaagcctcagttttcattattttaaaactagacgcagaacatataacaactgtcaggtggttagtatcaaaggccaagtgattaatctaggcctgacccctgaaagggagaggggagtgattctcagaccaagtcctggctgacaagctttctctggtcttagctatacatctccttccccccacgtccctctttgtgcagaaataaaatccatgtcccttgagccagctggtggggggtgctgagaaccttggggaagggcaggaaggctgatattaatgagtattttctaatcttagtttaaaaaggggggatggtggggaaatgagaggcaggaaatgaaaatctagaaacccctgtaagaattcttgaactgttgtcattttcttgtcatgccctaacaccatgatcaatgaatagtgtgaaccttactaaagaggcctgtgtgcctgccaaggagtcaggatggaagcggaggatcccaatttcctctgcaaatagttgtattggggagcagagccaatcctggaggcagatatcaccttctgtataggctcaggagcctgtcccctggtgatcaggggtgggcgcatctagatgaagcagactagtcatagctgtggggaaaaagggtgtttattaaccaacggcagggggaggagctgagcccaggctccccactctgtcacatgcctgttccacccacctggttgtaagtgggggcattcctaaagaagtgtagccattctcacaataaatacattcattgtggggtggaggtgggagaggttgggtgaagggcagtaaaaacccgtgggattccacgttctcagctacaaaaataacagtcatcctcacccgaggggaatgggggagctcagtcagaattgattgtcccatataggcctagagacttcagaggcccctggcccctgaaagtgccccggtgaggtaggacaggggtaggagctaagcgtccaaactcccagcctctgccctttgcatagttccaagaatgggcttcatgtgccagttgagacatcagatttctcctccctttccctgctgtagtctagaggaagcaaatgcttgattcccccaaaagagaggctggctcattgagtgcagtgttggtcatccatcctaggcaagggcctgtgaggacagttaaatgggagggggatctccctctgaaatgtccacggactaaacccaacagacaggtccaagacagcaagggaggctcagaggtgcatgtgagtggaaatgtaagcacatgtgtgatacaggtgtgtgttaccacatgtgcatggggatgggacatgcctggagctctgtctctcatactcttgagaatgaccaaggagagtggggaggctgattcacaagggccacacaggaagggagaggaggggagtgatgcagtcttacctccccaggctggcccgttcccaagctcttgacaaagaggtcaccacatggggctggggaagaggaccagataggatgtggcaattgggagggtaccccaagtccagaagcagggatgaaacaagaatgcaccaggagaaggtgagggtgggggcactgcagcccagccgataaacattcttccatgtgtgcatgtgaatgtacgcagggcttaggtggctggcagaggtcttgtctggtttcaggaccatccagcacacagggccatgcagagggtggtgacattgagcccatatggacctgcagagccctgcctgggagaaagagaaagggtttgggcagatgaatggaacaggaggatggagtcctcacctataagtgtttaggttaggggataggaactggctctgggtctgcagggcacctgatcctgagggagcacctacctctgaggagcaccgatgggcctgggctgctcacatgtgggtctgtggagactgaggagggggctttggctgggcctgactggccagccctacagggacatcaaaaagttgggagaagggtatggagtgggggtaatgaagggagggtggctgtgttagggaggcagtggcccagcctgggacagataggctggcttggaagagcatttgttctgggaggctgggctcagacagagctctcatctagctgctccacgagctgcgtgtgcttccttttttccaggatgcggctgagttcctcggcgaaggagcagggccctgctggtactccattgttgctctgcctcagaagcacatagctattgccattcatcctccgcagccggctgggcagtgccaccaagccattggtcagctcagccggtggcggtgggggcggtgggggtggtggggctggggctccctccccagggatgatctggagacagctgccctccaggcccccagccccctcatcatcaccctcatcttcctctccaggacactggcctgagactgtctgcagttgcaccgcagatcctcctgcccggctggcccgacccagtgagtatttccgtcggcgccctcgtctgccttcccgcagacaggccacatagaggagggaggaggccaggatgaggcagaggccaccaagcgcggcaatggctagcacatagagcagtctcacatcaggtgccagctgtgccccaggtgtggcaggggcttttggagctggggcaggagtggctggccggactgtgagactataggaggccagcagggtgcggaggccattttcctcggcatagcagccatagttgccactgtgctcaggctgtgcatctgtaaccagcagcccgtccacgcccacacggtagccaccctgcccatcgctcaggcccatgctcccattgagtagccacaaggcccgggccaggttggatggctggtcacagggcaggaggacatcatcaccccggagcacagagcgggtcttcagtggtggtggtggccctgtggggtttgggggagaggtcagtaccagcccgtcccaggaagggattagagatggcaagccagactgttcactgccaagtccctggcaccaagcacagaacccagaatcacagtgacagctgacccaggctctgtgctcatgcttccacagaaggttcacgttggcccttcccaggaagcaggcagtgccttgggcccttttccattctctctccatgctctcatcctctcctgtggtttcaatttctgccatctgccagtaactcctaatctctacctcagacttctctcctgagtgccagactcggatatctaccatgtgctgggcatctccacatgaggtctcttggacacctcaaaaccaaagcttttctccccaacgacaccaagtcctttccttgaatcgccaccactgtgaatggcaccaccagccacacagttgcttaagtcagaaacctgggagtctcccttctctttcttgctcgcctttttgttttgttttgtttttttgagacggagtctcattctgtcgcctaggctggagtgcagtgacgtgatctcagctcactgcaacctccacctccctggttcacgcgattatcttgcctctggctcctgagtagctgggattacaggcatatgccaccatgcccagctagtttttgtatttttagtagagacagggtttcaccatgttggccaggcttgtctcgaactcctgacctcaagtgatccactcgccttggcctcccaaagtgctggattataggcatgagccaccgtgcccggcccttcttcacgtttgtatctaactgtcactaagattctgtttctggcatctatcttagacctgttgatttctctccttccatgactcctggcccactctggccccatgtaatccattcttcatgagaggtattttaaaaacacaaatctgatcatgccactctccagcctaaaactcttcagaggtttcctattgcttttcggataaagaccaaaatcttcaacatggcctttgcccacttgtccagcctattctcctgtcactcaaatgtgccagcctccctctgcctgctgctccctctgcttgcatgtcaccccattaccccatgtcctctgcttgcctggctaacttgtgggagatagcatagtatagtgaccagaagcacaaagtcaaatcagactgcttggggtcaggtttgaattcttttttctttctttttttttttttttgagatgagatgaggtctcactctgttatccaggctggagtgcaatggtgtgatcttggctcactgcaacctctgcctcccaggctcaagtgatcctcccacctcagctttccaagtagctgggattacagacatgtgccaccacacccggctaatttttgtattttttgtagagatggggttttgccatgttgcccaggctggtctccaattcctgagctcaagcaatccacctacctcagcctcccgaagtgctgggattacaggcgtgagccactgtactcagccaggtttgaattctggtccagtttcttaatagctgaataagtttgagcaatttacttacactccctgggcttcagagaggtccctcatggggataataataatggcacctttctcataagaatgctgtgacagtagatgacatcatgcatagaagtatttagatcagtgtctggcacacagtaaatacttaatacatcttagctgtgatgattaacttttgttctttcttcagatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcacttactctgtgccaggctctgtgtttgagtcatccttaccaaatgtacatagccacagccactcagatacaaacatatacgtacacatggcagtaaatggcaaagaggacagtctgcgtagctagacccacactcatatgagtcacttacctgtatccctgctgctctcacagcctcgatttcctctctctatgtcctgtatcagtgctgtcctgggacagaagatcaggttttatgaacaaggggaactgggtttcagtttcccagtgaaagggtagataggtctgttactaataactagcccctgcactcccccagtagctatcaggccttcctcctccactcagaccacatgtgactgtcaccccccaccacttcccacctgcttccctgggacctgttggctatggtggtggctgctgcgcaggcatgggtgccagggtcccagccacagtaggggtctcgggccaagatgcagtcatagcaggatcggtagcgggagcagctggagagtggtagctggatgactccgctaggagcccccacatagaggctgtgctgggagccagataggacagttggtcggcagcgtccccactcatacagatacacagcctctgcccaacctccccactccctcttcctatttcagcaaggctatattaagggtcacagagaagggctacctgcaatagagagatgactagattttccacagactgggactccctgaacacttgtgtctcttcaataatgtgcatcccagagcccaggactacggccttgtggatccagccatcagctggtatggaaagagcagagagttagaccccaactatgggatctgctctcagcaccctgcaagaggcctaa

SEQ ID NO: 10441 - DNA, 6834 bp, Homo sapiens
ggcaatggaaaaattttttagtaaaactggaaaaggctctataaaatgtcctgactccagcagtcttgaggcagcacacaatggcatcagtgtctaggtggcaggcactccgggctgacagcttccttctatggctctatgaccaagcaacccagcccgaggcagctcccaccagtgaggccctgatattgcagggctaagcacctaggatccaattctagtacatgccacctcatgctaggctctacaaagtggggagcagaggagcttggtacccactgtatcaccctttgactttgaaagcctaggctggagtttcgcatgaagtccccgattcccctccaggttcatgcggcctgacctcactgccttgaatctgacctgctcattcctacctcagggcttggatttccttttctctctgcctgggtccccttcgccggatgttcacgtggctctctccttctagttgtttaggccccagctcacatgccctcggctcagagacaccttttcagaccacttatctacactagcctgccagcactctatcgcatttctattttctttacagcatttttcactaaaactaggttttctgctaatttgttcattgcttgcttgtctcttccgccagaatgcatgcaggcagggactttatctctcttttcagtgctgtatatacaggacctcaaacaaagcctgagcaacacagtagtttctcagtagtctgctacattgaattttctcactatggaaacctgctctaggttaggcccctcagactgagaagggcacacagctcaggaccacaggatagaggagcccttgcagagttttatgctccagcctatcctatcaggctcatttcagtgaccagctctgcacggccttcactttgaacgcttggaggtgtctggctggtcgggagtgggggcctggcctgagcaaatctcagagttctgtgtcgtagccccctttttgccagaagagggctttttggccactggtccagtgtcatccttgatcttcttgagccgggccttgttctttggtggaatggagaaggtgagggagttcttgttgaactcaagcgggaagacacctacatctccatcaaagcggttcttggacacctgcagataccgtttccctggcccggttaccagcttcctgtcctgcaggatcagaacattgtctgcttcctggcttgcctggggaacagggggcagaaggaggaaagcaggagtaagaggacatgagcaaagcagaaaggggggctgacagggcagggaggagtgataagaatggggagaggggctgggtacaatggctcacgcctgtaatcccagaactttgggaggccgagtcgagtggatcacgatgtcaggaaatcaagaccatcctggctaacacggtgaaaccccatctctactaaaaatacaaaaaattagctgggcatggtggcatgcacctatagtcccagcttcttgggaggctgaggcaggagaatcgcttgaatccgggaggcggaggttgcagtgagccaagattgtgccactgcactccagcctgggcaacagagcgagactccgtctcaaaaaagaaaaaaaaaaagagaaagaatgggagagggaaaagtacttccccccatgaccaaagctctttgaactactgaccacgatgctggggccactcaaatctttcagttccctgacaagcttgctactgtttcagacgctgcctgtgctgttccctctccttctccacagcgggccaccccactcaacctcagcttcttctcttttaggtctcagtctaaatgtcacatctcatgaaggagaccattctttttttttttttttttttttttttaaagacagggtctcagctgggcacggtggctcacgcctgtaatcccagcactttgggaggccgaggcggacggatcatgaggtcaggagattgagaccatcctggctaacacggtgaaactccgtatctactaaaaaaatacaaaaaattaggcgggtgtggtggcacatgcctgtagtcccagctacttgggaggctgaggcaggagaatcacttgaacctgggaggtggagcttgcagtgagccgagatcgcgccactgcactccagcctgggtgacaaagcgagactccgtctcaaaaaaaaaaaaaaaaaaaaaaaaaagatagggtctcactctgctgcccaggttggagtggagtgcagtggtgtgagcacggctcactgcagtctcaacctcccaggctcaagcaatcctcccacctcagcctcctgagtagctgggaccaaaggtgcatgctaccatgcccagctaatttttaaatatatatatattatatatatatattttttgagacggagtctcactctgtcacccaggatggagtgcagtggcgcgatctccgctcactgcaagctccgcctcccgggttcacgccattctgcctcagcctcccaagtagctgggactacaggtgcctgccaccacgcccggctaatttttttttttttttgtatttttagtagagacagggtttcaccatgttagcaagatagtctcgatctcctgacctcgtgatccacccgccttggcctcccaaagtgctgggattataagcgtgagccaccacgcctggccaattttcaaatatttttgtagagacagggtctcactacattgctcagattgccaaactcctgggccccagcaatcctcctgcctcagcctcccaaagtgttgagattacaggtgtgatccactgtaccctgccatttttccacttctgcattactctctttcccagctccatgtttgttccatcatggcacatgatttgtgctccttgctctgaattccctaggcccagcccaggcctcgtatgtaataggcattcagtgtaacactagaagctccaggattgggctggtcctgatgcccagaaggccctcacatttatctgattgtctaatacccattgtctaccaaacctcaacccaacctttgttgtcacctcctctggaagtctcccagatgtcccgggctgactcagacatcttttctctttgctctccaaatacttgtgctgcctatcatactcttatcatactgaattgcaatcactgtcttactgtttccccaggagaggatgtgagctcctgggggacaagaagagcataagaaccaactatcagcctttgtatttccagcacatatattcctcatgtcatggccccagaggcattgcctcctgcctgttcggatggacagtcaagacgattaaggctgaatgagggctgtccctggtcacacctacccactctattttccaaagcttgagctccgctaaaggccactcactttggctgagccaaaaatggacgctgtctgcagttccttgtcatcatcctctttccgggggtgaatgaccagtgtcacatggcagttattgtctgttgcaaacttccgaaagaccccgatgatgtagtcttgagctgcgatcctacgccatcccaacaacacaaagagcttatcagacacagaaggacaagaacatacacatactcttgatccattcacatctccccacaaactaccacaacccactctacctccctctacccaaggactcacactcagatccctgtccatacatcctgctgccataccccacacctccatatgatacacatgggggtggtacgtgcctgcacacatctcagaaaataggagagcacagcatgtgtgcctagaggccagctgcctgagaagtgtgtgttgtatgtccaagcgggctcaagctagacaagagaggatgtcaccgtcacctgtctgtggacagctgctcgtgacccatcatgaactgcaggttgtcgatgatcacatgacaaatgtcatagacgtagactgcatgttgcattgtatctattacagtcctgggaagaggaaaggcaaggaatttgacaagttgtctctagaccaccccaggcagaagaactagcatcctgaaaactctcttggctgcctcctctgcccttctattattattactattatttgagacaaggtcttgctctgtagcccaggctggagtgcagtggtgtgatcacagctcactgcagccccaacctactaggctcaagcgatcctcttactttagcttcttgagtagctgggaccacaggcatatgccatcaccatgcccagcctaatttttaaaaatttttttatagagaggggtggtctccctatattgcccaggttggtctcaaatccctgggctcaagtgatcctcccacctcagcctcccaaagtgctgggattacaggcgtgagccagtgtgtccagccctgccctctcattctttgaaaaactccaaacctaaggagatgggggagttcctactggagctggaaaaggaaccaaaggttcctgagtgctgggatatgtctgggaaagcaaggtggctggaatctgggagtctcacctgatgctttgctgtccatggaaagtcatgaaatagaggggcaggtcctcaaagcggtcagcccagtgatcatatttgtccagttgatcttccagccgcccctcggcaaactgtgtcagcatgacccgggctagtctcacattgctgatctcgaagctaccccacagtgtgttcaccccctgggaacacaaatccagggcatactcactgatgaatgtcgtctttccactgcctgttggccctgcagtggggtggaacagacctgggtgaggaggaagtcctacccttgaaaccaagacataggtcagggctttaaaactggggggaaagggccaaccttcttttcaacattgtcatggcccaaacccacttgcttttgtcacctgatcttctgcccctttactctaagtagtgatttctcaaagggttacctgtgaagaccgtcagctcgccctttcgatgtcccttcaagatacgattgaggtctggaaagcggctccagcggaggccagctgcttgctccacatttgacagttctcctagcacctcctcccgaagctgccggaaagatacgatggacttgtgccaggcaggcagggcggtacgaagaatacgagaaagattgaagcctccgttcagggcctccaggggacggggttgctggtctcctggtcgcaccaagaagcatcgtttggggttcagttttcgtgcaaacaacttggcggcttcccaggaccgaaggtcatcccccaaccagaatacaatccgccggaactgttccaggtaagggagtaaggcagggggtaagcaggtcgttcctcggggtagagtaagggtaggcagccccgtggactggttcaaggccaggctgtcaagctcacgactcgtcagtaccacctcagcatctcgacgactaatcagtggtaatccaaacagattgtggtaggcgctgggtcggggaatagtggtttcctcgtagctcactccatccccctggcatttagcctctaggagcttcaggcctcgtaatcctgagcccccaggggagaaccaagggaagacaagactgcgagcaggtcgcagatatcgcacactgaaacgcttgagtgtgtcatctgtaaccttggtaaggccaaacattgtatcagccagctgaacctcctcctgatcaggcagctcccagagaggtattgctcggttccagatcctccggacctcctcgctgtcctcaaattctggtgccttgctaagcagaaacccctccctggccccatcccctcgcccctccacgctggcctggaagtcttcccagctcccttctgctaggctggtcatgcagagaaagtggcctgtggtcttgtcaatgaagaggctgaaggaagtggtaacaccagtctggcctttgagctgtgaagactctgcaaaggggctcagtgcccgcaggcaactgtgaccatcctggaaggggatcccatgcccccgcaaatactggcggatttcagttgcagttacaggcaacactggcatatccaaggcttggagagtctccttcctgtaacgtctgcgaggagggcctggggccaagtttcggggcaggcccctccgacccatccactccccacgcaggggtaacaagatacggagggggtacccacttcggaggaggacccacattcctagccaaatgtgggaagtcactacttgaaatgccttaggtgcctggttagcgtgccttcactagaccaaactctagggatatcccacgcagcactctgcagagctcactctaggtgcattctttctctccatgaatttctcctcttcagcccctctacgttgctgcttcacacatatgcccatctacacgaccctttcgcgtccacgtccttctacaatggctcccccacctctatggtccgttagttagtttctctccgccacctcacctctatgaccctctatacagttcctcactgacacagtttctttgcatcatcttctcacctctactgctcctccacagcatctcctcgtcgtcctcatttctatagtcatctgcatcctttttgtagtccctttgccctaggccccgactagagaccctcttccgcttctccttcccctcactgggacctcaacacggcgagagcacccagcacgactcccgccaatcccccggcccaaaggaatgccagtctctatcctcccccgtgtcttcactccgctctactactccgagctccgccgcgccggcccccagccccaggttaccacttttctctctcccacttcgccggcaacgtgagtctcccgca

SEQ ID NO: 10442 - DNA, 336 bp, Homo sapiens
gcaactttacaaagtccaggaccagggatggcaagtcttgggatgaattgtagccttggctgcgcaatgaatctgtgatacactggcgtgggggacgaaggtggtgaacctcgggactccaccacctgcctgccctctccacaaggccagaccctttgacccttccctgggctctgtctactcagcactggccccaggcctgggcactcaccgagccaggccggggctcaggcaccccaccctcatagcgaccccagcgccgggaaccatcctggtattccatatagggtcctgcaaagacagcctggatctctgccaggtcatagcggcagatgg

SEQ ID NO: 10443 - DNA, 1012 bp, Homo sapiens
  misc_feature (905)..(905): n equals a,t,g, or c
ctttgagtccctggtgaggaagatctgcagacacctgttccacgtgctggcacacatctactgggcccacttcaaggagacgctggccctggagctgcacggacacttgaacacgctctacgtccacttcatcctctttgctcgggagttcaacctgctggaccccaaagagaccgccatcatggacgacctcaccgaggtgctatgcagcggggccggcggggtccacagtgggggcagtggggatggggccggcagcgggggcccgggagcacagaaccacgtgaaggagagatgagccccccgggccggacaggggcacacgtgtgcaaagagacggtggtgtgtgttctctcctgcatctgcgtgtgcacacatgtgctgggcacgcgtgtggtgaggtctgagagggccccgggctgcactggtgtgggctgcacaggcacagacgcagacggccccggccgtgtcctgtggccccctgtcggatggatgcgtgccgtttgtagagaagagcctttgggcccattcactcgttcagcagacacgcatgggactgatgctttgagttttcttctgtggggttttcctttctctggtctccgtgcagcccctgccctccctcgggtgctgctggcctcaaaggaggaactcgtggggggagggtgtgatttgcagacctgggtctctgctctgctctgggggtggggcttgctttcacagagaccctccttccctctcacccctcctctcccggcctcgcaggagtcttggctgttggcagctcagaggtgggggaggcctgtggtgtgaggtgccctgcactgctcctgctcctgtcaccccttcctgctgcctcctccatgcccaaggaacacccatggtgcagtcctcaggcaaggcanggacggggctgaggcctgcgtggagatgctgcaccagcggaaggctgagacccgcttaccttagttcatctgttcactcgtaataaaaagaattctctcaggtcaga

SEQ ID NO: 10444 - DNA, 256 bp, Homo sapiens
aggcaccccggaggctgccccgagagtgggggttggagcagactcgcccctcactgcctgcgagggtccacagccagcctgcaggtgccgtgggggcagcacataccctgtgtcactcgctcttcccagctgcctcagccccctgcctctccccgtgctggtggcggggaccctcaaatgtggctgcagtaagctggagacatcttctccgaagggctctgggccagcctgaaacagtggctctgccgcaggggcc

SEQ ID NO: 10445 - DNA, 3319 bp, Homo sapiens
agacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctggcggcctggccactctgaaagtctccctagggaagagtgggcctgaggcttgtcactggtcggaccttccgcacggtaaagctaagctagggcctccataagacctccataagatctcttcctttcatcccttccggctcagcctgcatactgaagggtcctagcctccctttcccccccagttattccaaggggataataaccctctgtttaggctgcttttcctgacagtagtggggctgaacctttgagcgtagtggctgggaaagcagggataggcctcagtattgggggtgaggctgaggaaaaaagaccctcacccagttatgttctccagatccagagcgctgacctacccacccaacccccagcccagtctcccagaggcccgcacaagagtaccagattggcttggctctagtgggctcctggagatgggcgctccctgtgctagagatttggctgtagacaccaggaagacccaacagtggcaattcaccagccacctggggtgtggggtcaggggagacgcagccttcattcctttgtgcttcttcctagcttaggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatggtgtgctctggtgtgggctctcttcttgggggtctgacatagtagcactgcccacccatcacctcacttcccactttcttctagtagaccccaaaccccaggcaaaggattctccaggcaggccaggcaccgtggctcacgcctgtaatcctaacactttgggagatgaagacgagtggattgcctgagttcaggagttcgagaccagccagagcaacatggcaaaaccccgtctctactaaaatacaaaaaattagcagggtgtggtggtgcatgtctgtagtcccagctacttgggaggctgaggcaggagaattgcttgaacccaggaggcagaggttgcagcaagctgagatcgcgccactgcacctccagcctgggcaacagagtgagattctgtctcgaaaaattttttttaaaaaaaggattctccaggcatattatcctcttttcttcccacttggggttgggaagaccacagacttccccgtgacctgtgacatttgccatgcccaggtgtggggctccagcccagcctgtttccttctccctctacacagctctatgttctatgatgaggatggggatctggctcacgagttctatgaggagacaatcgtcaccaagaacgggcagaagcgggccaagctgaggcgagtgcataagaatctgattcctcaggtgaggggctgggcagcggtcacagagcctacactaagcgtgtggaggtggacccagatgggatctgttgtcatggtgggggcttttgcggggggatctgggaggaacaaggaagcttcctgaagtagaggccctgagctgacccttactagcctctgtttccatggcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgca

SEQ ID NO: 10446 - DNA, 2397 bp, Homo sapiens
agctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaacggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaa

SEQ ID NO: 10447 - DNA, 268 bp, Homo sapiens
cccagcactttgggaggtcgagtcgggcagatcacaaggtcaaaagatggagaccatcctggccaacatggtgaaaccctgtctctactaaaattacaaaaattagctgggtgtggtggcacgtgcctgtagtcccagctactcgggaggctgaggcaggggaatcgcttgaacccaggaggcggaggttgcagtgagctgagattgcgccactgcactccggcctggcgacagagtgagactctgtctcaaaaaaaaaaaaaacaaa

SEQ ID NO: 10448 - DNA, 2846 bp, Homo sapiens; identical to SEQ ID NO: 9550

SEQ ID NO: 10449 - DNA, 857 bp, Homo sapiens; identical to SEQ ID NO: 9551

SEQ ID NO: 10450 - DNA, 5973 bp, Homo sapiens
gaacaaagagtagaagatgtccgacttattcgagagcagcatccaaccaaaatcccggtaggtagtctcaggcctcggtttcagtcatgaatgtacgcagaggagagcaccgcataagtgcatccacttgacgggtttttacaggaatcaccagacagccaaaccctgggtgtcagtttcacaacctagagagaggtatcctttttttaagagacagggtctcactctctttcccaggctggagtgcagtggtgcgatcgtagctcagtgcagtctcagccaccttgtgctcaagcagtcctccctcctcagcctcctgagtagctctgactagaggcacacaccactacacctggctaattttttaagttttttgtagagacagggtcttgctatgtttaacaacccaggctgatctcaaactcctgggctcaaatgatcctccaccttgacctctcaaagtgttgggattataggcatgagccactggctggcctcaggtgccaagatttctgtactgcctctaatttctgctaccacttaaactcaggcaggtggagcctacacactgatatttccttgtggatatcacacttcagaacgtgtccgctagataaagctctcaaacttaccaaggaaagtgatgacagcttgactcggccttacacagaaccctatgtaggtctcacacaatagaacaatgtacaaataagcatttttctttcccaaagaagcatgtaaagatttcccattcctgccactcaacttctctttgttgtgacagggtggaagaattactgtatatagaaaagatgtccgcagcgttcagtaaacacagacactaatgagactcagaggctcatctgtggtcaggtattataacagcttaaaactaaaaaaaaacaaaatattttgctccatggaaaggaagcatagtgaggagccaatggattatttatttatttatttatttattttgagacggagtcttgctgtgtcgcccaggctggagtgtagtggcgcgatctcggctcactgcaacctccgcctcccaggttcaagtgattctcctgcctcagcctcctgaatagctgggactacaggcacgtgccactacgcccagctaatttttgtatttttagtagagacagggtttcaccatgttggccaggatggtcttgatctcttgacctcatgatccgcccacctcggcctcccaaagtgctgggattacaggcgtgagtcaccacgccggcctgatggctttatttaaattcataatatgaaactatatgtgttccctgtgtagttcaaatacgtgtgtgtgtgtgtgtgtgtgtgtgtgtgtgtgtgtgtgtgtataaaattttttttttttttttgagatgcagtctcgctctgtcacccaggctggagtgcagtggcgtgatctcggctcactgcaagctccacctcccgggttcacgccattctcctgcctcagcctcctgagtagctgggactgcaggcgcccaccaccatgcgcggctaattttttttgtatttttagtagagacggggtttcaccatgttagccaggatggtctcagtctcctgacctcatgatctgcctgccttggcctcccaaaatgctgggattacaggcgtgagccaccgcacctggcctcaaatatttgtatttttaacctcatttaaagaaatatgttatcagaatgaaagtaccaggtcattatgcacaaaactttgtctctagaaccagctaataatggactctacttgccttgtcaaatataattttttcatgtcaactagacagtctctagtgtggaaaaacattgagcatattactataattaggaacttacacatttattaaaacacaggcatttactttttttttttttttaatggatgaaaggtttttatgtttcccaggtgggcctggaacgcatagcctcacctccttatgcaccagaacaaccagcctgagtcaccgtggctcccaaaacacatgcatttactttcattagaacttcagctggccggacgcggtggctcacgcctgtatcccagcactttggaaggccgaggcgggtggatcacgaagtcaggggttcgagaccagcctgaccaacatggtgaaaccccatctctactaaaaatacaaaaattagctgggcgtggtggcgggtgcctgtaatcccagctactcaggaggctgaggcaggagaattgcttgaacccgggagtcggaggttgcagtgagccaagatcgtgccactgcattccagcctgggcgacagagcaagactctgtctcaaaaaaaaaaaaaaaaaaaaaaaacttcagccatgtctcaggatatggtagttttggaattgagagtttcagatgttttgtgcttgaagctggttcccagcctctctgcctcggtaaggcttgaggtctttttctgactaggtatgtatttttcatggttccaaaactgaaacagaatgaaaggatacatagccaagtatcttcccccacttcctacctgacggcagacatattgtctctcttgtactatattttgtaaggggtagatgtctaagctagcaaatgatcactcttcacaggagagctatgaggaaactagtgaatgtgctgtttcaaagcccattttggcatgtgccagttagactgtaggaggcattttgtatatttttaattgttgatgactattttatttatttattggagacagtctagctctatgccctaggctggagtgcagtggcgcaacctcagctcactgcaacctccgcctcctaggttcaagcttgtctcagcctcccgagtagctggaaggcattacaggcacctgccaccacacctggataatttttgtatttttagtagagtcggggttttgccatgttgaccaggctggtctcgaactcctgacctcaggtgatctgctggcctcaccctcccaaagtgctgggattacaggcatgtgccaccatgcccagcctgatgacttttttttttttttgagatggagtctcgctctgtcacccaggctggagtgcggtggcgcgatctcggctcactgcaagctccacctcccgggttcacgccattctcctgcctcagcctcctgagtagctgggactacaggcgcccgccaccatgcccggctaatttttttttgtatttttagtagagatggggtttcaccatgttagccagggtggtctcagtctcctgacctcgtgatgtgcccgcctcggcctcccaaaatgctggggttacaggtgtgagccaccgcgcctggccctgatgactattttaaaatcacttctggcttcttttccaggtgataatagaacgatacaagggtgagaagcagcttcctgttctggataaaacaaagttccttgtacctgaccatgtcaacatgagtgagctcatcaagataattaggtattcagtcacctttgtttcataatatatttcctttgagtaacttcttattctttatgaaacttacagttaaatctttagttctggttaaaatctttaaaaaatatttttcagctgaattcagttctgattcagttatgattaaaacaatttcaacttaaactataaaatgtttctttttttgaggttttatattacttgctagactgcagagcccgtttctttcatcataacatcgtttagatgtttcctgtttaaaatcagtgttacaagttattaaggtattgtacagcaaagctagttaaagagaatgtagactctgtgagtggcagtaaatggcacaggcttagatcttagaatagttcagaaactgtatttgaactgctttcttatattagacagtttaacagctgttcagacagtatactagtttaaaatcagcctaatatgtaatctttcagtgattatagctcatgtcaatataatcaaaggaagtgtcctgtgctttatgagaagtattggattcaagagcatttagaacatttttatattttaccgatcagagtgggtgatattttaacacatgcttcatccttcttgtattgttgtcaatatttcttcacgttgttttctttcaatagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaagcccagt

SEQ ID NO: 10451 - DNA, 5975 bp, Homo sapiens
gaacaaagagtagaagatgtccgacttattcgagagcagcatccaaccaaaatcccggtaggtagtctcaggcctcggtttcagtcatgaatgtacgcagaggagagcaccgcataagtgcatccacttgacgggtttttacaggaatcaccagacagccaaaccctgggtgtcagtttcacaacctagagagaggtatcctttttttaagagacagggtctcactctctttcccaggctggagtgcagtggtgcgatcgtagctcagtgcagtctcagccaccttgtgctcaagcagtcctccctcctcagcctcctgagtagctctgactagaggcacacaccactacacctggctaattttttaagttttttgtagagacagggtcttgctatgtttaacaacccaggctgatctcaaactcctgggctcaaatgatcctccaccttgacctctcaaagtgttgggattataggcatgagccactggctggcctcaggtgccaagatttctgtactgcctctaatttctgctaccacttaaactcaggcaggtggagcctacacactgatatttccttgtggatatcacacttcagaacgtgtccgctagataaagctctcaaacttaccaaggaaagtgatgacagcttgactcggccttacacagaaccctatgtaggtctcacacaatagaacaatgtacaaataagcatttttctttcccaaagaagcatgtaaagatttcccattcctgccactcaacttctctttgttgtgacagggtggaagaattactgtatatagaaaagatgtccgcagcgttcagtaaacacagacactaatgagactcagaggctcatctgtggtcaggtattataacagcttaaaactaaaaaaaaacaaaatattttgctccatggaaaggaagcatagtgaggagccgaatggattatttatttatttatttatttattttgagacggagtcttgctgtgtcgcccaggctggagtgtagtggcgcgatctcggctcactgcaacctccgcctcccaggttcaagtgattctcctgcctcagcctcctgaatagctgggactacaggcacgtgccactacgcccagctaatttttgtatttttagtagagacagggtttcaccatgttggccaggatggtcttgatctcttgacctcatgatccgcccacctcggcctcccaaagtgctgggattacaggcgtgagtcaccacgccggcctgatggctttatttaaattcataatatgaaactatatgtgttccctgtgtagttcaaatacgtgtgtgtgtgtgtgtgtgtgtgtgtgtgtgtgtgtgtgtgtataaaattttttttttttttttgagatgcagtctcgctctgtcacccaggctggagtgcagtggcgtgatctcggctcactgcaagctccacctcccgggttcacgccattctcctgcctcagcctcctgagtagctgggactgcaggcgcccaccaccatgcgcggctaattttttttgtatttttagtagagacggggtttcaccatgttagccaggatggtctcagtctcctgacctcatgatctgcctgccttggcctcccaaaatgctgggattacaggcgtgagccaccgcacctggcctcaaatatttgtatttttaacctcatttaaagaaatatgttatcagaatgaaagtaccaggtcattatgcacaaaactttgtctctagaaccagctaataatggactctacttgccttgtcaaatataattttttcatgtcaactagacagtctctagtgtggaaaaacattgagcatattactataattaggaacttacacatttattaaaacacaggcatttactttttttttttttttaatggatgaaaggtttttatgtttcccaggtgggcctggaacgcatagcctcacctccttatgcaccagaacaaccagcctgagtcaccgtggctcccaaaacacatgcatttactttcattagaacttcagctggccggacgcggtggctcacgcctgtatcccagcactttggaaggccgaggcgggtggatcacgaagtcaggagttcgagaccagcctgaccaacatggtgaaaccccatctctactaaaaataccaaaattagctgggcgtggtggcgggtgcctgtaatcccagctacgtgagaggctgaggaacgagaatcgcttgaacccgggaggtagaggttgcagtgagccaagatcgtgccactgcattccagcctgggcaacagagtgagactctgtctcaaaaaaaaataaataaaaaaaaaacttcagccatgtctcaggatatggtagttttggaattgagagtttcagatgttttgtgcttgaagctggttcccagcctctctgcctcggtaaggcttgaggtctttttctgactaggtatgtatttttcatggttccaaaactgaaacagaatgaaaggatacatagccaagtatcttcccccacttcctacctgacggcagacatattgtctctcttgtactatattttgtaaggggtagatgtctaagctagcaaatgatcactcttcacaggagagctatgaggaaactagtgaatgtgctgtttcaaagcccattttggcatgtgccagttagactgtaggaggcattttgtatatttttaattgttgatgactattttatttatttattggagacagtctagctctatgccctaggctggagtgcagtggcgcaacctcagctcactgcaacctccgcctcctaggttcaagcttgtctcagcctcccgagtagctggaaggcattacaggcacctgccaccacacctggataatttttgtatttttagtagagtcggggttttgccatgttgaccaggctggtctcgaactcctgacctcaggtgatctgctggcctcaccctcccaaagtgctgggattacaggcatgtgccaccatgcccagcctgatgacttttttttttttttgagatggagtctcgctctgtcacccaggctggagtgcggtggcgcgatctcggctcactgcaagctccacctcccgggttcacgccattctcctgcctcagcctcctgagtagctgggactacaggcgcccgccaccatgcccggctaatttttttttgtatttttagtagagatggggtttcaccatgttagccagggtggtctcagtctcctgacctcgtgatgtgcccgcctcggcctcccaaaatgctggggttacaggtgtgagccaccgcgcctggccctgatgactattttaaaatcacttctggcttcttttccaggtgataatagaacgatacaagggtgagaagcagcttcctgttctggataaaacaaagttccttgtacctgaccatgtcaacatgagtgagctcatcaagataattaggtattcagtcacctttgtttcataatatatttcctttgagtaacttcttattctttatgaaacttacagttaaatctttagttctggttaaaatctttaaaaaatatttttcagctgaattcagttctgattcagttatgattaaaacaatttcaacttaaactataaaatgtttctttttttgaggttttatattacttgctagactgcagagcccgtttctttcatcataacatcgtttagatgtttcctgtttaaaatcagtgttacaagttattaaggtattgtacagcaaagctagttaaagagaatgtagactctgtgagtggcagtaaatggcacaggcttagatcttagaatagttcagaaactgtatttgaactgctttcttatattagacagtttaacagctgttcagacagtatactagtttaaaatcagcctaatatgtaatctttcagtgattatagctcatgtcaatataatcaaaggaagtgtcctgtgctttatgagaagtattggattcaagagcatttagaacatttttatattttaccgatcagagtgggtgatattttaacacatgcttcatccttcttgtattgttgtcaatatttcttcacgttgttttctttcaatagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttagggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaagcccagt

SEQ ID NO: 10452 - DNA, 535 bp, Homo sapiens
agtggccaacctcatcatctagggaactctgagcccagctcccgtttaagtaggcacctaaaagtctgttgaaaaatacaagggagtgacctgagaaaactgccttcccaggccagctgctcaatagaagcgtctgcgtcccttgtcccgtcttcggagctccccgtgggtgctgtagccccactcacttccctgacatcaccagagcacatgctcagtatgttgccacctcccaaatccagaagggtgtggtcttagatgccatggaagcgattctgtacaatgccgagtcagtcacaggctgatgtggcagctggtggcttgtgtcactgtgtcacccacctccgcagcaggcctgctccctccctgggaaagagctacttcagggtagggccacattgccaaggtatcttgagatccattcatgccaactttcattttcatggaaactcgtgaactcgtgctggaacatctttaaccccaaatcaggaatttacgtctttgttattagcagggacacttaaaaaaaaaaaaa

SEQ ID NO: 10453 - DNA, 535 bp, Homo sapiens; identical to SEQ ID NO: 10452

SEQ ID NO: 10454 - DNA, 803 bp, Homo sapiens
gccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtgaa

SEQ ID NO: 10455 - DNA, 805 bp, Homo sapiens
gccccagtccagcctacagcttccccagcattctagccttggagaaatgacaatggccacacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctaaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtgaa

SEQ ID NO: 10456 - DNA, 837 bp, Homo sapiens
ggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggagg

SEQ ID NO: 10457 - DNA, 835 bp, Homo sapiens
ggctggtagagtgatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggctgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcaggaagcagtgctgggagga

SEQ ID NO: 10458 - DNA, 1849 bp, Homo sapiens
ggggaatacgggctgtcagcaagacgctgcaggggtcaaggaggagagcaatgaaggacaggaagcagtgggcattcaagactcgctggccttttttccattttctcatgctttctttggcacttgactgctacaggtttttaacttcctgaactgtaccgtccatcatggaaggctctcctcacttactaaggctaaaaacacaggctccatagcctcttcattttatcacactaatggtcgaaaggttcttatcctattttgcatttgtttcttgaggggaacttgagaagcaaaactctggagccatgctccccaggtgcaaatctgagctctaccactccctgctctgtgaccatgggcaagtcacttagcacgctatgcctcagattcatttttaaaattaggatggtaatactagtatcttcacaagattttatgaggattaaattagctgttgggcactgttgtggttaatttcaggtgtcaacttggctaagctaagtgatacccagatagctggtaaggcattacttctgggcgtgtctgtgagagagtttctgcaagacattagcatttgattcagttgactgagtaaagaagatcaccctcactgatgtgggtgggcagcacacaatccattgagggcccagatagaaagacagagtgaagggtgaattccctctctgcttaaactgagacatccatctcctcctgccctcagatatcagtgctcctggttcttgagccatcagatttgaactgggacttacactgttagcccctcaccccagtttctagccttaaggtctaatggaatttgactgtcagtcctgtctttcttttgatttctcccttttggaatgggaatgtctatcctatgcctgtcccccactgtattttaaaagtgcataactcgttttgtttaacgggtttatagctggaggggaatttggcctcagaatgaatcatatcttaggtcccacccagatcagatttagacaatatttagatgagactttggacttagattttaaggttgatgcttgactttaaatgctattaggatggaacaaatgggaggacataaattttgagaaaacggggcgaatgctatagatggaatatttttgttcctccaaaattcgtatgttaaaacctaatccccaatgtgatagtgtttggaggtggagtcattggggggtgattaggttttgaggatgaaaccgtcatgaatggaattcatgcccttataaaagggaccccagagaacttccttgactcttacacagcaagaaggcagccatccatgaaccaggaagaggaccctcaccagacagtgtatgtgccagcactttgatctaggacttcccagcctctagaactatgataaatacatttctattatttataagccacccagtttatgatattctattaaagccacctgaacaatgtaaggcaggaacatgataaatgctcagtaaatgttaagggaaaaaatcctccttgaaaacataacacatttattcagcatatgtctgataaaatccttgtagtatggagttgatatcagggttgtgcagttcatctccgtcctcacaccatgtccagcggcttcctgaagactctgcacagtgacttctatgtgaactgaagcctgtgccacagtcaatacttaggaggtgatggtgaaaaacggtcatggttctgaaaataagccatgcatttgtatgttggaaatcttccctttgcataactggaaaacaaatctatgagtttttcagcaaaagtggagacataaaaaaatcatgcgggcctaaataaattaaaaatcaattaaaggcaa

SEQ ID NO: 10459 - DNA, 1849 bp, Homo sapiens
ggggaatacgggctgtcagcaagacgctgcaggggtcaaggaggagagcaatgaaggacaggaagcagtgggcattcaagactcgctggccttttttccattttctcatgctttctttggcacttgactgctacaggtttttaacttcctgaactgtaccgtccatcatggaaggctctcctcacttactaaggctaaaaacacaggctccatagcctcttcattttatcacactaatggtcaaaaggttcttatcctattttgcatttgtttcttgaggggaacttgagaagcaaaactctggagccatgctccccaggtgcaaatctgagctctaccactccctgctctgtgaccatgggcaagtcacttagcacgctatgcctcagattcatttttaaaattaggatggtaatactagtatcttcacaagattttatgaggattaaattagctgttgggcactgttgtggttaatttcaggtgtcaacttggctaagctaagtgatacccagatagctggtaaggcattacttctgggcgtgtctgtgagagagtttctgcaagacattagcatttgattcagttgactgagtaaagaagatcaccctcactgatgtgggtgggcagcacacaatccattgagggcccagatagaaagacagagtgaagggtgaattccctctctgcttaaactgagacatccatctcctcctgccctcagatatcagtgctcctggttcttgagccatcagatttgaactgggacttacactgttagcccctcaccccagtttctagccttaaggtctaatggaatttgactgtcagtcctgtctttcttttgatttctcccttttggaatgggaatgtctatcctatgcctgtcccccactgtattttaaaagtgcataactcgttttgtttaacgggtttatagctggaggggaatttggcctcagaatgaatcatatcttaggtcccacccagatcagatttagacaatatttagatgagactttggacttagattttaaggttgatgcttgactttaaatgctattaggatggaacaaatgggaggacataaattttgagaaaacggggcgaatgctatagatggaatatttttgttcctccaaaattcgtatgttaaaacctaatccccaatgtgatagtgtttggaggtggagtcattggggggtgattaggttttgaggatgaaaccgtcatgaatggaattcatgcccttataaaagggaccccagagaacttccttgactcttacacagcaagaaggcagccatccatgaaccaggaagaggaccctcaccagacagtgtatgtgccagcactttgatctaggacttcccagcctctagaactatgataaatacatttctattatttataagccacccagtttatgatattctattaaagccacctgaacaatgtaaggcaggaacatgataaatgctcagtaaatgttaagggaaaaaatcctccttgaaaacataacacatttattcagcatatgtctgataaaatccttgtagtatggagttgatatcagggttgtgcagttcatctccgtcctcacaccatgtccagcggcttcctgaagactctgcacagtgacttctatgtgaactgaagcctgtgccacagtcaatacttaggaggtgatggtgaaaaacggtcatggttctgaaaataagccatgcatttgtatgttggaaatcttccctttgcataactggaaaacaaatctatgagtttttcagcaaaagtggagacataaaaaaatcatgcgggcctaaataaattaaaaatcaattaaaggcaa

SEQ ID NO: 10460 - DNA, 299 bp, Homo sapiens
ccaatcctttttttttttatttttatttttttgagacggagtctcgctctgtcgcccaggctgcagtgcgttggctcgatctcggctcactgcaagctccacctcctgggttcacgccattctcctgcctcagcctcccgagtagctgggactacaggcgcccgccacgacgcccggctaattttttgtatttttagtagagatggggtttcaccgtgttagccaggatggtttcagtctcctaacctcgtgatccacctgccctcagcctcccaaagtgctgggattacaggcgtgag

SEQ ID NO: 10461 - DNA, 252 bp, Homo sapiens
tttttttatttttatttttttgagacggagtctcgctctgtcgcccaggctgcagtgcgttggctcgatctcggctcactgcaagctccacctcctgggttcacgccattctcctgcctcagcctcccgagtagctgggactacaggcgcccgccacgacgcccggctaattttttgtatttttagtagagatggggtttcaccgtgttagccaggatggtttcagtctcctaacctcgtgatccacctgcc

SEQ ID NO: 10462 - DNA, 12593 bp, Homo sapiens
tgtacctccagaaaacattatttacataagtccttgcaagcaagtgtctcagataaagtatgcggcaaaagttggagtgaatatcctgacatgtgacaatgaaattgaattgaagaaaattgcacgtaatcacccaaatgccaagtaagtataaaattaagtacttgaaaatattatttagcacttagagggttgggtttgtcttttgtctgggaagaaaggagcatttgtggtagggcaatgatgtgtatcataattataacttatttaaagggcctctgtgggaaacactagtaacattttattggctctctacctctgatccttcatgtggaattggaatttaaaaaaataagagcagtttggggatatgatctaataatcttcaaggaatccttgatagttggtgtgataatcaaattagggccatggctgtattttcattatttctataactttgtttgatgtttgataacgttaggaacaggataaactttggtcagcattttttcctgtttagctgaggatttaatctaccctaggccatagttcttgaatggtcatctttactgacagtgtcttcgaagcctagaccatagatttggggggttttgtttttaaggctaatacttttatttttgaacatgaagtttaattttttacttgcatcttcatgtatccagagaattttttttttttcttgattagaaagtttactttttaaaggctgggcgcagtggctcacacctgtaatcccagcactttaggagactgaggctggtggatcatttaaggtcaaggtggcctgcgcctgtaatcccagctacttgggaagctgaggcaagagaatcccttgaacccaggagccggaggctgcagtgaggcaagatcgagccactgcactccagcctgggcaacagagcaagactccctcataaaaaggtttacttttttaaaagcaaaaagatttaaggcaaattttatgttttcacaaactggtatatcgagagggcttaagaatatactaaaagcatattgaattatgcagttgttggcttactttttaatgagttatgtgtgtttccggaaatgaattctatctgtattttctttgtatgtctataattttcatactgactttaatggtgtacttaagatatcctgacagcattgattactctggtaaatctttgtgtggataaaagccttgttgggaaaattctagggaaccacttgtttttctaaaaaatattgttctgtgatcctctgaagacaagctgtgatttgtgatgtttagtatgttagattgtggactggcatcttcttgatggagctgattctaaccttagaataatttttgctttcatcaatcttgtcctctgattatcaaattagggccatagctgtattttcatggccatattattaaccttcttagtttatgtaattattacatccataggaaaacagttacacaaaaagaatttgtatattttcaacttctagcagtttgtaattactcagctcctgaaattaaagaaatttaatcagttttagtcatcttgtcttggttgccatggtttggaaggaaataccaaatagatttgaatcagtagactagaaggctgctgtttaaacacatgaaataattttttaaaaagctttctgggttgggcgcagtagctcatgcctgtaatcccagcacttggggaggccgaggcgggtggatcacttgaagtcaggagtttgagaccagcctggccaacatggtgaaaccctgtctccactaaaaataaaaaaaattagctgggcgtggtggtgcacccttgtatttccagctactttgggaggctgaggcaggagaattgcttgaactcaggaggcactctcatgaggcggaggttgcagtgagctgaaattgcgccactgcactccagcctgggcgacagagtgaaactccatctcagaaaaaaaagaaaaaaaaatttaaaaaatgcttcctatttttttccagttagagacctgctgggatgtaacaatgttagtaggaagaatgtttgcagtaaccatggaggtttagctagttagcacaatcaaagaaatttgaagacatttaaagccctgatatttttattgaaagacaatgatggcattgctattcaatttagtcttcctaggtggatttatggactgatggacttcatttgaaagtaatgtcgtctttcattacagagcccaaccaactcttgatgctacaacagagtcttaacttgctgcattttccaaaatcccatccttgtaagcttcatgctttaggccctaattgctagttttttctctatacaggattgtttttcattaggttcacttgattcatccgtcgctggatttgggagcactggcaacataatcaacacacttcctacaatcttcaggcttcacatgtgctgatgatgatgtaaaccaactctgccccaatcatctccccttctcttagggtcttactacatattgcaacagaagataatattggaggtgaagagggtaacatgaagtttggcactaccctgaagaactgtaggcatctcttggaatgtgctaaggaacttgatgtccaaataattggggttaagtgagtatttgttttaaacttttaaagctgtgaacattttatggtggtaacctgtctttctggttattgatttaagactttatttgcatgaaatctaagatgcaattttttctagtcttttaacacacatgtatgtgttttcttcttagtttaggcaaaacaacttaaatatgccttgtcccttttcatactgttttgtgactgtacctccttccccacagtaaaaagaatagcaaataatattttgattcagttagtgcagagtaacttaaatcgccgccttttaaattggatgggaggggatttgctagaattcttaatgaaaataaaagtgtcagacttttttgtccttttaacgattactctgggggacttcaataaattagactttgctttagccttttaattttatatgtgaggaaaccgagactccaagaggttcaaatacttgataatagcctcagaactaattacaggcatagtaacactaagccctagatgttatttgccagcccattgctacttttactaaagtaaaaaggtcttgctttttcaaacactcacaaagatgtattgtgtatctttctttaattttattatttattttttgagatagtatctcattctgtctcccatgctggagtgcagtggcacgatcacggctcactgcagcctcaaactcctggctcaagcaatcttcctgccttggcctcccaaagtggtgggattacagatgtgagcctctgtgcctggccttattgtgtatctttctatactactttgtacataaataggtggtagtcttttaaacaaagaatgggatcatgctgtgccttacacaatagataacattccatgtcagtctagttttaagttttaatttaagtcgacataaaaattaatgaagtactatctcgaatagatgaagggaaaagaagaatggactttacgggtacagttctatggattttagtacttgtgtgaccactgccacaatcaggaagtattctattctgaaactttatcactagtaatactagtgaataatagtaatgctgttactcagcttgattaatgttcatttgtatttatttcacaacagacacatttttgtatttggttgggtaaaattgaatgttcagttttatgctcaactgaatgtgatacgatttggtagtgcttgttacttcactatataaacataaaagtgccacatatacataaaagcacaccttattgtataaccgtggaacagtactgataattgacttattgttaagaatttttgtttatagaattacagttttatcttggcattgccttttctataaagctggtactgtaacttttgggtaattagaagctaatgcttctaatactttaaatatttggtaaagttaatggggatacttaatggtatgaatatgatgagtgacagttgaaagaaattacaggaggtgtctctacaactttctgctcctttaaatttagtattctatgtgtttcagatttcatgtttcgagtgcttgcaaagaatctcaagtatatgtacatgctctatctgatgctcgatgtgtgtttgacatggctgtaagttctttcttttaagttattttgatattttattttagccaggatgttaagttaaagactaagtattgttttctgcctgtgtgaattactctgactacattcaacgtgacacacacctcatttttattatataagcattcagagctctgtacagtcacaccttttaagcaggtaaaggagtgaaatagtaatttacttgcataagtctagaagagagtacaaataaaatcaaagagacagcatacctaacattgaataatctgtttctatcagtaaaaaaccaagaatttgctgtactaaagatcagaacagatatttacctccctaggagggggtttttaaaatgttctcatatccattacaatttggaaaaacatttaaattttttttttccatctctagggagaaattggctttacgatgaacatgttagacattggtggaggattcacgggaactgaatttcaattggaagaggtaaacttctcagtagatgacattaacagaataattgctttctttgttacttaagtggtggatgtgtagagcaggatttttacaatggcagaaactaaaccctataacatctctttaaaattatgttcttagaaaaggaataggcagttagtagacctagctaactttgaaaagtttgatagaattctttgaacattatcataaaacattttctatttcagttgtgtttctgtacttaatggcacaaatgatttaatacttagaaaacttcactactacctttttttttttttttttaaagtcttcctgtgttgcccaggctggagtggagtggcgcaattatagctcactatagcttccaactcctgggctcaagcgatcctcctgcttcaacctcccaagtagctgggacttaaaaaaaaaaaaaaaaaaattgagtctttctatattgcccaggctggtctcggaactcctggcctcaaatgatcctcctgtccccaagtgatcctcctgccccagcctcccaaagttttggggttacaggtgtgagccaccactcccagccaactttagcatttaggccagatacacgtcacacctgtttctcaccttcctgctctgccctccttccttctgtgatatctagaaactatgatttgaaaattttacttctgtttttagtgatcaagtatagaaaaatgacttaaaaaaaaaacaaaaacaaataccagtgggtatttgttattagagctatttttaaaattaatgccattctgatagttacaaaataaactgacttgaaagcatgcctaattaattgcttggagataactacaaagttgctaaggttcatgatctgtgattggaactgcttcattttcctagaaaattttgttaatatcaatctctgaatattgcgaattatctaatccaatattgaaaccatactgtggcatttaaaatccataggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggaggtaagttataaagtttatagttttatttttgttggtagataattgcagttagtctggaaatgagcagatggtcatgaagttgtaggtggttttcagcttttaaaaatcttaaaactggccgggcgtggtggctcacgcctataatcccagcactttgggaggcagagccaggtggatcacaaggtcaggagttcgagaccagcctggccaatatggtggaaaccccatctctactaaaaatataaaacttagctggtcatggtggcgcacacctgtaatcccggctactcgggagactgaggcacaaaaatcgcttgaatccgggaggcagaggttgcagtgagccaagattgtgccactggactccagcctgggtgacaagagtgagactccgtctcaaaaaaaaaaaaaaaatcttaaagccaaggtcccattccataagacttccaaatccaactttcttggtactgatgtttagatacgtgtgttttagataaatgtctagcagatgattaattctcatccattattcagaactacttttattgtgatcttttctgttctccttacctcacatgggtcacagggaggctctgttttcacactttctcacataagggccacaaagagtccctgtaatctaactcaagtcaaaccaacaaaaaggcactagacagtaccatcttgttggctaatattgtaggaaatactgttttacattaagaagacttttttttttggctgtggactaatccacagcccataggaaagttgtccatttccccaatattgtcttttttttacagctttgtttttccttgcttagaatccagtccaggaccacattgaattcgtcatttctccttgaatctagataaagtttctcagctcattactttgtattttttaactttgacatttttgaagagtagaaatttcatagctgatccttagtttgggtttgttggatgattcctcatgattaattttttaggctatgcatttggggcatgaagtccactaaagtgttactctgttcttctcacttcatcatgttaggaggcacatgatagtggccaattctaatattgatgatgctaggtgttttttcttgttgttttgtcgcccaggctggagtacagtggctccatcagggctcattgcagtctccacctcccggcttaagcagtcctcctaccttcaacctcttgcatagctgggactacaggcatatgccaccatgcctggctaggtttttttctatttttattttgtagagggtttcgtcgtgtttctcaggctggtctcaaactcctgagctcaagtgatccacctgcctcagcctcccaaagtgctgggattacaaacttgagtcaatacacctggccttatgattttttttttttttttttttgagactgttttgctcttgttgcccaagctggaatgcagtggcatgatctcagctcactgcaacctccacctcccaggttcaagcaattctcctgcctcagcctcccaagtagctgggattacaggtgcgtgccaccacacccggctagatttttttttttttttttaatttaaatgctagttttgagcacttgtttaaggttgtgtcaggcaggtttctttccattgtgaagtggcaagtttaaattagagactctgtaaactacctgtttttaaccagattttcaccccattagttttagcatctattgttgaatttctaacttcattattgtttatattagttggcctttacttaaagaatatcttttccttccctcctgtttatgagtttagactcatagatctttattcaataggtttatataatctgttactcttatttttcccttgacatgtctccattattctcagagcaattcgttattttttggtatatcaagatgttccaggctcattttaaccttttaaatgagcctcagtcccgtaatcagttgtttctccagggagccttggtttgttttcgtggagagtgatattttaaaaacctgaaaattagtattggttgtgctaagagtagagtagctgtgagtagaatgggcgttttcaaaggtttcaaagtgaggtgagaggatctattgatccctgaagctcgaggctgcggtgacctgtgatcacgctactgcactgtagcctgagtaacagtgaggccctgtctctacacacacacacagattcccactggcagtgtatacatgtgagctctggttgctcctcccgctctctgatgttttgtagtgtcagtctttaagttgatccagtcagtaggttggtggtaatggtagtccattgtggttttaatttgcatttacctgatgactaacgatgtagagcactgttttctttttctttttctttttcttttcttttttttttttgtttttgagacagggtttttgctctgttatccaggctggaatgagtggcacaatctcaacttttatttttaattctacattcaaacacatatttaactccttgtgcatatattgccttccccttgctgatttgaaaagaaactaaaaagtgtttttccttgctgcttcatttcctctttttttgaaacagcaactatcagaaagtcttctagaatcttaatacttttttcttttttttttttttttttgagacagggtctcattctgtcacccaggctggagtgcagtagcacagccttggctcactgtctcactgtcttactgtaacctccgcctcccggattcaagggattctagtgcctcagcctcccaagtagctgtgattacaggcatgcaccaccacacctggctaatttttgtatttttagtagagatggagttttgccatgttgttcaggctgatcttgaactcctgacctcaagtgatcctcccacctcagcctcacaaagtgctaggattacaggtatgagccaccgcatccagccctagagcactcttttcttgtgctcattggttatcttcctttgtgaaatgcgtgctctatgtgtctttttaagtttaaatagtttgagaaatgtgaaaattacattaatttgtttcatatgagccattttattaaaaattcattttcccctttcctgttttattccagtagaaaaaaccgaaagtgatgaaccagccttcatgtattatatgaatgatggtgtttatggttcttttgcaagtaaactgtctgaggacttaaataccattccagaggttcacaaggcaagttttatcagaaatatcaaaacctatttggcattttataagctgagctgttatttttaagatgcttcccagttttttgaaaaacatcttagaatggggaaaaatgtcctttttgaggatttgcgttcttctggtggagtcccttttttagtttgttgcctttacgtggagttaatggtaccattgaggcttaagtagcaccctgcccttggctctaggccttttttccatgagcacattggatctgagacagtgaaaatacttatttactcacaaattcaatacctgcgtaagtatgagtaaaaattaaattgtaaaacttttcctacagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtaaggtgattttattttaaggcagatgggatatttgaactgtccttttagacttgctaataagttttaattctgtaatgaatgctaaacttagaagtacagtcatgtattgcctatacagtgtagttacttaatgatgggaatttgttctgacaaatacaacattaggcgattgtatgatggcataacctactacataatctaggccatgtggtatattgatcctaggctacaaacctgtacagcatgttactctgtttaatactgttggcagttgtaatgcagtggcgtttgtgtatcttaagttacttaaacatagaaaggataatacattgtgctatgacatgattgctgcgatgtaacgaggtgataggactttttaaacttcactgtaattttacggtataccacagtcatatgtgtagtctttgaccaaaacatcactctgcagtgcatgactatcatagaaaaatgatgatcttttaaaggtttttggaagactagttataatcctgttttattatccatttgttatgtgattacgtggtctttgggcttaaactgagaatttagctgattttttttctacgtaggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataatgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaaaatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctatatgaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatcagcttta

SEQ ID NO: 10463 - DNA, 516 bp, Homo sapiens
cacgcctgtaatcccaacaattcaggaggctgaggcaggcagatcacctgaagtcaggagtttgagaccagcctggccaacatggtgaaatgccatctctactaaaaatacaaaaattagccaggcatggtggcgcacacctgtgccagctactcgaggctgaggcaggagaattgcttgaacctgagaggcagaagttgcagtgagtggagattgcaccaccgcactccagcctgggtgacagagcaagactccatctcaaaaaaagaaaagaaacacagtaatagtagaaacttaaattggcaggaatcaaaatgtaaaacaaaaattagtcttctacatttgagttgtgagtaaatcctatgaatcgcatccatcctgagaggaaaaaggtgtgatgcaagtaattacggcagcaggctttcataatgaggataaacctggcctaggaacaagcaacgaactagttctggtctttactggcatttgcattaagttaaagctaacctgaaaagt

SEQ ID NO: 10464 - DNA, 992 bp, Homo sapiens
aggaaaccttcctgagtttcagtttccttatttgtaaaatggagacaggagggaagaaagctaactcctgttgagtgcctgttatgttctcgggacagtgttagggaaatcagaggaattgttttatttaaagctgtccagtcctgcaaggtaggtataattggcctcatttaatagaccagaaaatggaggcaccggagcctaacaattttctcggccccacacagctggtaagtgatgaagccggaattcaaatctgggtcattctgactgcagagccaatgcgatttttatggtgccagcctgttgcctccgtgtggggctcataacttactccacagcggtgtcttattcaagttcgtccagaagcagatcctgagatagactacaagtagtttatttaggaagcctgggaaacatcagtcaggcagtcaggaaatgagacagggaatgggaggcagcccctgaaaaagtgtgttatcaattcaactaccactgtaagctattagagcttgttcacactggggaggctctgggaaccagtggagtgcatgtacctctgaattttcccatctgaggaaaaatccgagggagccaaggtatttatacaccaattcctgagagtagttaactgagggctacttctgggaggtggagtgttctaataatttgtaggtgcatatgttgtatcccgtgcttggcaaagtaggactctagcagcacaagaaagtcctcagcagagaaattcaggtgctggcagttggaagcaagccactgtgctctgaaatggtaaggacaaaggagtgggagggatgccgaaagcacctgctatggtggttttaagaattagaaacaggccgagcatggtggctcacacctgtaatcctagcactttgagaggccaagacaggcagattgattgagcccagaagtttgacactagcctgggcaacatggcaaaaccccatctctacaaaaaaaaaaaatacaaa

SEQ ID NO: 10465 - DNA, 551 bp, Homo sapiens
tcttcttgtataagtaaagagtagactggaagattttatgcaaattgctttcttcacttattgagatcttgcctctatcagtgtctgcatttgtgattcctttaataggagatccccatggattcttaaagtgaggaccattttgtggggcattttgtgagaagctatcagaaccctaaattaccactggtgaattgttttgacctgcctaaggagatttatattttaaaaaagaagacttgagaatcaaatttgtattctaattgggtgaccaaccatttctgtttacccaacactaagtaattttctgggacaagggacttttagtactaaaaccaggacaggttggtcactgtactgtaggtgaggtcacacatgggacctttcaaagttcaacctctgaaagattatgctcctgcaatataaacatatttcaaaatagcattgtattttaaaaatatcccaaatataaaggtggaaataaaaatagcttctttctagatttctaactgcaaaaatctgagtaagttgaacagaatgactttggtttt

SEQ ID NO: 10466 - DNA, 1412 bp, Homo sapiens
cttaacataactgtggttaccatgttggtatatgtgccttttagtcctttttcatacacaattttttttacaaagttataataataatttcttttcaaatttgtgccttatttcagttaacagtgtaaatgtttcccatttctaacaatgttttctcattgagtgaggtactgttaggttggtcagactgatagtttattgtacgtattgctgtaatatctttgtacatttagcttttccatgtttgtaccatatctttgggttttcagaagtctgtctctctctctgtttctctttttgtctgtcttttctatctctcaccttcatttggggagcattttgtgttctctttcacaggactaattaagttttattggatcttgaaaaacgggattagaaattttttcttacttatataattagaaaacaatgcttttggacttacattgccacggcagtttacacagttttattcccaaaaattgtagttttgtgactaggtgataaaaatgatctcctatatgtgccaaacttggtattctagacactcatacttaggatgtaaattgactgtagtccaataatttaatatgttgtgtttaattcttgtaatattttactcacaaattgaacttttccttaccaatttaatgtttgtaggcttaatttggcatctttgtcaggattattagacttctctgcattcttctgacttctccctaaactaatgtttagaactgaattgggtccagcaatttaagtggaaaatcagtatgactagagacttctagaaacttctggtgtcactgagatggtgaatttgatgattctgaccctacttgctcatctgtaaaagctattagaggattgttttaagcatttctattctatacaggtatatgtacaccatgtaataccactcagccataaagaagaatgaaataacatttttgcagcaatttgggtggagctgtaggccattattctaagtgaagtaactcaggaatacaaaactgaataccatatgttctcacaagcgggagctaagtcatgggtacgcaaaggcatacagaatagtaaaatagactttggagactgagacgcggggagaataggaagaagataagggataaaaaacgatatattgggtacaatgtatgctactttggtgatgggtgtagtaaaatctcagacttcaccactatacatttcatccatgtaacccaaaaccacttgtactccaaaagctattgaaataaaaaagatatttaaaaaaaaagaggccaggcaggttggttcacgcctgtaatcccagcactttgggaggctgaggcgggcggatcacttgaggtcaggagttcgggaccagcctgaccaacatggtgaaaacctgtctctactgaaaaaaaaaa

SEQ ID NO: 10467 - DNA, 360 bp, Homo sapiens
caaagaggtgccagcttgtgcacaaaatgagagaggagaaaagggtgggaggaggggccctggctctttttaacaaccagctcttgggggaacaaatagagtgagacctcaagcatgcctgaggaagagcattaatttattcttgagggttctgacccctccccaccatgcccaacaacatctcccattaggccccacccccaacattgagatcaaatttcaacaggagggacaatcatctaagtgatagcatagactcaggctatttactattctgttttcaagtatagattgagggcaacagcagcctttgttttctatgttgatggccaaaggtttatttttatattcttatactgt

SEQ ID NO: 10468 - DNA, 217 bp, Homo sapiens
  misc_feature (20)..(20): n equals a,t,g, or c
accagcctgaccaacatggnagaaaccccgtctctactaaaaatacaaaattagccgggcatggtggtgcatgcctgtaatcccagctactcgggaggctgaggcaggagaactgcttgaacccgggaggtagaggttgcagtgagccgggatcgcgccattgcactccagcctgggcaacaagagcgaagctccacccaaaaaaaaaaaaaaaaaa

SEQ ID NO: 10469 - DNA, 1591 bp, Homo sapiens
aaggaagagaagtagaatcagaagttaggacatctattgcttgatgcttctgggatgggtaagacgtagttctggtgatagaagttgaagctgcagcataatgagagatgaaagagaaactgctcttctggtgattttaaccctagggatgtagctactgggacaggaggaagtgagggacccagtgctgcagggtccctgttgtcacatatgtcaatcctactttaaagtcaaataatggattctggctgataaagcctatcagaattatggtgttgatacgaaagtgtcacatagccaccaaaatgtgttctctactttcttgctttgctctgattagctaagtcttggtcacatggctttatagcactgggaaaaccaggatctggtcttttatagggtaggaagtgagccctatcttttgtgtagatttgtggcggggagtttcccaagcatgggaaatgggctcagatgatgtggttataaaatgtgaatgtccattaaaaggcagtcagtgttggctactctaagccttcaaattgttgcttttccccttcaacagggaccaaggggagatactggaaacctctgagcttcagctgttggtttttgggttttgtttttgttttattgagatacagttcacttaactatacagtttacccatttaaggtatacagtgttttttagtaaatttacagaattgtgcaactattacaattttggaacatttttgacacctccccccaaaaaaacccctatgccccttagcagtcatcctcagtctcctcagccctaggcaaccactcatctactttctgtctttatagatttgcctatttgggacatttcctataaatggaatctgtatgtggtctttgcttggttttgtttttggggtggtgggggctgactacttagtcttgacaagccaaggtcccaacccagcagtagaaatataaggagtcacggctgtgaggatggcctcacaatgggctcagggtagtgaacttctgtcccctaagttatctcagaaatgaggccaactctctgccctctagaatggatggccctgagggagagaaaggttcatgtccttcctggctggtgacagaaggctggactgtgcctgaaatcaaagcttctcacctggatttgggcaaatcaagcagtcccgaatctcagggtggggtgagatgtgtgctgaagagggcaacacaggagctgcactgcagatggcgacatgcagggtttcaaggccaaagctggtgtgttcttcccttaagaattgctgtaggctaggtgaggtggctcacacctgtaatcccagcactttgggaggctgaggtgggcggatcacctgaggtcgggagttcgaaaccagcctgaccaacatggagcaaccctgtctctactaaaaatacaaaattagccgggtgtggtggcgcatgcctgtaatcccagctactcgggaggctgaggcaggagaattgcttgaaccccggaggtagaggttgcagtgagccgagatcacaccattgcaatgcagcctgggcaacaaaagcgaaactccatctaaaaaaaaaaaaaa

SEQ ID NO: 10470 - DNA, 299 bp, Homo sapiens
ccgggcacggtggctcacacctgtaatcccagcactttgggaggccgaggagggcggatcatgaggtcaggagatcaagaccatcctggctaacacggtgaaaccccatctctactaaaaatacaaaaaattagccggacatggtggcacgtgcctgtagtcccagctactcaggaggctgaggcaggagaatcacttgaacctgggaggcggaggttgcagtgagctgagattgcgccactgcactccagcctgggcaacatagtgagactccatctcaaaaaaaaaaaaaaaagaaa

SEQ ID NO: 10471 - DNA, 147 bp, Homo sapiens
tggatcacctgaggtcaggagtttgagaccagcctgaccaatatgatgaaaccctgtctctactaacaatacaaaaattagctgggcgtggtggcgggagcctgtaatcccagctactcgggaggctgaggcagaagaatcgcttga

SEQ ID NO: 10472 - DNA, 14036 bp, Homo sapiens; identical to SEQ ID NO: 9008

SEQ ID NO: 10473 - DNA, 481 bp, Homo sapiens; identical to SEQ ID NO: 9009

SEQ ID NO: 10474 - DNA, 488 bp, Homo sapiens; identical to SEQ ID NO: 9010

SEQ ID NO: 10475 - DNA, 2062 bp, Homo sapiens
cccagaagtaaagaaaagggagggttttaaaataaataaatacataaacagggtttttgttttcattttcagaaatatctctaaaagcaaatagttttacagcgatatcattatatgtgttaaacttccagctctctgagtatgacttctgcatttttatttttatttttagattcagttttgttcacttgggcatgtgtatggcttggagacaggcaggaatgccaaaaagctggtagatgatggcaactgtgatgagcagaagaactcactgcctcagttacctggatgtgggccattttctttccctggagttggagggcgggcaacaatgttgaaactggctggaagttgagagagaaactgaatttgtttcagggcctagtgatattttagtgcataattttataaaataacagctccattccatgaatataggagaggaaaaagattattgagaaaataatttttttacaggcactggtacttttttttcatgttttgtgttgtagttgcattttactagagcagctgacaccattctatgtggtctgattttgtagttcaaagaccaaaaccaaataaaaagatctactctttaaaaactctcttttccaatgagaggattatggaaaaagtgacagtgattgaaagtctgtgttctatttgccagagtgggggagggagtggtaaggcaggttgactgggatagaccagtcacgaaggagctggaacattcacccaggcccattgccatgtgaattgtagaaggtctgtggggaagacaccatctgccactgtttggcaggatttggccaccatggcacagagtgggcaattgtcctcaaccttggaggcagaagctggcagctggccaaaagtctgctttctcccagaagagataggcagtcactgagccgagatactgatgatgtctctctcttatcgtgcaacatggagagcgggagaaaatgagggaggacagaagagaggagaaggaggaggaaaataagaaaaggaatactaattaactcagcctgtctatccagctaagcttgagcttgattttgctctctagttgaatggaacatgcaacctgaatttctgaataacagaattaccaaattactgtttaagtgtttgagaaaaaaaggtgaaaagtgtgtgtactatatgtatagacgtatagattgacatatagtgaattggttaattgaatgtctgcatcagataagaaggtgttaggtcaatttccacaataatgccattaaaatcggttctttgattaaatccaattaacagatgtggaaactgaggtttgtgacaaggttcaatccctgatttctgtgactccaaagtatgtgctgttatttaatgtttatgtattctctattatgaattgttttcaagttttttaaaatatcactagctagcctgtacgtttcttaggaggcaaaaacaattgccttaaattttgttatattttagtgccattttgcacataggttataagcaacagataatttctgtaatctttagaatatcgattaaacttgttaaaatgtagatattttgaaatctcacacaggacacctaaattatgtaaaatgttataaactttatgatttacaggggccctggagatggaagttctgaaaaaatgttgcctttattcagtattagtgcattatcagggattccagatctcagttaaaatgagagaatctgaatctctaggcaatgatgagtgtttctgaaattcagattcaccagaaagaaattgaaagcaaagagaagacagtgttgtcaaattatcatataattcagctaaaaaaaaaatcatggtacttaagtgggagctagagcacatcactgcctttaagaagatatttaggggaataaaagaggtctgggacctcggaggtgaaactgagagaaagacaaagggacttcaaatcaagcatttgaaagagccaatgaggggccagatgtggtgactcactcctgtaatcccagccctttaagacgccaaggcgggatcccatctcaaaaaaaaaaaaaa

SEQ ID NO: 10476 - DNA, 1713 bp, Homo sapiens
cccagaagtaaagaaaagggagggttttaaaataaataaatacataaacagggtttttgttttcattttcagaaatatctctaaaagcaaatagttttacagcgatatcattatatgtgttaaacttccagctctctgagtatgacttctgcatttttatttttatttttagattcagatttgttcacttgggcatgtgtatggcttggagacaggccagaatgccaaaaagctggtagatgatggcaactgtgatgagcacaagaactcactgcctcagttacctggatgtgggccattttctttccctggagttggagggcgggcaacaatgttgaaactggctggaagttgagagagaaactgaatttgtttcagggcctagtgatattttagtgcataattttataaaataacagctccattccatgaatataggagaggaaaaagattattgagaaaataatttttttacaggcactggtacttttttttcatgttttgtgttgtagttgcattttactagagcagctgacaccattctatgtggtctgattatgtagttcaaagaccaaaaccaaataaaaagatctactctttaaaaactctcttttccaatgagaggattatggaaaaagtgacagtgattgaaagtctgtgttctatttgccagagtgggggagggagtggtaaggcaggttgactgggatagaccagtcacgaaggagctggaacattcacccaggccaattgccatgtgacttgtagaaggtctgtggggaagacaccatctgccactgtttggcaggatttggccaccatggcacagagtgggcaattgtcctcaaccttggaggcagaagctggcagctggccaaaagtctgctttctcccagaagagataggcagtcactgagccgagatactgatgatgtctctctcttatcgtgcaacatggagagcgggagaaaatgagggaggacagaagagaggagaaggaggaggaaaataagaaaaggaatactaattaactcagcctgtctatccagctaagcttgagcttgattttgctctctagttgaatggaacatgcaacctgaatttctgaataacagaattaccaaattactgtttaagtgtttgagaaaaaaaggtgaaaagtgtgtgtactatatgtatagacgtatagattgacatatagtgaattggttaattgaatgtctgcatcagataagaaggtgttaggtcaatttccacaataatgccattaaaatcggttctttgattaaatccaattaacagatgtggaaactgaggtttgtgacaaggttcaatccctgatttctgtgactccaaagtatgtgctgttatttaatgtttatgtattctctattatgaattgttttcaagttttttaaaatatcactagctagcctgtacgtttcttaggaggcaaaaacaattgccttaaattttgttatattttagtgccattttgcacataggttataagcaacagataatttctgtaatctttagaatatcgattaaacttgttaaaatgtagatattttgaaatctcacacaggacacctaaattatgtaaaatgttataaactttatgatttacaggggccctggagatggaagttctgaaaaaatgttgcctttattcagtattagtgcattatcagggactccagatctcagtta

SEQ ID NO: 10477 - DNA, 427 bp, Homo sapiens
gagaagagaagcagaactgttgtaccaaagtaacagttctcaaatctttattttttttcttttgtgataagacacacaggccaaataagactgactgcaagttagcacaagagtgcaacgactctatgttatcctggctccctcattcaaggaaacacgccaaatcttaagtaaaaataatcttaaaacaactttaattataaataagcaaatctcttacaaatggcactactttatcattaattagcaactactaagttgtagcatataacacagaagtatggtatcaagactgaaaactaattgattatttaattcctagcttcttttcaagttctcaaatcccaagatttgcctatggttgccaccaagagctatggaattgttgtttggtaggtgattttcatcctccatattaaaaacaaaa

SEQ ID NO: 10478 - DNA, 665 bp, Homo sapiens
tcggctcactgcaacctcccactcctgggttcaggcgattctcctgccttagcctcctgagtagctgggattataggtgcccacctccatgccctgctaatttttgtatttttggtagggacagggtttcaccatgttggccaggctgctctcgaactcctgacctcaagtcatctgcctgcctcggccttatataggggtgagtcaccccacccagccgatattctttattagtcatctttttcatatctattacagagttttctattctgaatttaatagtttgtttagctatcttttacctgttttatttaccgtcatatactgtgtgcttgcttgtggttggcactcaataaaaattgataaatatgaggactattatatttcttatcatcatctctcttctcgtccttctttccttcgtgtgagtggaagatgatgtcattctttgcatatttttgtaacccatggcttattttaccatgaaacaagctcttccttgcaatcatcctcacttcagagaatatttaacaatatactgttgtcttatagatgcagctcagtagtcctacattatcccagaaacacagattccctatgcataaaaaagcagtaatgaaagctaacttttttgagtatttattctgttcactattgtattcttt

SEQ ID NO: 10479 - DNA, 665 bp, Homo sapiens
tcggctcactgcaacctcccactcctgggttcaggcgattctcctgccttagcctcctgagtagctgggattataggtgcccacctccatgccctgctaatttttgtatttttggtagggacagggtttcaccatgttggccaggctgctctcgaactcctgacctcaagtcatctgcctgcctcggccttatataggggtgagtcaccccacccagccgatattctttattagtcatctttttcatatctattacagagttttctattctgaatttaatagtttgtttagctatcttttacctgttttatttactgtcatatactgtgtgcttgcttgtggttggcactcaataaaaattgataaatatgaggactattatatttcttatcatcatctctcttctcgtccttctttccttcgtgtgagtggaagatgatgtcattctttgcatatttttgtaacccatggcttattttaccatgaaacaagctcttccttgcaatcatcctcacttcagagaatatttaacaatatactgttgtcttatagatgcagctcagtagtcctacattatcccagaaacacagattccctatgcataaaaaagcagtaatgaaagctaacttttttgagtatttattctgttcactattgtattcttt

SEQ ID NO: 10480 - DNA, 12679 bp, Homo sapiens
aaagttataaaaatattttatttaaatgatacagaaaaaaatgtatacttaaaagtgattaaaacttcacattaggaaatgctaaaaacccagtaatgtacataatgataaaatctaaagtgatgagaaaacataaaatattttcatttggtcctgtcacctaacaaaactatcataaatatgagattatagtaattactaaagctggttaaaggcacatgacaacataattcctttatacacatctagtcattttatacaaggaactgctatcccttaaatggaagagtgaactacttgtttaaaatattaacagtgcactatgtacctacaatgaaaccactttctccaaagactcaaacagattaacattgcaaaatagtacttctgtatcactgacttctgaaaattttaataatttatgcatatgcaagtgaaatataatttattctggtttcaacaacagttatacaaagtcacaattttccccaggaaaccattcacttcatagctgcaaaaacacactgtagcttttctgttagggtctgccatgctttcagctagctggatgtttaaccattcacttcaaatttacatgtccagccaggcacggtggcgtgggcctgtagtcccaactacttcgaaggctgaggcaggaggatcacttgatcccaggagttcaaagacagcctgggcaacatagaagaccctgtctcttaaaaaaaaaaaaaaaaaaagtgtatgtccttaaatctgaaagaaaaccagcatttatgtaccaagtaaaacattgtatctcaagctattgcatttaacactaaaaagcatagttcactctgtaatctacaacattgtctgagtctccattaccaattataacttcatgtcagagtaagagctcccaaacatctgtaaaaactcaaaattcaagagtcaaagaaggggctgagaacacgagaaggggagatgggtgacagggtcaggtgaggaagtgttctgagatgtgtaggattcctccgggcccaaagccgcttgtggcaccacatgtgtacaggaatgaagggcctcctgtgagggttcccagtggtcccaagacacagcaaggtgcctgaaggaggctggagacattggcgtgggcatggaggtgctagcaactattttcagactgctaacaatgagagtatgtccatttcttctttacacagttaccactgaccttcctttaaaatcccacagggagaacatgctgtttttagcagaaatgtcagttttcattaactccttgaaaatttagcgtattaacttttatttccatgagcttcagtttccacacctgtcaactgctgtataaagcaggtttcctgcaagttctgatgtaagtgacctgacaggaggcactatctttgtccttctcaccatgcccctaagcatctggagtgagtattctcaatatacacttatttaataacagagttatacgacactcagaaaacagcctccactgtgtaaggcagcagatctcaggatggggtgatctgtagggaggcagaaattctataaataacaccaaacgaaagctgattgtgtcatccaacacatttttatgaggaagtcagaataattagaagatggcagaattttttttcccaattaggtaaaattgttcattcttcctgtattcccatttcttaagaatgatccagccaacagtcactgaatataagctgacacaaattaatataatttcaacataaaatggtctaatgtgtgaattcaactatattggaaggtacaaatcctgtctttatgaggtctttgaaaggcagggtaccttctctaaaaagtagtcacttagaaccaacttttacaaaagaaagagtctcagcccccaacccccgccagcctgggcaacataaggagactctgtttctacaaaaaaatttttaaaaattagccaagcatggtagcacatgcttataataccagctacttgggaaactgaggtgggaggattgcttgagcccccaagtggtcaaggctgcagtgagctgtgatcatgccaccgtactccagcctggacaacagagtgagaagctgtctcaaaacaaaaaggagtctatctcagagttcaatgaatggataattctagtgtggacaactctggtgtaaacatgactgaaaataattcacaaatagtctgttacagctccatccactgaaaattgtcataaaagacatttttcaaacgagttcatttttagaaaaaccactccagatatcttaccttcggaaatcatccaaggagtgtgataaacatgacaacccccataaactgggtaaacaacaacaatggagtgaaaaacgaccacacatgccataaagcaatgttgaagctgaaaagaacaagacataaacagttgacaactccaatatgcatcaatatattttattctagaatccagatttaaagtattcaatgtagaaaagttcatccagtcagcaactttctctatgtatcatatttctcaagtatgtgacttagccaatgctggaaaggaaaactctagatatacttaaacaagtatcacaatttcttcaagaaggccctggaactggaaccactaaaggtctcctaataggggttgacatggcttaatagaaactgaagtctcttagtttctgacttcaacaataatttaaatggctacagcccatttttatgacatcacacactaaactatcatggtaaaaaagaccaaaatattgtctcttaaaaacagaatgaaaacagttatcacttataagctgctattatatctttcattgagaaaaacactattcctgtcatcaaagtaaaattaaaacactaagtataaagatttttaatgactgaaatttctaagaacagaatagggaaaactatattcaaataagttcagatggttattggttttaatatataatagtttgataagtatgagtattaaataactataatcacaaatcacactgtctaaaaaattaacatttctggacatgatcttaccctcatgggaaaaagtaaaacaacgtatctgcatgcccccacatacaggttaacaataaccacatcacactgtcaaacaaccttgaacttcaactacagaaaataagtcatagaaagaatatgtataaaggtatatggttcttccaaaataaaaattcaattaggccgggggtggtggcgcacgcctgtaatccagcactttgggaggccaacacaagcagatggcttgaggccaggagtttgagacctgcctgagcagcacagcgaaaccccatctctacaaaaaatacaaaaaatagccagatgtggtggcacatgcctgtggtcccaactactcgggaggctgagtgaggcaggaggatcacttaagcctgggaagtcgaggctgcagtgagctgtgatcatgccactgcactccggcctgggtgacacagtgagaccctatctccaaaaagaaaaaaaaatccaattgatataaagaaagaaaaaactagagagctgcacacaacataggaaaagtagttttctttctggttgaatcataggatatatttcctttgtgtttttatgtaatttacagattttttttcctcagggagcaagttttacttttataaacccaaaaaaccctgtatttttcattgagtatttaattaacttatgaagaaggtatttattgtggcattgtgtggggtttaatattacgcagtgctcccacagaagacaggttaaataaatcatgttatgtccatgctgtgaaaactatgcaactgtttaaaaaaatgagacacatctatatgtaccattatggaagaatcccaaactataaggatccactgaaaaacaaaaggagaaaaggacaaacaaccactttggaaagcagtttggcatgatttactgaagtcaaaggtacgtacatccaacaattttaccccttggggtacatatatatacatatatacatacatctctacacccaacagaaatgtgttcactgtgctacaagagccatgtacaagaatgctctttatagcatccttcatagtaaccccaaactgaaaaaaatctaaacacaatcaacaagggaaaagaaaactgggattcaattaaacaatggaatgctaaagagcaatgaagatgagtcactgttcccggcgacaatatgaaagaactgcacacaatgctgcacacagccagctcaatgtgaaggaatacaccctgtacaaatccatttctataaagttcaaaagcgtagctgaaacaaaaatagaatatctaatggaagcaaagcaagtagttaccatgaaggtcagggcagtatttacctgtggcaggagggaaggtgtagtaactgggagggagaatgaagggggttcccagtgtgctggctcagtttacaccaatgctcacttcatgagaattcattcactaattcattcatctcagtttttttcacttttctatatgtactgtatgtcataataaaatagatttaaaaagcaaaatgcagaatatgtacagaatgtcaccatctgtgctttaaataactagatccataaatagaaggagaaagagatactaatcaaaagggaaccagagagcatgaatgaccaggagactatttttctgttttaactttttttctttcgaagtttggaccaagcatatcactatctgatcaaaaaaaaaatttgttgttcattcctgttagtcatttcaaagttaacttaccaaattcctgctgcaataaaggaggcagtggtaatgggtatcaaggctggatacttgacatcatattctccaattccacaataccattccaggtagactatgcagtaaaatgcaattgataaactgacaagcaacaaggcactgccacagagaaaccagctgtggagataaaaacagtaagaggtctgacagcacttaatgaatcgtcacatatcttaaaagtttttactaatagcttaaaaatctgcttctaagaatatcaagtgttgcagagggagccatacttaaacaatccatgctttcagaaagtctcaatctatgggagatgggggtgagaaaaagagatacacaactcaggaaagaatgaaaagtaagacttgaaatacatgcatttatatatacactctcatcagccaaccaaccaagggaaaattctggtcatgacaatgcattttctttaaaaatacaaggaagaggccgggcgcagtggctcatgcctataatcccaacactttggaaggccgaggcaggtggatcacttgaggtcaggagttcgagaccagcctgaccaacacggagaaatcctgtctctactaaaaatacaaaattagccaggcgtggtggcgcaagcctgtaatccaatcttcttgggaggatgaggcaggagaatcgcctgaacccaggaggcagagattgcaatgagctgagatggcgccattgcactccagcctggagtgcctgggcaacaagagtgaaactctgtctcaaaaaataaaataaataaaaacaaaaatacaaggaagatagtggctttctggttgtttctgaagttttgagtgtgacaggattaaagaagtttatcagtgggaaacttcattcctccaagttaagtggactttcttggaatactgaaagacaattaggaagatcaataattcaaattttctctcataaaagatttctaaatgaaatcctcccattttcaaaatatcttctactcaccacctcaccctcaatgccaatgcctttttactcccttccaattccacctgtgacctgattcagcaagagtgaggcaacctggacaaccccttccctccaccccagctggacttggggactgaaatgcctttcccattctcccaactcaatccaatatcccatcatcatctgcttctctatgggaaaagcctgacaatccatgtggaagagagagggagaacagatggctacaacagataagttacaaaggcacaaagtgaacttccaataatggcaaggttccggattccatgaaggctttttacgatgatgcaattctgagattcggagtcatgagaggctgtagagggaaggggttaagagcacagcctctgaaatctgtctgtatgggtttgaatcttaacttgagcaagactagttttgtgactctaggcaaattacctaacctccgtgtgtttcagaaatattgacagtacttaactcagaatagctgtgagaattaaatcaagtggtcagcaaagtgctcctcacagctgactctcaatcataatcattattattccactcaagttatttttattttcattcatttatttctgagccggagtcttgctctgttgcccaggctggagtgcagtgctgcaatctcagctcactgcaacctccgcctcccaggttcaccaattctcctgcctcagcctcccaagtagctggaattacaggcactggccaccacgcccagctaatttttgtatttttagtagagatggggtttcaccatgtccatattggccaggctggtctcgaattcctgacctcaagtgatccacctgtctcagccttccaaagtgctgggattataggggtcagccaccatgcccagccatcactcaagttatatctatgaggaaaaaatgtccatgttcatctttaggagtcttcaaagacctctcttctgctagagcatgcaatctcactggggggagtatcgcccccaaagtgaagaaaaaaatatggctctaattgtatgtataaagcatagatatgcatgcagtatataaatgatatagtttatctaattccacattccacaggaatgattaggaaaaaaatgtctaaaaaggccttttatcattacccctaaggagtctttttagacatttttttcctttgccaacatgtggatatgagaaaaaaaaaattttttttttttgagacggagtctcgctgttgttgcccaggctggagtgcaatggcgcgatctcggctcactgcaacctccacttcccaggttcaagctatcctcctgcctcagcctcctgagcagctgatattacaggtgcccaacaccacacccagctaatttttgtatttttagtagagatggggtctcaccatgttggccaggatggtcttgaactcctgacctcaggtgatccatccaccttggcctcccaaagtgctcggattacaggcatgagccaccatgcccggcctaagaaaattttttaaactgcctgaacaaaatataatactatcagtcagtggtcctcagccctggctttatatcacagtcaccttgcacctttctaagagaaactacctagtccccagtttccaaaattctgggcctgagcatctaggattttaattttactttctgtctttaactccactgttgattttgatgcacacaagccgagtattttaaactgtgatttctaaagcatcacagtgttgttttgttattatttatttacttatttaatttttttaagacggagtctcgctctgtcgcccaggctggagtgcagtggcgcgatctcggctcactgcaatctccacctgctgggttcacgccattcttctgcctcagcctcccaagtagctgggactacaggcgcccgccaccatgcccagctaattgttttttgtatttttagtagagacggggtttcaccgcgttagccaggatggtctcgatctcctgacctcgtgatccgcccgcctcggcctcccaaagcgctgggattacaggcatgagccaccgcgcctggcctgttttgtttttaatatggacctgctctcccatctttgaacaatataaagaaccttaaggcctcaagcttctaaacttaggctagagccagaggaaaaagaaatcacctcaggcgtcagaagaacgagccattttagccattttccaaaagcagaactcagccggcactgtcttttgtgcagccctctcatttcatggctgttcaataccccccaactccccttaatgagtccttcccaagaaaacaatgcgactcaaaatcctcagcctttgagaatgcatttctgcctttttctctctaagatgacaccttgttgaggacagatctatgacttctactttctttccaacccccacagccctggtcccagtgtctgcgtcccggctttgccacacagcagttatgtggtcctgggcactccacttcactgcagttgcccccaaatatcttacgtgtgatcatttcttactctgccatttctctaaactactaaaaatacccaatataaggacacaaatacagaagttctctcacatctcctaaaacctcaaaaaggtctcagtcctgaggctgacctggactagatatccctcctagatgctcccatgataccctgcgcctacacttacagagcacataccatgcggcctggtaacttgtctgctgcagcctagaatgagctgttggagagctagaaatgcaccttccacgtgtttggcactgacagccaaacacatctcagcctccataaagtatctgatgaaggaaagagcagctgctattggtggtggttaaagtacccatcccctccagccaggtgcagtggctcacacctgtaatcgcagtactttaggaagtcaaggtgggaggatcactggagcccacaagtttgagaccagcctgggcaacatgaagagacctcgtctctacaaaaaataaaccaaattagccaggcatggtggtgtgcgcctatagtcctagctacttgggaggctgaggtgggaggatcacttgagcctgggaagtcaaggcagcaagccatgatcgcaccactacactccagcctgggtgacagagtgcagcgagaccctgtctcaaaataaaaataaaaataaagtatccatccctcttttcccagcccaagttctaagagagatgactgagtcaagctgatgaagattaaatgtctgttatactgatgcagccgtgggaagaatatggctttggtgagtgatgacaaagcacttcctaatactgggtctctgacacccagaaacagccttacccactgggttccaggtcaaaatgaaaacctagagaccttttcctgtggggactgcccctgtggaatgacaccatgggaaggcagaccagactctgcgcttcctatgggcagccgacttgcagcagaagaaggtgctgagctacctttgtccagttcttcatcacacactcaatcagtcacgccacctcccacaaaggagtgagtgacatggaggggcagaagatgggagtgtttagggaaagtttctcccctagaaagtagaggacagtttaaataaactcccctctgcctactttcccctgtgggctttttccttgtggctcgacagtctcctccgccagaagtcactgctcctcctgaaggcccttgaggagaaatcatgtgtcctgccatgatacgaggggaccacagtcctgtctgcatcttcctacccccactggtacttccaaattattactcttgaccctaagcacaccagccctcccaatgccatgatgctcaccaacatacctctcccttccatttcttatccaagggtctccacatcactctccaatgtgcagtaaggaccctaggatatgattccaaccctctcctccatgtcaactctggagactatactgaaaggatctcagtccctgtgaatgaggaactactggacatctggtctggccacaaagctgtcactcctcccactgtggaccttcacctccactctaacacagttacaccctgtagttaccttgtcagctgtaaccaccctctgaaaccaaccctgagacccaattcccactggccacagttctcggctcttcctcccagtactcttgtacttggtctttgaagaccttcagtcagtctttctccctcttttccccaaatggattaggttcttcttaaatttactaccttcctcatcctacaacacatttatttgcacacaaataatttccagttctattccactctactgtatgtgcccagagcacacaccctctcattggttttattttttccagctttattgaagtataattgacaaattaaaattttatatattcaaggtatacagtgtgatgacttgatatatatatacacacacacatgaatatatacatatatacatatatatgaatatatatatacgtgtatacatatacacacacacacattgtgaaattattaccacaatcaagttaattatcacactcatcacctcacatagttaccactggtggggtaacagggggaggacacaagacctactcttagaaaatttcaagtatacaatacagccttattaactatagtcactatactgtatgtacattagatctccagaccttattcatcttataactaaaaatatgtaccctttgacccccatctcatattcatcttcgtatcaccacacctccaacacagggcctggcagagagtagtaggtgcttactgtttgaagaattcaactaacaaaatataacacgaaaaatcagacttgggtttaatttacaaagcaataaaattttcttacctgctagtgtggaagttttctttaagggttttaaagaagtcaacataataggtcacaacaatggatgccaaaatccagaatccagaatggatattaagtcttggaagaggtttctcctttttctcaacagctgtggaggtttctgcaaataagggagatttcaacttattaagttaccacaattttgcgaggaaaaattacacttaagccaaataaaatcatttcctagagctaagaaacagtctctcccatgataacaaatccttctgtaaaacccttgagataggtttatatttacaaaaaataagagcccactataaaatatggtcaatacagtcaatttatttcctctaaatacattgtgaaatcaaatttacactttcatcgtctttcggagataacaatgtcacctggaaatgtaagaattttaatattatgtttcacatttcttctaggaaagtaattagtcttgttaattaggaaaaatgccaaaggcaaacattagcgcatgaactggacttgtggtcttccaagaacacttttataactaaattttttttttttgagtcggagtcttcctctgtcgcccgggttggagtggaatggtttgatctcggctcactgcaaccaccgcctcccgggttcaagcaattctcctgcctcagcctcccgagtacctgggattacaggcgcctgccaccacgccgggctaatttttgtatttttagtagagacggggtttcaccatcttggccaggctgctctatttggccaggttggtctcgaactcctgacctcgtgatcagcccgcctcagcctctcaaagtgctgggattacaggcgtgagctaccctgcccagcctataactaaatattttagttactttaaacacagctcaaaagtggaaacggcacaccagagctctagttccagcacagcactgtctagacaggtgatggacaagacatttttcctgtctggaacgcaatctgaaagaatgggtggatgggggttgggtcagatggatgatttctattaagttttccggggattctgacatgccctctaggttcacgtgagaatcaatggtccacatctgaggttttgggcctttagatgaccatcggaaaccctgggaagcatgttcgtaatattctgggatatcctcaaaatgtatacatcatcatgcctgggcatgaggttattcgtgtttttaattttaaaaggtaataaatggacgtggttttaaaacatatgagataaaaaatatccaaaaatgaagtatctgtctcccatccttaacctcagatctaatccccagaagcaaccaccacttacaatttctactgaattcttccatattctatgtatccacaggtgaacatacatcacaagttacctgttttgtacccaaatggcggcataccatagtgttccacacttccctttgaaaatcatccccattggtacatacgagtcgacctggcgtgtcaggtatacatatacccaaatttacttaaacagctttctgctgacgggcaaggcagatatttctcgtaattcgctattacaagcaatcctgaagtgaaacactgcgcacatcattgtacactgcggtacacgcatgtttctggtaaatccttaagacttaaaactggtgggtatttttaattttaatcgctatttccaaacaggtgtcaaatcagctctccagagaattctgaagcgcagctgaaatgacgatgcacagcactccgcgattctaaggatcttccctgacattaaatattcgacttgcaaagccgaaactcagtccttccagactgggccagggctgccggaggccggccgttttccgacgcctcgcctctgagaacctcggggcggcttggtgcgcgcctcacccggcccggcgtcaccctcgcggtccagctgggcctcggcgtccggcaggaggaggaatcgccgccggagctgctgccgggcccgcgaggagtccatcttggtaccgccccgaaat

SEQ ID NO: 10481 - DNA, 12680 bp, Homo sapiens
aaagttataaaaatattttatttaaatgatacagaaaaaaatgtatacttaaaagtgattaaaacttcacattaggaaatgctaaaaacccagtaatgtacataatgataaaatctaaagtgatgagaaaacataaaatattttcatttggtcctgtcacctaacaaaactatcataaatatgagattatagtaattactaaagctggttaaaggcacatgacaacataattcctttatacacatccagtcattttatacaaggaactgctatcccttaaatggaagagtgaactacttgtttaaaatattaacagtgcactatgtacctacaatgaaaccactttctccaaagactcaaacagattaacattgcaaaatagtacttctgtatcactgacttctgaaaattttaataatttatgcatatgcaagtgaaatataatttattctggtttcaacaacagttatacaaagtcacaattttccccaggaaaccattcacttcatagctgcaaaaacacactgtagcttttctgttagggtctgccatgctttcagctagctggatgtttaaccattcacttcaaatttacatgtccagccaggcacggtggcgtgggcctgtagtcccaactacttcgaaggctgaggcaggaggatcacttgatcccaggagttcaaagacagcctgggcaacatagaagaccctgtctcttaaaaaaaaaaaaaaaaaaaagtgtatgtccttaaatctgaaagaaaaccagcatttatgtaccaagtaaaacattgtatctcaagctattgcatttaacactaaaaagcatagttcactctgtaatctacaacattgtctgagtctccattaccaattataacttcatgtcagagtaagagctcccaaacatctgtaaaaactcaaaattcaagagtcaaagaaggggctgagaacacgagaaggggagatgggtgacagggtcaggtgaggaagtgttctgagatgtgtaggattcctccgggcccaaagccgcttgtggcaccacaggtgtacaggaatgaagggcctcctgtgagggttcccagtggtcccaagacacagcaaggtgcctgaaggaggctggagacattggcgtgggcatggaggtgctagcaactattttcagactgctaacaatgagagtatgtccatttcttctttacacagttaccactgaccttcctttaaaatcccacagggagaacatgctgtttttagcagaaatgtcagttttcattaactccttgaaaatttagcgtattaacttttatttccatgagcttcagtttccacacctgtcaactgctgtataaagcaggtttcctgcaagttctgatgtaagtgacctgacaggaggcactatctttgtccttctcaccatgcccctaagcatctggagtgagtattctcaatatacacttatttaataacagagttatccgacactcagaaaacagcctccactgtgtaaggcagcagatctcaggatggggtgatctgtagggaggcagaaattctataaataacaccaaacgaaagctgattgtgtcatccaacacatttttatgaggaagtcagaataattagaagatggcagaattttttttcccaattaggtaaaattgttcattcttcctgtattcccatttcttaagaatgatccagccaacagtcactgaatataagctgacacaaattaatataatttcaacataaaatggtctaatgtgtgaattcaactatattggaaggtacaaatcctgtctttatgaggtctttgaaaggcagggtaccttctctaaaaagtagtcacttagaaccaacttttacaaaagaaagagtctcagcccccaacccccgccagcctgggcaacataaggagactctgtttctacaaaaaaatttttaaaaattagccaagcatggtagcacatgcttataataccagctacttgggaaactgaggtgggaggattgcttgagcccccaagtggtcaaggctgcagtgagctgtgatcatgccaccgtactccagcctggacaacagagtgagaagctgtctcaaaacaaaaaggagtctatctcagagttcaatgaatggataattctagtgtggacaactctggtgtaaacatgactgaaaataattcacaaatagtctgttacagctccatccactgaaaattgtcataaaagacatttttcaaacgagttcatttttagaaaaaccactccagatatcttaccttcggaaatcatccaaggagtgtgataaacatgacaacccccataaactgggtaaacaacaacaatggagtgaaaaacgaccacacatgccataaagcaatgttgaagctgaaaagaacaagacataaacagttgacaactccaatatgcatcaatatattttattctagaatccagatttaaagtattcaatgtagaaaagttcatccagtcagcaactttctctatgtatcatatttctcaagtatgtgacttagccaatgctggaaaggaaaactctagatatacttaaacaagtatcacaatttcttcaagaaggccctggaactggaaccactaaaggtctcctaataggggttgacatggcttaatagaaactgaagtctcttagtttctgacttcaacaataatttaaatggctacagcccatttttatgacatcacacactaaactatcatggtaaaaaagaccaaaatattgtctcttaaaaacagaatgaaaacagttatcacttataagctgctattatatctttcattgagaaaaacactattcctgtcatcaaagtaaaattaaaacactaagtataaagatttttaatgactgaaatttctaagaacagaatagggaaaactatattcaaataagttcagatggttattggttttaatatataatagtttgataagtatgagtattaaataactataatcacaaatcacactgtctaaaaaattaacatttctggacatgatcttaccctcatgggaaaaagtaaaacaacgtatctgcatgcccccacatacaggttaacaataaccacatcacactgtcaaacaaccttgaacttcaactacagaaaataagtcatagaaagaatatgtataaaggtatatggttcttccaaaataaaaattcaattaggccgggggtggtggcgcacgcctgtaatccagcactttgggaggccaacacaagcagatggcttgaggccaggagtttgagacctgcctgagcagcacagcgaaaccccatctctacaaaaaatacaaaaaatagccagatgtggtgacacatgcctgtggtcccaactactcgggaggctgagtgaggcaggaggatcacttaagcctgggaagtcgaggctgcagtgagctgtgatcatgccactgcactccggcctgggtgacacagtgagaccctatctccaaaaagaaaaaaaaatccaattgatataaagaaagaaaaaactagagagctgcacacaacataggaaaagtagttttctttctggttgaatcataggatatatttcctttgtgttttcatgtaatttacagattttttttcctcagtgagcaagtattacttttataaacccaaaaaaccctgtatttttcattgagtatttaattaacttatgaagaaggttattcattgtggcattgtttgggtataaatataacgaagtccaacaacagaagacaggttaaataaatcatgttatgtccatgctgtgaaaactatgcaactgtttaaaaaaatgagacacatctatatgtaccattatggaagaatcccaaactataaggatccactgaaaaacaaaaggagaaaaggacaaacaaccactttggaaagcagtttggcatgatttactgaagtcaaaggtacgtacatccaacaattttaccccttggggtacatatatatacatatatacatacatctctacacccaacagaaatgtgttcactgtgctacaagagccatgtacaagaatgctctttatagcatccttcatagtaaccccaaactgaaaaaaatctaaacacaatcaacaagggaaaagaaaactgggattcaattaaacaatggaatgctaaagagcaatgaagatgagtcactgttcccggcgacaatatgaaagaactgcacacaatgctgcacacagccagctcaatgtgaaggaatacaccctgtacaaatccatttctataaagttcaaaagcgtagctgaaacaaaaatagaatatctaatggaagcaaagcaagtagttaccatgaaggtcagggcagtatttacctgtggcaggagggaaggtgtagtaactgggagggagaatgaagggggttcccagtgtgctggctcagtttacaccaatgctcacttcatgagaattcattcactaattcattcatctcagtttttttcacttttctatatgtactgtatgtcataataaaatagatttaaaaagcaaaatgcagaatatgtacagaatgtcaccatctgtgctttaaataactagatccataaatagaaggagaaagagatactaatcaaaagggaaccagagagcatgaatgaccaggagactatttttctgttttaactttttttctttcgaagtttggaccaagcatatcactatctgatcaaaaaaaaaatttgttgttcattcctgttagtcatttcaaagttaacttaccaaattcctgctgcaataaaggaggcagtggtaatgggtatcaaggctggatacttgacatcatattctccaattccacaataccattccaggtagactatgcagtaaaatgcaattgataaactgacaagcaacaaggcactgccacagagaaaccagctgtggagataaaaacagtaagaggtctgacagcacttaatgaatcgtcacatatcttaaaagtttttactaatagcttaaaaatctgcttctaagaatatcaagtgttgcagagggagccatacttaaacaatccatgctttcagaaagtctcaatctatgggagatgggggtgagaaaaagagatacacaactcaggaaagaatgaaaagtaagacttgaaatacatgcatttatatatacactctcatcagccaaccaaccaagggaaaattctggtcatgacaatgcattttctttaaaaatacaaggaagaggccgggcgcagtggctcatgcctataatcccaacactttggaaggccgaggcaggtggatcacctgaggtcaggagttcgagaccagcctgaccaacacggagaaatcctgtctctactaaaaatacaaaattagccaggcgtggtggcgcaagcctgtaatccaatcttcttgggaggatgaggcaggagaatcgcctgaacccaggaggcagagattgcaatgagctgagatggcgccattgcactccagcctggagtgcctgggcaacaagagtgaaactctgtctcaaaaaataaaataaataaaaacaaaaatacaaggaagatagtggctttctggttgtttctgaagttttgagtgtgacaggattaaagaagtttatcagtgggaaacttcattcctccaagttaagtggactttcttggaatactgaaagacaattaggaagatcaataattcaaattttctctcataaaagatttctaaatgaaatcctcccattttcaaaatatcttctactcaccacctcaccctcaatgccaatgcctttttactcccttccaattccacctgtgacctgattcagcaagagtgaggcaacctggacaaccccttccctccaccccagctggacttggggactgaaatgcctttcccattctcccaactcaatccaatatcccatcatcatctgcttctctatgggaaaagcctgacaatccatgtggaagagagagggagaacagatggctacaacagataagttacaaaggcacaaagtgaacttccaataatggcaaggttccggattccatgaaggctttttacgatgatgcaattctgagattcggagtcatgagaggctgtagagggaaggggttaagagcacagcctctgaaatctgtctgtatgggtttgaatcttaacttgagcaagactagttttgtgactctaggcaaattacctaacctccgtgtgtttcagaaatattgacagtacttaactcagaatagctgtgagaattaaatcaagtggtcagcaaagtgctcctcacagctgactctcaatcataatcattattattccactcaagttatttttattttcattcatttatttctgagccggagtcttgctctgttgcccaggctggagtgcagtgctgcaatctcagctcactgcaacctccgcctcccaggttcaccaattctcctgcctcagcctcccaagtagctggaattacaggcactggccaccacgcccagctaatttttgtatttttagtagagatggggtttcaccatgtccatattggccaggctggtctcgaattcctgacctcaagtgatccacctgtctcagccttccaaagtgctgggattataggggtcagccaccatgcccagccatcactcaagttatatctatgaggaaaaaatgtccatgttcatctttaggagtcttcaaagacctctcttctgctagagcatgcaatctcactggggggagtatcgcccccaaagtgaagaaaaaaatatggctctaattgtatgtataaagcatagatatgcatgcagtatataaatgatatagtttatctaattccacattccacaggaatgattaggaaaaaaatgtctaaaaaggccttttatcattacccctaaggagtctttttagacatttttttcctttgccaacatgtggatatgagaaaaaaaaaattttttttttttgagacggagtctcgctgttgttgcccaggctggagtgcaatggcacgatctcggctcactgcaacctccacttcccaggttcaagctatcctcctgcctcagcctcctgagcagctgatattacaggtgcccaacaccacacccagctaatttttgtatttttagtagagatggggtctcaccatgttggccaggatggtcttgaactcctgacctcaggtgatccatccaccttggcctcccaaagtgctcggattacaggcatgagccaccatgcccggcctaagaaaattttttaaactgcctgaacaaaatataatactatcagtcagtggtcctcggccctggctttatatcacagtcaccttgcacctttctaagagaaactacctagtccccagtttccaaaattctgggcctgagcatctaggattttaattttactttctgtctttaactccactgttgattttgatgcacacaagccgagtattttaaactgtgatttctaaagcatcacagtgttgttttgttattatttatttacttatttaatttttttaagacggagtctcgctctgtcgcccaggctggagtgcagtggcgcgatctcggctcactgcaatctccacctgctgggttcacgccattcttctgcctcagcctcccaagtagctgggactacaggcgcccgccaccatgcccagctaattgttttttgtatttttagtagagacggggtttcaccgcgttagccaggatggtctcgatctcctgacctcgtgatccgcccgcctcggcctcccaaagcgctgggattacaggcgtgagccaccgcgcctggcctgttttgtttttaatatggacctgctctcccatctttgaacaatataaagaaccttaaggcctcaagcttctaaacttaggctagagccagaggaaaaagaaatcacctcaggcgtcagaagaacgagccattttagccattttccaaaagcagaactcagccggcactgtcttttgtgcagccctctcatttcatggctgttcaataccccccaactccccttaatgagtccttcccaagaaaacaatgcgactcaaaatcctcagcctttgagaatgcatttctgcctttttctctctaagatgacaccttgttgaggacagatctatgacttctactttctttccaacccccacagccctggtcccagtgtctgcgtcccggctttgccacacagcagttatgtggtcctgggcactccacttcactgcagttgcccccaaatatcttatgtgtgatcatttcttactctgccatttctctaaactactaaaaatacccaatataaggacacaaatacagaagttctctcacatctcctaaaacctcaaaaaggtctcagtcctgaggctgacctggactagatatccctcctagatgctcccatgataccctgcgcctacacttacaaagcacataccatgcggcctggtaacttgtctgctgcagcctagaatgagctgttggagagctagaaatgcaccttccacgtgtttggcactgacagccaaacacatctcagcctccataaagtatctgatgaaggaaagagcagctgctattggtggtggttaaagtacccatcccctccagccaggtgcagtggctcacacctgtaatcgcagtactttaggaagtcaaggtgggaggatcactggagcccacaagtttgagaccagcctgggcaacatgaagagacctcgtctctacaaaaaataaaccaaattagccaggcatggtggtgtgcgcctatagtcctagctacttgggaggctgaggtgggaggatcacttgagcctgggaagtcaaggcagcaagccatgatcgcaccactacactccagcctgggtgacagagtgcagcgagaccctgtctcaaaataaaaataaaaataaagtatccatccctcttttcccagcccaagttctaagagagatgactgagtcaagctgatgaagattaaatgtctgttatactgatgcagccgtgggaagaatatggctttggtgagtgatgacaaagcacttcctaatactgggtctctgacacccagaaacagccttacccactgggttccaggtcaaaatgaaaacctagagaccttttcctgtggggactgcccctgtggaatgacaccatgggaaggcagaccagactctgcgcttcctatgggcagccgacttgcagcagaagaaggtgctgagctacctttgtccagttcttcatcacacactcaatcagtcacgccacctcccacaaaggagtgagtgacatggaggggcagaagatgggagtgtttagggaaagtttctcccctagaaagtagaggacagtttaaataaactcccctctgcctactttcccctgtgggctttttccttgtggctcgacagtctcctccgccagaagtcactgctcctcctgaaggcccttgaggagaaatcatgtgtcctgccatgatacgaggggaccacagtcctgtctgcatcttcctacccccactggtacttccaaattattactcttgaccctaagcacaccagccctcccaatgccatgatgctcaccaacatacctctcccttccatttcttatccaagggtctccacatcactctccaatgtgcagtaaggaccctaggatatgattccaaccctctcctccatgtcaactctggagactatactgaaaggatctcagtccctgtgaatgaggaactactggacatctggtctggccacaaagctgtcactcctcccactgtggaccttcacctccactctaacacagttacaccctgtagttaccttgtcagctgtaaccaccctctgaaaccaaccctgagacccaattcccactggccacagttctcggctcttcctcccagtactcttgtacttggtctttgaagaccttcagtcagtctttctccctcttttccccaaatggattaggttcttcttaaatttactaccttcctcatcctacaacacatttatttgcacacaaataatttccagttctattccactctactgtatgtgcccagagcacacaccctctcattggttttattttttccagctttattgaagtacaattgacaaattaaaattttatatattcaaggtatacagtgtgatgacttgatatatatatacacacacacatgaatatatacatatatacatatatatgaatatatatatacgtgtatacatatacacacacacacattgtgaaattattaccacaatcaagttaattatcacactcatcacctcacatagttaccactggtggggtaacagggggaggacacaagacctactcttagaaaatttcaagtatacaatacagccttattaactatagtcactatactgtatgtacattagatctccagaccttattcatcttataactaaaaatatgtaccctttgacccccatctcatattcatcttcgtatcaccacacctccaacacagggcctggcagagagtagtaggtgcttactgtttgaagaattcaactaacaaaatataacacgaaaaatcagacttgggtttaatttacaaagcaataaaattttcttacctgctagtgtggaagttttctttaagggttttaaagaagtcaacataataggtcacaacaatggatgccaaaatccagaatccagaatggatattaagtcttggaagaggtttctcctttttctcaacagctgtggaggtttctgcaaataagggagatttcaacttattaagttaccacaattttgcgaggaaaaattacacttaagccaaataaaatcatttcctagagctaagaaacagtctctcccatgataacaaatccttctgtaaaacccttgagataggtttatatttacaaaaaataagagcccactataaaatatggtcaatacagtcaatttatttcctctaaatacattgtgaaatcaaatttacactttcatcgtctttcggaaataacaatgtcacctggaaatgtaagaattttaatattatgtttcacatttcttctaggaaagtaattagtcttgttaattaggaaaaatgccaaaggcaaacattagcgcatgaactggacttgtggtcttccaagaacacttttataactaaattttttttttttgagtcggagtcttcctctgtcgcccgggttggagtggaatggtttgatctcggctcactgcaaccaccgcctcccgggttcaagcaattctcctgcctcagcctcccgagtacctgggattacaggcgcctgccaccacgccgggctaatttttgtatttttagtagagacggggtttcaccatcttggccaggctgctctatttggccaggttggtctcgaactcctgacctcgtgatcagcccgcctcagcctctcaaagtgctgggattacaggcgtgagctaccctgcccagcctataactaaatattttagttactttaaacacagctcaaaagtggaaacggcacaccagagctctagttccagcacagcactgtctagacaggtgatggacaagacatttttcctgtctggaacgcaatctgaaagaatgggtggatgggggttgggtcagatggatgatttctattaagttttccggggattctgacatgccctctaggttcacgtgagaatcaatggtccacatctgaggttttgggcctttagatgaccatcggaaaccctgggaagcatgttcgtaatattctgggatatcctcaaaatgtatacatcatcatgcctgggcatgaggttattcgtgtttttaattttaaaaggtaataaatggacgtggttttaaaacatatgagataaaaaatatccaaaatgaagtatctgtctcccatccttaacctcagatctaatccccagaagcaaccaccacttacaatttctactgaattcttccatattctatgcattcacaggtgaacatacatcacaagttacctgttttgtacccaaatggcggcataccatagtgttccacacttccctttgaaaatcatccccattggtacatacgagtcgacctgatgtgtcaggtatacatatacccaaatttacttaaacagctttctgctgacgggcaaggcagatatttccagtaattcgctattacaagcaatcctgaagtgaaacactgcgcacatcattgtacactgcggtacacgcatgtttctggtaaatccttaagacttaaaactggtgggtatttttaattttaatcgctatttccaaataggtgtcaaatcagctctccagagaattctgaagcgcagctgaaatgacgatgcacagcactccgcgattctaaggatcttccctgacattaaatattcgacttgcaaagccgaaactcagtccttccagactgggccagggctgccggaggccggccgttttccgacgcctcgcctctgagaacctcggggcggcttggtgcgcgcctcacccggcccggcgtcaccctcgcggtccagctgggcctcggcgtccggcaggaggaggaatcgccgccggagctgctgccgggcccgcgaggaggccatcttggtaccgccccgaaat

SEQ ID NO: 10482 - DNA, 411 bp, Homo sapiens
agggtggagtcggcctcaaaggttccgctctcatgtcggcaagtgtgatttgaattttaaaacactgagctttcccggtggaagagttcccaagtttattccgacctacggaagcccaggaggaccaggattaccgctgccgctggatgcgtccagggccgggatgcgcgaccgtgagacgctgcgcttccgaagccctcgcaggcttccgggtgccagagcaggagacataccctctgtccagccctccactctcagtccccagtttttttcctacttttgcttttcaggagtcgtccagcaagacttgaaaggaggagaaaggcctgctggacaggatgctagagcctggcagtgaccacttgggggccctgggcattaaataaacttcttggggcccgtttcgttatt

SEQ ID NO: 10483 - DNA, 3563 bp, Homo sapiens
tcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcaggtgaaggcaggctggtggctgaaggacctccttcttatcttccacaggggctggaagttaaaacccctgttggtgtttagtggtggtggttgttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaactgac

SEQ ID NO: 10484 - DNA, 3560 bp, Homo sapiens
tcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctctgtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcaggtgaaggcaggctggtggctgaaggacctccttcttatcttccacaggggctggaagttaaaacccctgttggtgtttagtggtggtggttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaactgac

SEQ ID NO: 10485 - DNA, 115 bp, Homo sapiens
ttttttgtatttttagtagagacggggtttcaccgtgttagccaggatggtctggatctcctgacctcatgatccgcctgcctcagccttccaaagtgctgggattacaggcatg

SEQ ID NO: 10486 - DNA, 1092 bp, Homo sapiens
ctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 10487 - DNA, 1092 bp, Homo sapiens; identical to SEQ ID NO: 10486

SEQ ID NO: 10488 - DNA, 117 bp, Homo sapiens
tagtagagacggggtttcaccgtgttagccaggatggtctggatctcctgacctcatgatccgcctgcctcagccttccaaagtgctgggattacaggcatgagccactgcacctgg

SEQ ID NO: 10489 - DNA, 981 bp, Homo sapiens
gaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggattctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaaaa

SEQ ID NO: 10490 - DNA, 979 bp, Homo sapiens
gaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggtttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaa

SEQ ID NO: 10491 - DNA, 115 bp, Homo sapiens
agcagagacggggtttcaccgtgttacccaggatggtctcgatctcctgacctcatgatccacctgccttggcctcccaaagtgctgggattacaggcgtgagccaccacgcccg

SEQ ID NO: 10492 - DNA, 6804 bp, Homo sapiens
cggaagacaccctgtgccatgtggaggggccctgccctctggggcaagaggtcagggaggagggcgctggctgggttcccaggcgcctgcccctgagaggcgcaaatggccctaatggggttattaggtggagcagatgcgtccggctcctgctgtggaggaaatgctcaaatgatcttgaagctaccaggctgggagaggcaggcaggggatggggcagacaggctgccaacctctgtgagataagccctggcctctccagaaccttttcagaacagctatgagccccaaccctggggctgagtgacccaagacagatcactcacactctctgggcctcagtttccccttacataaaaagcaatggttaggccaggtgcagatggctcacacctctaatcctagtgctttgggaggccgaggtgggaggattgcttgagaccaagagttcaagtccagcctgggcaacatagcaacaccccatctctacaaaacataaatacaaaaattaaggccgggcatggtggttaaggccaggcgtggtggctcacacttggaatcccagcattttgggaggcagaagcaggaggatcacctgaggtcaggagtttgagaccaacctggccaacatggtgaaaacccgtctctatacaaaatacaaaaattagccagccatggtggtgcatgcctgtaatccctgctactgtggaggctgaggcaggagaatcacttgaacccaggtgaaggaggtttcagtgagcccagatcatgccactgcactccagcctgggtgacagagaacaagactgtctcaaaacaaaacaaaagaaaaattagccagacatggtagtgtgaacctgcagtcccagctactatggaggctgaggtgggaggatcgcttgagcccaggagttggaggctgcagtgagctatgatggcacccctggacaccagcctctgtgacagagcaagagcctgtctctaaagtgaaacatttttaaaagggaaggtgaactgggtgaactctaagaccctgcatttcacaaacccttgcccacaccctgtatgcgtcgggccctggcagggaacagatggtacgctgtctcacagggcaattgagagcgtttacaaaggtgtgggcagcattaggggaatggaccagagagggtgacctgggacttggctgtaatggggccctaagcactcctggatctgattgctgatgggagggagggagtgatgtttcccgatcagcaggcagtggccatgggtgaggggccccgcaggagcaggggctgtaagtgaaaggatgaagccaccagagggaactgggctctgtcttcccgccccctgatctcatgccagtgcctccactggccacacctcacgagaagcaagagagtgtggggtctcagtggtgcagtccctggaggccaatctgctgggtcagagcaggacagagaaagcgaaatggacatacataggcacacgccgctttcatgctgatccagtggaattagatccttcctgttctttcttttgtttctttctttttttttttttccttttttagagatggggtctcactctgttgcccaggctggggtatggtggcgtcttcatagctcactgtagcactgaactcctgggctcagacgatcctcccaccttggcctcccaaagtgctgggattacaggcactacaggcacctagctaactttctttttttttgtagaggcagggtctctgtcacccaggcttgagtgcagtggcacgatcatagctcactgcagccttgaacccctgggttcaagcaatcctcccacctcagcctcccaagtagctgggattataggtatgtgccaccacccagctaatttttttattttttgtagagatggggtctcgccatgttgcccaggctagtttggaactcctgagctcaagagatgctcccaccttggcctcccaaagtgctgaaattacaagcataagccaccatgcctggcctcccttcctggccttctggtctccagactggagagagggccacaaagtcctgcccagacagagggctgctaaggctggggtggggctgggggtgtgcagaagggactctgcaggggctgacctctgagtctcaggggacagggcaaatttttttttttttttttttttgagatggagtcttgctctgtcgcccaggctggggtacaatggcacgatctcggctcactgcaatctccgcctcctgggttcaagtgattctcatctctcagcctcccgagtagctgggattacaggagtgcaccaccatgcccagctgatttttgtatttttagaagagattgggcggggtggggggtggggtgcgggtttcaccgtgtggcccaagctggtcttaaactcctgacctcaagtgatcctcccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctgggtagccccctacccacatgcctcagcattgggaggtggggagtatgggggtcccccttctcctcagccccatttggagtaatgtcctgtgcagctgagctcacaactcctcctccacctgtcccttcacccggtgtcactggcaattgctcacttcctgggcctgcacccactcagctcccctatccctgggcatcagcctcagccagctcccatgtggactaatgacccttgtccctcccctcagctgcctctcttttttctttttttttttgtttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtatttcggtagagacggggtttcaccatgttggccaggctggtctcgaactcccgacctcaggtgatccgcccgcctcagcctcccaaattgctgggattacaggcgtgaggcagctcgcccggcaaccctcagctgcctctcatatgtccttggccccctggccatctctgaccagacatctaggaggcccctcctgccaatatgcttccccgacagccgagcccaaagctgtctccagccctgcaccttgtcttggttccccgggtgctccctttcccaggctgaagcctggacagccccaggcaacctctctccctgaccacagtaccacctggccacatgccacactgctttctacagcagacaccgcctggccacaaagacttaagccacttccttgggtcctgctcagcgctgagcccagagcccaatctcagggactgggagagagcccagtacatggccagtgggattctcccgatgaaaatcccagccatgtgaggctggcttctccaggttctctgaggcctgtgagtccagggctggctggagggaaagcccctggccccttaaagccactgatcatgttcccatagagggatcctgagaatcccctgggagagaaaatgtcggagccccagtcctggcacccccctgaccagcttgggcctcagcctcctcatccatgaaaagaatggacaagaggggtctgggtgcggtggctcacgcctgtaatcccagcactttgggaggccgaggcaggtggatcacgaggtcaggagttcaagaccagcctggtcaacatggcaaaaccctgtctctactaaaaatacaaaaattagccggttgtggtggtgcacgcctgtagttgcagctatttaggaggctgaggcaggaggatcactggaacccgagaggcagaagttgcagtgagctgagattgtgccacggcactccagcttgggcaacagagccagactccatcttaaaaaaaaaaaaaaaaaggagggacaagaggcaccagaagctcctgtccaggtctgggcctccctcgggtcactcagttctcccccattcattcattcattcactcactcactcactcactcattcccacactctgcagccactgacttcagctagccatgctggatgctaagacatagagtcccggccatcaaggccagtccatctcagtggcatctagacatgcacagagatgaccagggagcccctaagggacagagaggcacaccctgcctcctgatcccatctgggggctgcatgaaggaggggcacaggtgtggccttgaaggctgggtaaggggctgggagggctttaggggcattccagggggcaggcacagaactggaggctctgccgggcacacccacaggagagcaatggctggagggtgacatggactgcagggtatggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctctgtgccccctctcttatgtctctcacgctgtctcttgtccttgtttttaactctgacacgccatgggaacttggctcacttcctagggggaagctgtctggactggcccagagatgggcaccaccatttcccaataaacacaagataaaatcagagagctggcgtcagttccgcggctggactcagtggggaaaagggcaaaaagcagcagaaataagagcagggaaagaacaggggctgggtgcgatgggtcccatctgtaatcccagcgctttgggaggcctaggtgggaggatcgcttgagcccagaagttcaagaccagcctgggcaacatacggagacccccatttctaaaagttttaaaaattagctgggcatggtagtgtgcatctgtggtcccagctactcaggaggccgaggtgtgaggatcgcttgagcccaggaggtcgaggctgcagtgagctatgattgcatcactgcactccagcccgggcacagagcaagaccctgagaccttggcagaaagaaagaaagagagaaagagagaggagagggagagggagaaagaaaggggggggggagagagagagagagagagagagagagagagatgaaagagaaggaaggaaagaaagaaaggaaagaggaaggaaggaaggagaggggaaggaaggaaggaggggaaggaaggagagagagaggaaggaaggaaggagggaagggaaggaaaggggaggggaggggaggagagggagaaaagaaaggaaaaagaacaagtggatatcaggggacagaaaccattcgcagcccatccctcggcagatgcagagggagtcagcctggaacccccacccctgctggctgtgccccaccgctgtctccacaccccagcccttcctccagacacccagccgtccactgcagcaggagcacaggtgccccaaggggaccactgttggaaaccaggcagccctccactcacccacacagtgtgtctctgcaccccctctttgacatgggagccggggcgctcttggaaataagggtttacctgaggggtctgaagacttgggcagtggggggctgtgaagccttggggagggaatcagcttgtccaagagtctggggcagcgagtggtcgggggctacccggtctgaccccatcaaagtaaccttcctgggggatatttccattgcagggtcacaaaaaggcaagggctaaggttcgagagaggggtctctctggggtcccagccaccctgctgtgggggcccttcccaagcaggacactccaggcaaaggggatggctttcccttgctcccaggacccataggtgaggtcctggctgaaatgcagactgtccccagatgcccctggggacttgtagggatttgggggattcagtgttgcaggagctggaacccttgcttgctggacgggtttgagctgtgctgtcaggcccaaagctcctgggtctccaggatggtgcatgagggctcacaccagctgctccctgccacccttcccccacctcccaccccttctcctggagccccagtcctctggtcctccaagctcagcttcaaatgcttccaccacttctgtctcttctacctcgagtggtttgtcaacctccaaatcacacggagttcaagaatatctcaaatatcgaccaggtgcggtgtctcacacctgtaatgccagcactttgggaggccgaggcgggtagatcacctgaggtcaggagttcgagaccaggctggccaacttggtgaaactctgtctctactaaaaatacaaaaattagccgggcgtgatggtgggtgcctgtaatcccatctacttgggaggctgaggcaggagaatctcttgaaccagagaggtggagattgcaatgagccaagattgtgccactgcactccagcctgggcaacagagtgagactctgtctcaacaacaacaacaacaaaaagaatatctcgaatacaaaaattagctggccgtggtagtttacacctgtaatccgagctactcaggaggctgaggcagtagaatctcttgaacctgggaggcagaggttgcactgagctgagatagcgccactgcactccagcctgggtgacagagcaagacgtcatctcgaaaaaaaaaaaaaaaaa

SEQ ID NO: 10493 - DNA, 6807 bp, Homo sapiens
cggaagacaccctgtgccatgtggaggggccccgccctctggggcaagaggtcagggaggagggcgctggctgggttcccaggcgcctgcccctgagaggcgcaaatggccctaatggggttattaggtggagcagatgcatccggctcctgctgtggaggaaatgctcaaatgatcttgaagctaccaggctgggagaggcaggcaggggatggggcagacaggctgccaacctctgtgagataagccctggcctctccagaaccttttcagaacagctttgagccccaaccctggggctgagtgacccaagacagatcactcacactctctgggcctcagtttccccttacataaaaagcaatggttaggccaggtgcagatggctcacacctctaatcctagtgctttgggaggccgaggtgggaggattgcttgagaccaagagttcaagtccagcctgggcaacatagcaacaccccatctctacaaaatataaatacaaaaattaaggctgggcatggtggttaaggccaggcgtggtggctcacacttggaatcccagcattttgggaggcagaagcaggaggatcacctgaggtcaggagtttgagaccaacctggccaacatggtgaaaccccgtctctacacaaaatacaaaaattagccagccatggtggtgcatgcctgtaatccctgctactgtggaggttgaggcaggagaatcacttgaacccaggtgaaggaggtttcagtgagcccagatcatgccactgcactccagcctgggtgacagggaacaagactgtctcaaaacaaaacaaaagaaaaattagccagacatggtagtgtgaacctgcagtcccagctactatggaggctgaggtgggaggatcgcttgagcccaggagttggaggctgcagtgagctatgatggcacccctggacgccagcctctgtgacagagcaagaccctgtctctaaaatgaaacatttttaaaagggaaggtgaactgggtgaactctaagaccctgcatttcacaaacccttgcccacaccctgtatgcgtcgggccctggcaggaaacagagggtacgctgtctcacagggcaattgagagcgtttacaaaggtgtgggcagcattaggggaatggaccagagagggtgacctgggacttggctgtaatggggccctaagcactcctggatctgattgctgatgggagggagggagtgatgtttcctggatcagcaggcagtagccatgggtgaggggccccgcaggagcaggggctgtaggtgaaaggatgaagccaccagagggaactgggctctgtcttcccgccccctgatctcatgccagtgtctccactggccacacctcacgagaagcaagagagtgtggggtctcagtggtgcagtccctggaggccaatctgctgggtcagagcaggacagagaaagcgaaatggacatacagaggcacacgccactttcatgctgatccagtggaattagatccttcctgttctttcttttctttctttctttttttttttttttccttttttagagatggggtctcactctgttgcccagggtggggtatggtggcgtcttcatagctcactgtagcactgaactcctgggctcaggcgatcctcccaccttggcctcccaaagtgctgggatttcaggcactacaggcacctagctaactttctttctttcttttttttttttttgggtagaggcagggtctccgtcacccaggcttgagtgcagtggcacgatcatagctcactgcagccttgaacccctgggttcaagcaatcctcccacctcagcctcccaagtagctgggattataggatgtgccaccacccagctaatttttttattttttgtagagatggggtctcgccatgttgcccaggctagtttggaactcctgagctcaagagatgctcccaccttggcctcccaaagtgctgaaattacaagcataagccaccatgcctggcctcccttcctggccttctggtctccagactggagagagggccacaaagtcctgcccagacagagggctgctaaggctggggtggggctgggggtgtgcagaagggactctgcaggggctgacctctgagtctcaggggacagggcaaatttttttttttttttttttttgagatggagtcttgctctgtcgcccaggctggagtacaatggcacgatctcggctcactgcaatctccgcctcctgggttcaagtgattctcatctctcagcctcccgagtagctgggattacaggagtgcaccaccatgcccagctaatttttgtatttttagtagagattgggcggggtggggggtggggtgcaggtttcaccgtgtggcccaagctggtctcaaactcctgacctcaagtgatccttccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctgggtagccccctacccacatgcctcagcattgggatgtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtggactaatgacccttgtccctcccctcagctgcctctcttttttctttttttttgtttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcaaactcccgacctcaggtgatccgcccgcctcagcctcccaaagtgctgggattacaggcatgaggcagctcgcccggcaaccctcagctgcctctcatatgtccttggccccctggccatctctgaccagacatccaggaggcccctcctgccaatatgcttccccgacagctgagcccaaagctgcctccagccctgcaccttgtcttggttccctgggtgctccctttcccaggctgaagcctggacagccccaggcaacctctctccctggccacagtaccacccggccacatgccacactgctttctacagcagacaccgcctggccacaaagacttaagccacttccttgggtcctgctcagtgctgagcccagagcccaatctcggactgggagagagcccagtacatggccagtgggattctcccgatgaaaatcccagccatgcgaggctggcttctccaggttctctggggcctgtgagtccagggctggctggagggaaagcccctggccccttaaagccactgatcatgttcccagagagggatcctgagaatcccctgggagagaaaatgtcggagccccagtcctggcccccccttgaccggcttgggcctcagcctcctcatccatgaaaagaatggacaagaggggtctgggtgcggtggctcacgcctgtaatcccagcactttgggaggccgaggcaggtggatcacgaggtcaggagttcaagaccagcctggtcaacatggcaaaaccctgtctctactaaaaatacaaaaattagccgggtatggtggtgcacgcctgtagttccagctatttaggaggctgaggcagtaggatcactggaacctgagaggcagaagttgcagtgagctgagattgtgccacggcactccagcctgggcaatagagccagactccatcttaaaaaaaaaaaaaaaaggagggacaagaggcaccagaagctcctgtccaggtctgggcctcccttgggtcactcagttctcccccattcattcattcattcattcactcactcactcactcactcactcactcattcccacactctgcagccactgacttcagctagccatgctggatgctaagacatagagtcccggccatcaaggccagtccatctcagtggcatctagacatgcacagagatgaccagggagcccttgagggacagagaggcacaccctgcctcctgatcccatctgggggctgcatgaaggaggggcacaggtgtggccttgaaggctgggtaaggggctgggagggctttaggggcattccagggggcaggcacagagctggaggctctgccaggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctccgtgccccctctcttatgtctctcacgctgtctcttgtccttgtttttaactctgacacgccgtgggaactcggctcacttcctagggggaagctgtctggactggcccagagatgggcaccaccatttcccaataaacacaagataaaatcagagagctggcgtcagttccacggctggactcagtggggaaaagggcaaaaagcagcagaaataagagcagggaaagaacgggctgggtgcgatgggtcccatctgtaatcccagcgctttgggaggcctaggtgggaggatcgcttgagcccagaagttcaagaccagcctgggcaacatacggagacccccatctcttaaaaagttttaaaaattagctgggcatggtagtgtgcatctgtggtcccagctactcaggaggccgaggtgtgaggatcgcttgagcccaggaggtcgaggctgcagtgagctatgattgcatcactgcactccagcccgggcacagagcaagaccctgagaccttgtcagaaagaaataaagagagaaagagagaggagagggagagggagaaagaaagggagagagagagagagagaaagatgaaagaaagaaaaagaaagcaaagaaagaaggaaggaaagaaagaggaaagaggaaggaaggaaggagaggggaaggaaggaaggagaggggaaggaaggaaggaggggaaggaaggagagaggaaggaaggagaggggaaggaaggaggggaaggaaggagagagaaaggaaggaaggaaggagggaagggaaggaaaggggaggggaggagaaggagaaaagaaagaaaggaaaaagagcaagtggatatcaggggacagaaaccattcgcagcccatccctcagcagatgcagagggagtcagcctggaacccccacccctgctggctgtgccccacggctgtctccacaccccagcccttcctccagacacccagccgtccactgcagcaggagcacaggtgccccaaggggaccactgttggaaaccaggcagccctccactcacccacacagtgtgtctctgcaccccctctttgacatgggagccggggcgctcttggaaataagggtttacctgaggggtctgaagacttgggcagtggggggctgtgaagcctcggggagggaatcagcttgtccaagagtctggggcagcgagtgggcgggggctacccggtctgaccccatcaaagtaaccttcctgggggatatttccattgcagggtcacaaaaaggcaagggctatggttcgagagaggggtctctctggggtcccagccaccctgctgtgggggcccttcccaagcaggacactccaggcaaaggggatggcttccccttgctcccaggacccataggtgaggtcctggctgaaatgcagactgtccccagatgcccctggggacttgtagggatttgggggattcagtgttgcaggagctggaacccctgcttgctggacgggtttgagctgtgctgtcgggcccaaggctcctgggtctccaggatggtgcatgagggctcacaccagctgctccctgccacccttcccccacctcccaccccttctcctggagccccagtcctctggtcctccaagctcagcttcaaatgcttccatcacttctgtctcttctaccttgagtggtttgtcaacctccaaatcacacggagttcaagaatatctcaaatatcgaccaggtgcggtgtctcacacctgtaatgccagcgctttgggaggccgaggcgggtagatcacctgaggtcaggagttcgagaccagcctggccaacttggtgaaactctgtctctactaaaaatacaaaaattagccgggcgtggtggtgggtgcctgtaatcccatctacttgggaggctgaggcaggagaatctcttgaaccagagaggtggagattgcagtgagccaagattgtgccactgcactccagcctgggcaacagagtgagactctgtctcaacaacaacaacaaaaagaatatctcgaatacaaaaattagctggctgtggtagtttacacctgtaatcccagctactcaggaggctgaggcagtagaatctcttgagcctgggtgacagag

SEQ ID NO: 10494 - DNA, 240 bp, Homo sapiens
gggattacaggcgtgagccactgtgcccagctcatgcaacacttatcatcaggattcccgctcagtgctcggaccccaggggccagagatgcccgcggcaaggttctgccctcaaggtgcccactgctttagggggaagacagtgatactaccacatacgagagaaggagaggacacaactgtcagggagatggactgttggagcttcagaggcagcatcttggggaggggtggctttga

SEQ ID NO: 10495 - DNA, 1443 bp, Homo sapiens
gttcgagaccagcctggccaacatggcgaaaccctcgtctctactaaatatacaaaaattaactgggcgtggtggtgagtgcctgtaatcccagctattcgggagcctgaggcagggcaattgcttgaactcgggaggcggaggttgcagtgagccgagatcgcaccactgtacgacagagcaagactccgtctcaaaaaaacaataaaaagaattgctggaggagggaagtgaggggcggctggcgggggactgctgggctggtgcagagggagtcaaggatccctaagagagaggcaggggtgttcagctctcccacctctgctggatgaacttgcagagcctccttggtgacccagcccgtgcagagactctgctcaggacaacacccttgcctgggacccccacatctctggccccagcagcagcccttgggggggtccctttatcttcctccactcctacccaggcttcctcagcaggagatgaggcaggacatttccactccctttctggaaggttcagaaggttaatgagagctaagcacgtaagtccatttagggggatgaacttctgggaagagaggaacctgggtctgggctgacgtccaagggcgggctgggtgacggtccctctgatcacggaccctgtccacccactgcccagggccctgcctcgacccctctgaccagccaccgagccccagagggatctccatgaatgtcagagacattgactggaggccttatctccagtgggagaccccttctcttcccactgtgggccggttccagcctgggctgtccaggaagtgacctctcagggcctgggaagggtgtggccagtggttcttggttgtactcaactcatctgccttgggtctaaggctggggtgaatggaagggcccacctggaccctggagggacaccaggctcatactaaaatcccaaaaagtgaaaagctttccccaggcccaagcagagaaactggaccttgaagctacatctctggacttagtcctcaaagtaggagacatttgcctctaagctgttctctcccaccccacctttctgtgagccgccggttccctgttgtccacatcaagctgtgtgctgggcactgggtgcaggaatagcttgaccacagtctctatcctgggggtaaaggggtgaccagcccacagagggatggactgcaaacagacagtcccaaagtgccatgagagaagctctcagggcctgggcgtgatggttcatgcctggaatcccagcactttgggaggccgaggtgggtggatcagttgaggtcaggagttcgagaccagcctggccaataaggtgaaactccatctctactaaaaataaataaataaataaataaataaataaataatacaaaaattagccgggcatggtggcatgcacctgtaaacccagctactt

SEQ ID NO: 10496 - DNA, 1443 bp, Homo sapiens
gttcgagaccagcctggccaacatggcgaaaccctcgtctctactaaatatacaaaaattaactgggcgtggtggtgagtgcctgtaatcccagctattcgggagcctgaggcaggggaattgcttgaactcgggaggcggaggttgcagtgagctgagatcgcaccactgtacgacagagcaagactccatctcaaaaaaacaataaaaagaattgctggaggagggaagtgaggggcggctggcgggggactgctgggctggtgcagagggagtcaaggatccctaagagagaggcaggggtgttcagctctcccacctctgctggatgaacttgcagagcctccttggtgactgagctggtgcagagactctgctcaggacaacacccttgcctgggacccccacatctctggccccagcagcagcccttgggggggtccctttatcttcctccactcctacccaggcttcctcagcaggagatgaggcaggatatttccactccctttctggaaggttcagaatgttaatgagagctaagcacgtaagtccatttagggggatgaacttctgggaagagaggaacctgggtctgggctgacggccaagggcgggctgggtgacggtccctctgatcacggagcctgtccacccgctgcccagggccctgcctcgacccctctgaccagccactgagccccagagggatctccatgaatgtcagagacattgactggaggccttatctccagtgggagaccccttctcttcccaccgtgggccggttccagcctgggctgtccaggaagtgacctctcagggcctgggaagggtgtggccaatggttcttggttgtactcaactcatctgccttgggtctaaggctggggtgaatggaagggcccacctggaccctggagggacaccaggctcgtactaagatcccaaaaagtgaaaagctttcctcaggcccaagcagagaaactggaccttgaagctacatctctggacttagtcctcaaagtaggagacatttgcctctaagctgttctctcctaccccacctttctgtgagccgccggttccctgttgttcacatcaagctgtgtgctgggcactgggtgcaggaatagcttgaccacagtctctatcctgggggtaaaggggtggccagcccacagagggatggactgcaaacagacagtcccaaagtgccatgagagaagctctcagggcctgggcgtgatggttcatgcctggaatcccagcactttgggaggccgaggtgggtggatcagttgaggtcaggagttcgagaccagcctggccaataaggtgaaactccatctctactaaaaataaataaataaataaataaataaataaataatacaaaaattagccgggcatggtggcacgcacctgtaaacccagctactt

SEQ ID NO: 10497 - DNA, 290 bp, Homo sapiens
atgttgcccaggctggtctcgaactcctggtctcaagtgatcctcctgctgggattacaggcgtgagccactgtgcccagctcatgcaacacttatcatcaggattcccactcagtgctcggaccccaggggccagagatgcccgtggcaaggttctgccctcaaggtgcccactgctttagggggaggacagtgatactaccacatacgagagaaggagaggacacaactgtcagggagatggactgtttgagcttcagaggcagcatcttggggaggggtggctttga

SEQ ID NO: 10498 - DNA, 3987 bp, Homo sapiens
ctcgctctgccccgcgtcccagccatggcgacatcctcggccgcgctgccccgaatactcggcgcgggtgagcgcgcgcttgcgggaccctggggaggagcatgcgaggaggatgcggaggggcgcggggacccgatggagcggcggggacgtggaggggacccggggcgagcgcggaggggactcggggagggcgcggggacgcggaggggacccgttagggacgcggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccggtaacactgggcgcccagccgagttgggtgggaacgaggagaggccggcagccgcgggggatgcgaaccctagaggggcctgggcgctgcacgcggtcgaaactgcgcgctccgctgggctcctcccactcccgtgctcgccgccgctcggtcctgcctgacgtagcacagcgggctgaggccaccgcctcaccatggatagggtgagagggagcgggcgggccagtggttagcacaggcttcgctccctaggggggtgtcactggaccaccgaggcccggagccccgagctcgcccaggcgggcccaagtgacctgggggcactgggcttggagtctgcccaccttgctggactcctgatggggactttctggctggccacctgagaccacaaggcggggaggtgccagaaagacctgagcaacccgctgggcccctctctttttctcctctgtcttccaagtaagaccaagggacggggttgaccaggttcgaccaggcttacccaggagcaaggtcgggatcagaacctggctccagccctctgtttcctgaaaaggtccctgtgcttccaggtctttcctggggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtccatctgggacacaaagctggctgtcggcacaggtaggtgacacccccatctgagcccggggcggttcccaggaggaacctgggacctgctctggttctagggccacttttgaactggcctatgtcagttttaggtgattacagccccatcctcctccacatgggaatacagagccccacagagaagcaggagtttattcctcagcttggcggacgctcttgtgtgccttggtgtggcgctcacagcccttgatagggcaggcctgctgggggttgcaggactccacgggttcagaaatggaaaggctgagggcagaacctgtaaggttggtccccccggatcgggctgggccttctgggctgcggggaggaggaatgactggtcctgtattctcacatggtcattttgactgctgtggggggaggggatgggaggggcaggtgggaggccagggaggaggttggtgtgggcgttcagggtgaaggtggcggggcttaaatcgcagtagcggaagagctggagcagcaggtggacatgaggcagcagggcagagccagtgggccttgggctggggtgggaggtggctggggccgaagggatcaaacacctgctcttcgggtggagcctggtactggttactgagatggtgaaaaccaggggagacctgggggacatcacaagcttggttcctaccaggtatgaaccctttgctgccccagtggagaggtcacacggttaccaggagggatgggcctgggcccagggagccatcagcatcgggggctggcaggtgtttccagagcatcggaaaaggaggtccaaggtggagccctgggtgctccagtgtttggagtcagtgaagagggacagccgggggtaggggagatgtggttctctgttgatgctgctgagaagtgaattcaaggctgtgaccttggcaagatggaggtcgccagtgccttgatgggcagggttgcttgagaggaagggacagaacccagtgggagtagactggaggtgaggacctgggaaccgcaaatgtggatgactcgcctgtcacgcaccgagaggcgggggtgtctcccatgccccgcttttctcagcccaggccagcagtggtccagtgctttggatcagggttccccgcccaggcttggccactcctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 10499 - DNA, 3988 bp, Homo sapiens
ctcgctctgccccgcgtcccagccatggcgacatcctcggccgcgctgccccgaatactcggcgcgggtgagcgcgcgcttgcgggaccctggggaggagcatgcgaggaggatgcggaggggcgcggggacccgatggagcggcggggacgtggaggggacccggggcgagcgcggaggggactcggggagggcgcggggacgcggaggggacccgttagggacgcggaggggcccgttggggatgcggtggggagcgggcgtggtgcattcgggactcggcgccaggacctctatctacttccccccaggtgcccgggccccgtcgcgctggttgggctttctcgggaaggcgacccccccggcctgctcggccgagccgcaggacgcttggaagcgcgacggcccttatgatccgcgagtcggaggacagcaccggtaacactgggcgcccagccgagttgggtgggaacgaggagaggccggcagccgcgggggatgcgaaccctagaggggcctgggcgctgcacgcggtcgaaactgcgcgctccgctgggctcctcccactcccgtgctcgccgccgctcggtcctgcctgacgtagcacagcgggctgaggccaccgcctcaccatggatagggtgagagggagcgggcgggccagtggttagcacaggcttcgctccctaggggggtgtcactggaccaccgaggcccggagccccgagctcgcccaggcgggcccaagtgacctgggggcactgggcttggagtctgcccaccttgctggactcctgatggggactttctggctggccacctgagaccacaaggcggggaggtgccagaaagacctgagcaacccgctgggcccctctctttttctcctctgtcttccaagtaagaccaagggacggggttgaccaggttcgaccaggcttacccaggagcaaggtcgggatcagaacctggctccagccctctgtttcctgaaaaggtccctgtgcttccaggtctttcctggggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtccatctgggacacaaagctggctgtcggcacaggtaggtgacacccccatctgagcccggggcggttcccaggaggaacctgggacctgctctggttctagggccacttttgaactggcctatgtcagttttaggtgattacagccccatcctcctccacatgggaatacagagccccacagagaagcaggagtttattcctcagcttggcggacgctcttgtgtgccttggtgtggcgctcacagcccttgatagggcaggcctgctgggggttgcaggactccacgggttcagaaatggaaaggctgagggcagaacctgtaaggttggtccccccggatcgggctgggccttctgggctgcggggaggaggaatgactggtcctgtattctcacatggtcattttgactgctgtggggggaggggatgggaggggcaggtgggaggccagggaggaggttggtgtgggcgttcagggtgaaggtggcggggcttaaatcgcagtagcggaagagctggagcagcaggtggacatgaggcagcagggcagagccagtgggccttgggctggggtgggaggtggctggggccgaagggatcaaacacctgctcttcgggtggagcctggtactggttactgagatggtgaaaaccaggggagacctgggggacatcacaagcttggttcctaccaggtatgaaccctttgctgccccagtggagaggtcacacggttaccaggagggatgggcctgggcccagggagccatcagcatcgggggctggcaggtgtttccagagcatcggaaaaggaggtccaaggtggagccctgggtgctccagtgtttggagtcagtgaagagggacagccgggggtaggggagatgtggttctctgttgatgctgctgagaagtgaattcaaggctgtgaccttggcaagatggaggtcgccagtgccttgatgggcagggttgcttgagaggaagggacagaacccagtgggagtagactggaggtgaggacctgggaaccgcaaatgtggatgactcgcctgtcacgcaccgagaggcgggggtgtctcccatgccccgcttttctcagcccaggccagcagtggtccagtgctttggatcagggttccccgcccaggcttggccactcctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaga

SEQ ID NO: 10500 - DNA, 649 bp, Homo sapiens
gggactcggcggcgtcctgttgccaagcgacggccaggtcacgtgactggggagcgagcggaggggccttaaaggcgccgcgcgtgggccgggttcctctgcgggtgggtccggaacctgccgggcgactccccaagggccgggaaggtcgggacggcgagagattccctgctgggaccgtcgtgtgaggcagccccaggcccccagccacccgcggggggaccgggccaccccagcatcagggcgtggactcccgggcgaaagaaaccccagggcctgggaccccgccagccgggtgacggggtttaagcactgcaggtccactcggcaggcaacgattggacttttgctgtccaatgtactccagggatgctatgccccccagcaccccgagtctaaattgagacccgagatctggctaactttatgaaattctcctaagccaaatatcgtttaaatattacaaacagttttggagagcgagaggttgcgcaggacgtggttcacagctcacttggcgggaggcgagggtccccatcgcccagcgggcttccccaagggtcaggggcctcccgggctggccggtcccattagcagggcggggcgagctgcagggcgaggaccgtggctccactccccgcccgagact

SEQ ID NO: 10501 - DNA, 649 bp, Homo sapiens; identical to SEQ ID NO: 10500

SEQ ID NO: 10502 - DNA, 30904 bp, Homo sapiens
ttcttaaacccaagctgactttaatgagaattttaaaatttttaaataggtctctggcaaagaacaatgcaggagtaaggatccaggcacagtccaacatctccctgaggcctccacacaggcccctcaaactgcacccattctgaccatgcaccactttccacagacctggtcccacagccgtcccttcatttggggaagtagggaagggatggctttgggggatgcagagcccatcctcagccctgccatctgccccacttcttaggacttcctgggattgtccttcccttgactctcccatccctctggtcccctggtctcacacagcatggcccctcccaccctctggcttctgctggttctaaccatcttctttgatccctagtgccacctccccatggtcccccttagccacctcagccttgccgtccttctcaggtagagccctctgacttgaccccagtcttgtcagtccctactctagagagcccacagtcccagctccctgaggccccgctcttctggacctggctgtacagggctgagttgtggcttttgatgccactgccagttgcagtaccaggttcagggaaggctgggccctggggcttgggagcaaggaggggctttgtgctccgagggggtggcacagcgtagtcatcagtggcagggttgtaggggagctcatagccctcctccttcacccgagcttggcaccaccatgcatccttgggctcccgaggcagatcataaaggccctggggagggactggggccaggccctcaggttcatcatagatgggatcctctttggggtctgtcagcttggccttcagcaactgctgctgcgcatgctcatacaagtcccaatagagaggtttcttccgttgtactccctctcctgcctgagcagacgtgctgtccaaggggtctgagtatagggagtcctgggaagggcatggagcaatgcgcagggagtctaagggctcagcatacagggctgggggactgtcgaggagctcttgggggccaggtggggaaggcaacttcccctctgccacctccccttcatgggagtcagctctgagaacatcgtgcccctgtccggcctttccctgggccttctgccggtggatggcagtctcaactgcctggaagatgtcatttccctgtgccgtctggaaggtgaaggttccagggcctgaggggcagcggcggccggcctcgaaagagaacatgacctaaggagggtagagggggaaacacattaccaggagccatcagaggaagtgagtcacacgcctgcactagttagggtatctacaaagaagagaccacctgcgaacagacgcggggtcaccgggtaggcaagaaagggggatccaaaggtcagagcttcccactttctgtcctgccccacccctcccacagctgcccaacccaggaagccctcccggacagcccctgcaccttgtcccggccatagcgacgcaacagagtgtagggccaggacaggagtggctccagtatctgactctgggcccccacggtcaggagagtcagcctttcagcctccaccctcagcacgtaggagccatgcaggccacagcgctcggcggcctcagtcctctgcaccgttacccagaattgggatcctggaaggcatacacgattagacagctgcgggggagggacgggggcagcagtggggacccagaggactcatgagcatagtgtccaagcactcactcggaagccagatctcagggccttcctacttcttacttccccatgggcccctgggtatccacccacttcccaaaggccctcggccctcctcctcttcactccatccctgcccgggcttctgaggcgtctaccttcccaggtagggctgtacaaggagttctccagcatctccagggcagaaagcttaggtgggttatcggtaggcgccagagtccagctgcctttctgtagtagagagcatcgagaaacccgtaatttcctcagcggggagcgggggtcggtctgaggcagccccatttctctgcctctgtaactgcccccaccccgcatcgccgcagctcctcaccggaaaggcgtttcggcacagcgtctgcacccaggctgcactggacggcgcgtcggccgccagcaggtgcgagcgctgagcagtgtccaggcggaaggcagtggcgccgggctcagggggggtctccacggtgacgggggccacactcacacactcagccagacggatcactttgcagtccaggcggcgcgagctccctcggccacccccagagctcgaccccttatggtcaaagaactcgagccgcgctacgccgtggggactggccgggtagagcacggcccaggtcttcctccacctctagggagagagagagagtgctcgagagggagtggcgtgcgcaggcggcccgggtcccgacggggaaggaggttgcggcgcaagtcgatttgggatctggggcttccaaacggggttgggggcgaagtttcccaaggacgatgccactccgtctccccaggaccagaacccctagactacagacgcttcccgggagtgtgcaaagcaacttcacgggaaagtcacaggctctccaactcccggcgccgctctccagcccgctgcccacctctccctgtttctgggctctctcacccactactagcccggataaggttcggcatccatgcgccagactaccttggtcccaaagcgctgactctgcaaaaaaagcggcccttccatcactgctccgtccatggcccccggcggttccttccgcgcttcctggccctgcggcgggaggcggggcgggaggcggggccgggttccctggaggagtttccgcccctccccggcccccgccggcagccgctgggggggtcgcggtggggtgagggagaggagcgagaaggaatggtggagacccccggattagccgggagctgcagcaccccaggcccctacccgccgtcgtgggggcgcgccagtggctccaccgaaagtcctcggttttggcgcgagggccctggcctctgggcgtggtggctgcgcgtgacgtcatatgcccaaggtgacgtcagagtgaaagccatgacatcaccccgaaagcgccccgggcaccggagagacccacacgggcctccggggctttatttaccctggccgggcccgcccccagccccgcccgagccgggctgtttagactccgctggcccgggactcggagggagggctggggttgaaccgcttcccgccaccaccggggccgccccgccgcccggccgccgcttgcatgtcagctccctgaccgcagaggcctggcctccatgccgcgggaagagaaagcttcattgaacgagccgggagggccagggagggggagggggcgcggcagtggccagctccacggggagggaggacccagaggaggagaggagggaactggccgggaggaatggaaggagaaggcggaatgtgggagggctcagggggatgtgggagggacgaacggagaagggggagagaggggggtccagtctcccctggccgagcatttttttttttttttggaagtcctaggactgatctccaggaccagcactcttctcccagcccttagggtcctgctcggccaaggtagggggagtcacgctaaccgcagagggaatgagtaggggatggagaggatgtggagggaccagggaaaacgggtggtgtgggatggagtcgaggggaagccacccaactgagagtttgattcttgtcaaagggcaagtgagacagagtacacggaggaggcacataccggaggcgggggctacgggtgttcgaacagggccgccaggagcgccctaagggagggggctcctccgggaggcgctgcccctgggtccccaacccagaacaaagctgccttgttggattgattgtttgggttgggggaagcatgttgacgggggcttgctgtagaggggctgttctcagccctaggcagagaaggccttggctgaggagccatagcgcctggcctcccgttgcccggtgacagggatggtggtgttggcaggaggctgggacaaccctaccccatcccccgcccagccttgaggcctggccctcctgggcctcttgaccctgcagggcatctgagagcctgcgtgttggggagggcgtgcagcaggttctccaggcgagctttggtgccagccttccctgcctgggaatctgctgggttaggactctgggctcccattcaggggatctgtgatcccagggccgcctagggccccttacgtgcctctctgcacaatcagtacagctgtctgtcctccctctgagtaaatggggtcatctggatccctcccacgtccgccccttggctcttgtcaatccctctccttctcacccgcggtgtgcttggttcccctatactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagttgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggtgagcaatgatccaggcatatcctagatatttcctatgtgtggccaaagtgcagggaaagggaacacgaggatggcacagccatagggacacacgacaccaagaacagccagcattgagtaaatccatggatgacaaaccaagcaacatagttacttcccagagctgtgtgaccttaggctagtcagtgctttctctgagcctcagatgccctgtatgcaaaatgactagatgatgtctaagttcttttctgctgcaaaagtatgatcctacaaagccatccacaaaacagcccagatacaggtgagccctgtacaaataaagtacagttagtctcatgggacgctaagagcaggtaaatgatatctggatgtcccaaagtcacaaggggtcacagacactgcagctaacaaaatcaggttatgggccagagctaaaactaacaaggtggtactgtctaaggacaagtataaaatctaggacaagtatgagtgtgggtggtggaggcttaagagcagttccctaggtgaggcctaggactgtgcccatggtatgaacccacagtgggaatgatggacagaagcaggtgcaacctgcagctgattccccagttcccactggctagaccacctgtggaattaagtgtcatttgtagatgctgtgttttaagagggacagtagaaaatggaaatactttcagaggagagctgcctagatgtgaaagattcagaagccaagtttcaaggaggaattgctgaagaatcaggggattgatatggaaagtaaaaaccttgcatagcaatggcgtaatggttgtttttaaatatgggaaggacagtcgtgtggctgaaggatttttctggttggcaccaaaggaatgaatcagatgtggtaggggaaagtcatgaagagtcacaaggactttgatggttacacagtctggtggggcaggagctaggtgtctccgcaacaactgggtaagtcctgttgggatgtgaatgagatgtccttgaacattggctaggacagatgacctttgaggctgcgcccaattctgagaggaagccagtgatactccacagggttcaggccgggctcagtggctcacgcctataatcccagcactttgggaggctgaggtgggtggatcacctgaggtcaggagttcgagaccagcctggccaacatggttgaaaccctgtctctactacaaatacaaaaattagccaggtatggtggcacatgcttgtagccccagctacttgggaggctaaggcaggagaattgcttgaacctgggagacagaggttgcagtgagctgagatcatgccactgcatttcagcctaggcaacagggcaagacttcgtttcaaaaaaaaaaaaaaaacaggtttcagacagagagaagaacaaggggctatatggcagcacagacagggcgggcacaagagagaatgcaaggatgtgaagaaaggatcttagacatccaagcctcacagatagatcaaactcctaagcccccacgtattggctttatggtcttaagcaagttgctcagcttctctaaaccccagtttctttatataaaacagtgttctggcagctctgttctaagaatgatcacatatgtgcacaccatggcagagcacctggcacacagtaggtacctgattaattgtagctatcaatgaatgggtagagactgatcagaacttcagggttgattcttggttttttattcaccgtatcaggttcttgagtatccccagatcacaccaattttccctcaatcttatgcccccttcctattccctgccagggtcccctgtcccgtctccaccccttatcataccagaaagatgggatcatcatggccaagtgggaggcctcagcactcactcttccctacatccccattactcccccatcctccctccccaagcttctctgtcccttcatctccccttccacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtctgcatttcctagacatacacacacacactacccaggatagccgagagtactgtggggtggttagcggagacattagaaggtagttacccctgggggatcatttggattggtgggagacttggaaaagcaaatgatagagctcccagatgctgtaaaatccaacaggtttttagcattcacattcaaggggctaaacctggcatgagcctctccagcttcatccctagtcacccctggggcacctggtgctctccttctcctcaaatgttcctgctttcctgagacatcttccttctgactttctcctccttcaaagccatttcctttttgaagtgctccctcctgctccaggcacagggagggcctccttcctagtgccctgaatcctctctgggagcacagcacatcccacgcgctgctggctgcaagagagtccacaccgcggactgcggccatcgtggccgctctctcagcgccgcctcgggcccatcccgccactgggtttacagcaggcacaccaagcagggttccttaagggcggcgggacacatgaaaggtgccactgggattctttccctgcttgtggccccgcccccaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggtgaggggccgcgggcgccgggcggagcaggccgggattggggtgctccctgatgaatagccttgggagacatctgagcaggtccggggcacgggaggacccgggggtcgggacgcgcgggaaaatatggaggccgttgcaaagctggagagttgggaaatcttgtgggaccacgaaaggtgccccaagggagtacctgaaatggggaccagcgaggctcccgctctctcgtggccgacgcctgggcgggcaggcggattcctcggccccggggcgcgcgccggcctcgcgaggccactcccaggcgcgggggcgattccagcgctggcgctgccggccagcgatttccgagttcagtaaggacgcggccgcccctgggaggcggcgcctgggtgtgtcccgcgcaggctgggcgcccagggtccgggggcccggggacggcggcgcgcgatggccgaagggcgccaggagagaccgcgccagtctctctgcccgggccgccccggggcggggcgcgtatgtgaacgctcgagccctcggggctcctggaagtcctggaagtttcccaggatctcttttggcgaggcccaacctctccacctgcgctggagccctggggtccagtccggcttccagggaaacgcatcaccctggaaactgcctgtgcttaacgtctcccttccctggaacatctactttgatctttttgagaaactgccattgacagccaggcatttatttggaaatctttacaccctctcactgtaatctattttgcgagccaaaaatcctccctttcttcagtggttccctagatcagtattgctgaaaggcctcttgatgtccggataggtttccgcgggcacactacttcagatggggtctgatgccgccagctactgtagaaatcctcaaccccgactgaagcgtgctcggattacactgtcttcctactgcggcagcttcccactgcttatactgaacttgtcatcacttaaaaccagttcaggtcttccctatgcttcctactgatagagcagccttttccaacccaggtataggtgacgtttacctattacatttgttttgatacataatttagaagccataaaaaagccatgatgatcccatgagattatcttgagtcctgatgtgactttccatctgtcatttcccctcagcctcctctgctgaacagacatggcagctttgccttctggcttcatccaaatggctaaaagttgttgtggaaatgtttaaaaccaaagtctaactcttcttgcaaaatgttcctgtagattttcatcaagcttctaatcatcagctgtaaaatatgttccttccaccaactgggaagaaacagaacacttcaatgatgtaaccaacatttcaccttatctatctatatatttcttatctgtaatgaaatcatgggagattctgttagtttttgataaaatccagatatgctatgttcacagccattctccagccttccaatttagtaatcctgtcaaaaaagaaaatcatagtagtttgagtctatttttactgaaatccttttaggtctctaagaatcaccttattttttcctaaatgcttacaaacttctatttaataatttattctagaatattacttatgtgtagattgaggaattgaggaatcctttttctccttttttttttttcttttgaaagtcaggatattatccagtctccagtcttttctatacctgctcacactttctttgccttggctctgaggctcatctgaaatgtctttcagtactgaggactttcggtactttatctggcctggacactcaaaccactttaaaacaaacgtgctgtgcctctttactttcatccatcttggggctgcatttccttctctgtgctgcttaccttccctaatttaaaccccatgttctgaaagatgcgtagaatttagacatttccagtgaagaagatagcgtgaacaaaggtgtagagatccactcacccaatatttatttactgagatcttactatgtgccaggtactgttgtagacactacccgtggctcatgcctataatcccaggactttgggaggccacggtggaagcattatttgagcccaagaattcgagaccagcctgggcaacataatgagaccctgtctctacagataattttttaaaaataaaattagctgaacatggtggtgcgtgcctgtagtcccagctacttgggaggctgaggtgggaagattgcttgagcccaggaagtcaaggctgcagtgagctgtgatcatgccactacactgcctgggtggcagagcaagaccctgtctcaaaaaataaattaactaaggccgggcacggtggctcacacctgtaatcccagcactttgggaggtcgaggcgcggatcacctgaggtcaggagttcgagaccagcctgaccaacatggagaaaccccatctctactaaaaatacaaaactagccgggtgtggtggcgcatgactgtaatcccagctactcgggaggctgaggcgggagaatggcttgaacccgggaggcggaggttgcggtgagctgagatcgcgccattgcactccagcctgggcaacaagagcgaaactccgtctcaaataaaaataaaataaaaataaattaagtaagtaagtaaataaataagtggtgaaggaaggcctcttggagaaggcatcatttgagaaaagatttaaaggaggtgagggcacaagctatgcagacctctagataaacatttctaggaagagggatcaaaaatgaaaatattctggggtgtgtgtgtgcctgtgtgtgtatgtagtgggtgatgggataaggcctctccttctcctggaggccactgtggctggagctgagtgaaaaagaagaaaatggtaggagatgcagtgtaggtggtcttcggaaaagaatgggaagccagatcctgcgggccatctgggagaggatggcttttgttctgtgggagataaggaaccactggagggcttggagcagaggtgtgacatcgggcttccatttttttttcagtactactttcactgctttattaggaatagattgtaagggatgcagtagaagcaagaagtcaggtggctggttatggggttattgtcttctgaaagccacgtaaagaaagtgaaaggtgatggtgaccagtgaaagtggtgaaaaatgatcaagatttacagacagttgaaggcagagctataggacttgctgatggattcagtgtgatgtgagagagaggagttaaggctctctccaggtttttggcctcagctaagtaagaaattggcctcacctgacaaggaaaacagtgaatggagcatgttttgttgggagatgggcttgggggtggagggtaggaacttggttttagacctgttaaatttaagattctttaagacattgaagtggcgaggctaagttaggtaatttaatataggactctggagttcagttgagtaaaacatataaagtcctgaaactggacaacataccaaggaagtgaatgtaaatttaaaagacagagagaggcccagagactgaaccttggggagactaaatatttaaaagtcagaagataagatgaatgcaaacagtgaggtgaggtaggaagaaaaccaggggagtgtggtggcctgggagccaagtaaagtgcttcgaagaggagagagtgaccagctaagtcagtgctgcccagacctaaaaacatgaggactgagaaacaaatgctggatttagcaacagtaaagtcactgttggccccaacagagatgataatgaatggtttatatttggaagacagtaagttagcaagagtaggtttatactgagaaatagtggaagatctggataaagggaggccagaaaatggaatgctttaggtgccaaattggagagtttggcctttgccttatagaaaaattacaaataaaggtatttatatgggacaagaataaagccagtgtttttgaaagtttgcctgatagtagtggatgaggagaggagggtcttgatgcagtaagaccagtcaggagtttgttctaaaattgaagcttatcaggagggtaaaaacaaagatggaggaaaatgaatagatgtaggatgactgatagaacatagagaatgagagaacagacacctaaaatgattccgatgctgcctgagagaaggatggtaccagcagccatctctgggcttcaggttaatatgaactagctttagagatgggctgtccttggaaagtttgagacacaggaattgtccccaggtatgcaaagctgaaataagttttagggatcaggaatatttgttggacatatcggaatctcatactaagtctgggatataaaggctggagaaagagatacactaaagcacagaggccattcttcgtggggaaagagattgcgggagccctgggagattctgtgatggggctatgatctagatccttcacaggtcaggcccagcagagggagcattctcacaggtgatacaattattacaattatgaaagataggcaagacagttgtaaacaactctcccctccttagggaaaaaaaatggatctgctggcttttagaggaagtcagtaagatttagggaatgagaaaatcaaaacctgatgtattaatcatttttcaatttgttttggtagttctaccctagaacatgtaaaagttgtagaactttagaataagaaaagaatgtacagataattgaactatttactactcttttacaggtaatgaaattgaggctctaagagcttcagtgctatttaagaagtcactcttctagttcatttcagcttgacagatgtttattgaactcctatttgccaagtactgtgcaaggtgctgagaatacaaaggtgaataaatgacaagagaggttattaggctgcagatcatagaagaccttataggccatcataaggattcaggtccttatgataaaaggattgggaagcctttgatgtttggattgtttgtttgtttgttttgtttgtttgtttttttgagagggagtctggcttgttgcccaggctggagtgcagtggcacaatctctgctcactgcaacctccacctccctgggttcaagtgattcttctgcttcagcctcctgagtggctaggtctacaggtgcccaccacgcccagctaatttttgtatttttagtagagacgaggtttcaccatgctcgccaggctggtcttgaactcctgacctcaggtgatccgcctacctcggcctcccaaagtgctgggcttacaggcttgagccaccgtgcccggccattgaagtgttttaatggggagggctatgagatggcatgatcaggtttgtgactccaaaagatcatttgaatctatttcttttttttcttttcttttctttttttttttttttttttttttgagacagagccttgctttgtcacccaggctggagtgtactggtgcaatcttggttcactgcaacctccgcctcctgggttcaagcaattctcctacctcagcctctcgagtagctgggattacgggcacgcgccaccatgcccagctaatttgctgatttttgggtatttttagtaaagatggggtttctccatgttgcccaggctggtcttgatctcctgacctcaggatcagatcaagtgatctgcctgtcctggcctcccaaagtgctgggattacagctatgagccaccacgccccgcctttgactctatttctgagaataatcaggagaggagcaaaagatatggattggagagatatttagaagtaaaattgacaggacttggttattgattgactttgggatccaagaaagggagaagtcaggattgacccctaggtttctggagtggattttactgagataattatcttttttttttggacctacattacatttcagattactttcagatctctacctagaaacatcaagaaggcaatgaaatagacaagattatgaatacactaggtgtgaattagaccatatagagggccctatatgaagtgagaacaaaatgcctaagaaagagctccacaaattttaatgaccagataggggaggagcctgcagagaagaccaagaaagagcaaccagaattaggagtaggcggctctaggcacactgcctaggagtcagccctgctccctggggagccactctggaaattaataataataataagcagaattaggaataaaaccaggatattgtagtgttatagcagccaaggaaagagaggacagtcagatgttgcagagaggtcattaagatgaagactgaaaaatgtctgctggatttaacaaaatagaagtttgcagagtgataggtagggaaaaccagaggaagtgggttgaaaaatgagtaagaggaggctgggcatggtggctcacacctgtaatcccagcactttgggaggccaaggcaggtgaatcacctgagatcaggagtttgagaccagcctggccaacatgatgaaactccgtctctactaaaaatacaaaaattagctggctgtggtggtgcgtgcctgtaatcccagctacctgggaggctgaggcaggagaattgctgagcccaggaggcggaggttgcagtgagccaagattgcaccactgcactccagcctgagtgacagatcgagactctgtctcaaaaaaaaaaaaaaaaagtaggaagagaggatataaagatgataagtatggacagctcttgagaaatgttactgtgaaggggaggagagataagtagagggtgtgtgtgtgtgtgtgtgtgtgcatgtgtaggagtgatttgaatgtttaaaaggattcagttgagaaaaagaaatggtatgcaggactgagaaaaattgtaagagatggaatttagaaacatttaggtacagtagacttagagaagaaaaatagttgaaaggtatgagaagaggatatgcaaatgtagacaggtttttgttttgggttttttctttgtttgtttgtttgtttgtttgattccttgtttttgagacagggtctctctatgttgaccaggccagagtgcagtggcgccatcatggctcactgcaacctcgacctcttgggctcaagcgatcatcccatctcagcctcctgagtagctggaactacaggctcgagccaccacacccggctaatttttaaattttttgtagagacgaggtctcactgtgttgcccaggctggtctcaaacttctgggctcaagcagtcctcctgcctcagcctcccaaagtgctgggattacaggcgtaagccgctgcccctggcctacataggtttttatgtttgatggctgaaggaaggaacaaatggtaggtggaaacaaacacatctgtgaatgaagaaatttaaatcaagacaaataacagcactggtcctcaatgaggacaaagtccttaacataacttatatataattttatatataaaatatttataagataaaagggtctaaactcttttatataaatatgaaataagattacatatgtttgtgtatatatatatataaataatacaaagacctgttgatataaggtccttaaataatttagagaagaggtacttctaaatttctagataataccaaaatgttttagtactactctggagatcaaggtgaactctccaggttgattggtgaagaggccaagtgtatttcattttagacattttagacatgtttgagaaaaagacatttggagaaaaaatttcacaccatatttataagatgaaagagtctaactattagcaatgtctcagtaaagggacctgagagttgtatattctttgccaggaatgtccaacactttggacactttggcaaagagaccaactaagtacatcctcaggaagaagctgaggcagaaaatatcaaacagcttctgactggtttaaaatatatacgtatatttaaatcccaaggtgtcttcacacattaaacagtcatccctcagtaaccatgggggattggttctaggatctcccaaggataccacaattcaaagatgctcaagtccctgatataaaatgctatagtatttgcatataacctatgcacatcctctgtatgctttaaatcatctctagattacttataatacctaacataatgtaaatgctacataagtagttgttatattttattgcttagggaataatgacaagaaaaaaagttggtacgtgttcagtacagatggaggttgaatctacagatgcagagcccatggatatggaaggccagctgtactatgttgaaatatgactcctcaagagaaacagcggagcaggaacatgttcaaagaaaggacaactaaggctgggctcagtggctcatgcctgttatcccagcactttgggaggccaaggcaggaggatagcttgggctcagaagtttgagatgagaccagcctggacaacatagtgagaccctgcttctaacaaatattagccagtcatgatggtgcacacctgtggtcccagcgattcagaaggctgaggtgggagaatcacttgagcccaggagataaggctgcagtgagccatggttgcaccatggctcactgcagcctgggtgacagagtaaccctgtctcaaagaccaaaaaaaaaaaaaaggaaaaattatttatttccctggaagtaagtttgggagatgaactcagtttgtgaatgaccacagcatatgggattggaacttcagcaggaagggtggtgtcattgtaaggagcctggcctgtgttccccagtcaaaccaagttaacgcccttggatattcggccttggttcttggtcctggtccagcggcctcaggcctgaacaatgccagagtctttctcaaagagagcatccaggaaaaaaagacacagtagcctccctaggcctgactcaggctagttctgccgcctagcctggtcagtctggcaatcttaacaatcctaacgatgctccccttagccctccactgaggtttagcactaacatctggactcaggagtccttacttgccatctgccctagctaatttctgagggtgctggcatgggggcaccgtcctgagtccacggccttcacttctgctcacccacctggtcatgtgctgaagaggccaagcagctatgaaagcttgggtctcagccaggtgcggtggctcacgcctgtaatcccaacactttgggaggccaagacgggtggatcacaaggtcaggagttcgagaccagcctagccaacatagtgaaaccccatctctactaaaaatacaaaaaaaagaaaaaagaaagctcgggtctcaggagtgtctgctgttataatatcctgccaccaggaagccttcggactgctagaagagaaatcttgcccctggtcctagttgcaccagcttttccacttggttctacactaaccctgactactgttgtcttatcctcacagaaagttgaggaagcgagcggccaaggtctcagcccgacaccccaagccccttggaaggtatggggcaagagccccgggacctcctgctcgccctgcggccccaggaggtggatggatggatggcagccatccatgtccatcccagaacccaagctgatggattagggatgtgaggaaaatggcttttcctgcagggaggtgaagggagcaggcatggggatgggcaagctttgatcttagggaacacaaggaggaagtaatgtaggagtggctgagaagcctcccatctttacacctaccccaaatagcttggattccagcctcagccaccttcattcttcctccttcctgccccctccatcacctcccttagttcacccacattcccattctctcccctctccacctttcctcttcccttctccccttcccaactcccccacctggattgacatcgctagatttcccattactgttgctgaatccagagagcagcatgagttcctgaaatgcagttcaatggtgttcagcagacggtggatgcggaaaatcttcatttttcccatccccatgctgcccacaaagggtctttcccagaaacagaaaaataaccctgtacctttcctgcgccacatatgtaaccactacctctaccaacttccttctcctttttgcggaccaatcaccaagcttaaagtcaaacccaaaccccgagtggtcagggggccacacaagaggtaaataaaattcaggttgggtggaaaggagagggagcatggagttactcggctgtggccagggagggagggggtccaggaggcctttgtggctgaaagagctgaccaagaggaggagcagcagcagctcttagaaatcaccttccagggcatttactgaagtgttacgcaagactggtccttaccttggtctcaggaatgatgcttgtcctaggatttgttttttcactcactgactacctcgttccacatgtttacttatcttcccctgctgagttccaggagacaacatggtgcttttctctttcagacgccatacttgcgtctcctgtaagaggttacatttgcctaaaggatcagtgttcccaaatcaaatgctttatttgattagttgttaaaaataagtgctaccagcttactcgagatggagggaaactcagcgtcccctttggaacctttaccaggaatgcagtcagattgacagcccctgcctctctggctcattttccacaattaggctcccagttccctaattttcctcctgggctcctttagaactcgaagtgggaagcttccaacccctgtaattacatctaacttgtcttcaaaaggcagtttgcacattaaaagtctccctgataacttcaagagggactgaagtatcgataattcatccctttctcccctcctgttctcaacaagttctagtctcacccagtggtcccctcatagccctcattccccagcttctctggtggtttcaaaggatctcagaaatttggggatgttcttgtagtgcccttctagcttagggtcatctttgcccaacatggccacactctagccttccctgacctgcacattaaagtacacactgccatttttattttgttcattgtagacaacgggaatgaggatgtttagaagatagatgtatttttcctgtgatgggctccttgacttttactttcagccaaacaggactgtgggagagtgcctgatctcttagatcttcaggatccatttatcctgagcttccaaaggtattctgtaaagtctccaggcttcctttgtctgttttgtgtataaacttttcctcctcctgtgtcttcctagccaatggcttcaagtcatcatattccatccttcctctgacatcaagtgatagggcacattattgcaataatgcatgactacatcagcctcacaggcccgttccaccagcaccagacctcattttcttccctttctctgcgggcagagtgtacttcactctggcacgtgcctcactgcagcctctcattctactggtatcgataaagaagtccccccattctctcaaacatctcggcagcatttccaagccttagcatctatagttcagtcccattatcctattcagatggctttgggacactgttacgttgaaattgcagaagcatggactgcctttttaaagacttacacagcacaggtcctgggatgtctttgccattttgttgttcacatccatctcctttctctggtcatttattccctcaaactttgacctgtcctgcatttatacatcttcattcttgcatatgccagtcccagtttttcttgcgtctacctgctggtctgttcttgctgcatctgcccctcctaatctgtcctgcagagtctctggcctctgcggagctatggagatgggagacttccttagtcctttgcatcctgactcattcagttattccagtctcagcatcacagaaggacttgctcgccctggcttttcaggcttcctgtgtcagccactccctcctggccatttcttccaactggaaagtcctggtttccccttccctgaggccttagcctcagcctcctttagggccagcagcctgaaaccacttggaacagtttcttccaggcaagtcgagactagccatccttctcttaaggttgttctactgcaggaggtccccaaggcccctcctatctgggtagttgaggctccctcagcctggaaactcagcaatccccatgtatctcccgagggaaacatggaagggggaagaagaggagataaatggtcacaaaagggtggggggcatggtggaggcatgaagtgggaggatgtttgtggggccaagaggcaggagcattgttttaccctactgcacctcactcctgtccccctaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggtgtgtgagacagtgattatgacctttcccaccccaggtggagaacccctagcctggcaaccccagactaagcacagccctgacctttgaggacagagaggagccttccagggggtgggccacagacctgataccacccactcccttccaccaaagtctcactcatctcccaggtctgcttagccctccgtgcagatgttgccatttgcctctgttgggcacttctctcttctataggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggtgaggtggcatggaggtgggagggagagggaaggaggtacatgctcctggggggcatattccttcggaaggttaggtgtcccctgggcagacaatatatgcttaattacaacttcctgatctttgccatctggccctaggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggtcagtcatcctctctaccttggttgaggtctctttcatcctatccaggtctggtctccaatctacagtccaatggcccccagcccattgccccaggcccctgccctcctgcagctcccacctgacccatcacttgctagcccattatgtgcctgagtcacgcttcagccacatctgttagagactcccactacctcaccccaaagctttctccagcgcttccattctgtgtcactacagatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggtgagtgggaaggaaaggggagccgaggctgttgtctcaaagcctgtgttttgggcagagggctgaggaatgagtcccttggcccaagatgctggatcctgggccttacagaaacatctgcatatgtccccaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagagtgagtgaaggagggggtgatgcatgccagggaagggagtgtctgggccacccgtttgcagggaaagggggctgtaatctggaggggcacttcttccccataaaagagccagtttcgccgggtgcagtggctcacgcctgtaatcccagcactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaaaaaactagtcttacacactagggagggatggaagcacccctctctgtgaagtcagcagtgacttctaacacccccttcctttcttggtgcagctgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggtgagagggtagggagtcaagtagaagggcaagaccacgggggatggggcaaaccttctgggggcagagaaggaaacagaagttcccttctccccacaggcattaccacagcatggacatcttcactcactatgatatcctcaccccaaatggcaccaaggtggctgagggccacaaagctagtttctgtctcgaagacactgagtgtcaggagggtgagttggggactgaagtgaaccacatggtatccattgcacagcctttccttacactgacatatgccaatccctccagatgtctccaagcggtatgagtgtgccaactttggagagcaaggcatcactgtgggttgctgggatctctaccggcatgacattgactgtcagtggattgacatcacggatgtgaagccaggaaactacattctccaggtacctggagtctggggcttccagatgggtgagtggggggagcgttaaagacacctttgaattcgaggattgtcgctgggttaagtggcctttttctcactcacaggttgtcatcaacccaaactttgaagtagcagagagtgactttaccaacaatgcaatgaaatgtaactgcaaatatgatggacatagaatctgggtgcacaactgccacattggtatttgatgggaagagcaacccaggaagattaggggatgggagggaaagacgttcattctcttttccatagcttgtttctccatcttcccaccttcctgtagagctctcagtccctccacttctacccacccttctccacagtgcatctatctccctccctctgtgcagggcgcctcccaaattgcctgtccactctgcaggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaagatgtacaccacatgagggcaccaaatgacaaacagtgttaaatcaatagcactaatgtcattctagaatactaagagaagctttaaggggaaagaacttaagttgagcctaaaaggatggatctgatattaaccatataaaacaagaacagcataaataaaaaacatgggagtaggaaatcaggttggctgagtattcatataggaaggtattacagccaggtctagaaagttgatttacagacagatggaaaatggcccttaaatgccaagttaatggattgaaggcttgaaatcaaagcagtaacaggatgaaatcaatctggtgacaggtgtacaaagtggagtgggataagaaagtcaagatgatgaagggagacagctcttgtgattatttcaagtgtgacacagttcatcttagataaagacagaaatgagaacaaagctcaatagaggtgcccccctctgattacactggtcacattacatgtcactgtccctaaagctcatacctgggactcagggtcagcatcatcaccccaatgtagcgccgctgggacccactgattccggaggaggaatctgtgacagagggacaaatgagccccacccagctacatccttccttccctgccctcttctcccagtagaccaccctccaggaagtcccactgaatgcccttcccctatttccaccacattaaaggaacccgtttccccataaggcaggctcactcttcttttccccacgatgcagaaactctcgaagacgatcagaagggatggcaaaggagattccagctgtgaccttcatggtgttcactccaatcacctccccatcctgcagggatacagcccccagttccctagcctaaacaaatagtaggggatgggggcacccgaacaaaagtaccagcaagtgttggggagatctggttggatattgagagatagccaacaaagaactgctcagaaacttgaccaaacatccttgaattaggggaaacctacccttcccacactgacctggggcagggattcttggaaggaaggatgtctcactcaccaggttaaccaggggacctccagagtttccaaactgtaggacaaggagaaaacatgaaagagatctggggattctaagtctgggggcataccaggatgtaggtactttctccaaattctcttctttctcagcccatgaataagtggccacatttttgcagcctaagctctatataggctcatccaccatatatcagttggtgcttgtaccacacagcctctcccccctcccccatcatttgtcatttctctcctatcaggacgcacatcaatagctgcatcagtttgaatgtattccacattggtttgggggagtcccaggtctctggctggacgctgagcagagctaacaatgccggatgtgatcgtgttctgcagtgcaaagggacttcccatggcaacaacaaactccccttgccggacatcagctgagcgtcccagaggcagcgtggggagaggctcctaagggagaatgggtaaaagagacctgtcatctgaagatgcgagcaaataagcagctccaaccagacctggcctaccccagcccccaccttagtctgaatcctcagcgttgcgatgtctgccacgggatccacagctgtgaccacggcctcatacgtgtcgccgcttagcagtctcacacggactctgcgccgatcagccaccacatgggcgttggtgacaatgagcccatcggcagccaccacgaatcctgagccgttcgagatagggacctcgcggcccaagaaagggtgcctgaaatggagggaaagcacagataagaggaggctctgacccctcctacccgcccgccctccagcctgtggcttcagtgcctcccggtctacccccaccattaccggtccaggatctcgatatagaccacggcaggtgctgtcttctccaccacatctgcgatgaagttgtactgactccggggagaagcgggcggcgggctagggacggcggcgaggacggccggaggaccccgacccccgccccacaacaacaacagcactgcccccccagcgcccagcgccaccgccagccacgcgcgcgaacgggttccagagttctctgaggcctcccgggtcctggtatctggggtcaccgcagtcagttgtgcccggggacccggggtcccagacgtcaggcatgctcggggttcagtgaccccaacagacaaccgggcccagagactgggggtcccataagtcactcgggcccgggggtcagaagttcctgacgtcagcagggcccggaggtcaggggtcaaacggggtctcctcccccagcgaatgccccccaaagcccgccatgcccgaaggctccagcctgcaccccgccccgccctcggcgcagccatcagctccgccttggctgcctcctcgcccgccctactcagaggcggcacccaggacgcgagcaggcggacagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtaagagacccggcgggaagagaccgatccccgcgtgctctcggccttcggcgcctgaccacttcgcctctcgcccccaggcttccgggtgactgcttcctactgctcgtgctgctgctctacgcgccagtcgggttctgcctcctcgtcctgcgcctgtttctcgggatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtggtgagtgtgtgttgaacagggaatctctggggcttgaaggggaaatttcccatccctggccctggcttaggcctcatctcatgccctcccctcagacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcaggtatgtggtctctatacattacagcttttggggtttttttttttcggcctactgtgattcctcccctatttctgtgctagttagcctctccttctagttctctacttaccagaatttcttttttctttttttcctttttccacagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaaggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggtgagggggttagaggacaattaataggatgtggcaaattggagaatggaattatggagctactacggcaaagcctgaataatatctctccctatgtcccacaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggca

SEQ ID NO: 10503 - DNA, 7764 bp, Homo sapiens
tcttcactcactatgatatcctcaccccaaatggcaccaaggtggctgagggccacaaagctagtttctgtctcgaagacactgagtgtcaggagggtgagttggggactgaagtgaaccacatggtatccattgcacagcctttccttacactgacatatgccaatccctccagatgtctccaagcggtatgagtgtgccaactttggagagcaaggcatcactgtgggttgctgggatctctaccggcatgacattgactgtcagtggattgacatcacggatgtgaagccaggaaactacattctccaggtacctggagtctggggcttccagatgggtgagtggggggagcgttaaagacacctttgaattcgaggattgtcgctgggttaagtggcctttttctcactcacaggttgtcatcaacccaaactttgaagtagcagagagtgactttaccaacaatgcaatgaaatgtaactgcaaatatgatggacatagaatctgggtgcacaactgccacattggtatttgatgggaagagcaacccaggaagattaggggatgggagggaaagacgttcattctcttttccatagcttgtttctccatcttcccaccttcctgtagagctctcagtccctccacttctacccacccttctccacagtgcatctatctccctccctctgtgcagggcgcctcccaaattgcctgtccactctgcaggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaagatgtacaccacatgagggcaccaaatgacaaacagtgttaaatcaatagcactaatgtcattctagaatactaagagaagctttaaggggaaagaacttaagttgagcctaaaaggatggatctgatattaaccatataaaacaagaacagcataaataaaaaacatgggagtaggaaatcaggttggctgagtattcatataggaaggtattacagccaggtctagaaagttgatttacagacagatggaaaatggcccttaaatgccaagttaatggattgaaggcttgaaatcaaagcagtaacaggatgaaatcaatctggtgacaggtgtacaaagtggagtgggataagaaagtcaagatgatgaagggagacagctcttgtgattatttcaagtgtgacacagttcatcttagataaagacagaaatgagaacaaagctcaatagaggtgcccccctctgattacactggtcacattacatgtcactgtccctaaagctcatacctgggactcagggtcagcatcatcaccccaatgtagcgccgctgggacccactgattccggaggaggaatctgtgacagagggacaaatgagccccacccagctacatccttccttccctgccctcttctcccagtagaccaccctccaggaagtcccactgaatgcccttcccctatttccaccacattaaaggaacccgtttccccataaggcaggctcactcttcttttccccacgatgcagaaactctcgaagacgatcagaagggatggcaaaggagattccagctgtgaccttcatggtgttcactccaatcacctccccatcctgcagggatacagcccccagttccctagcctaaacaaatagtaggggatgggggcacccgaacaaaagtaccagcaagtgttggggagatctggttggatattgagagatagccaacaaagaactgctcagaaacttgaccaaacatccttgaattaggggaaacctacccttcccacactgacctggggcagggattcttggaaggaaggatgtctcactcaccaggttaaccaggggacctccagagtttccaaactgtaggacaaggagaaaacatgaaagagatctggggattctaagtctgggggcataccaggatgtaggtactttctccaaattctcttctttctcagcccatgaataagtggccacatttttgcagcctaagctctatataggctcatccaccatatatcagttggtgcttgtaccacacagcctctcccccctcccccatcatttgtcatttctctcctatcaggacgcacatcaatagctgcatcagtttgaatgtattccacattggtttgggggagtcccaggtctctggctggacgctgagcagagctaacaatgccggatgtgatcgtgttctgcagtgcaaagggacttcccatggcaacaacaaactccccttgccggacatcagctgagcgtcccagaggcagcgtggggagaggctcctaagggagaatgggtaaaagagacctgtcatctgaagatgcgagcaaataagcagctccaaccagacctggcctaccccagcccccaccttagtctgaatcctcagcgttgcgatgtctgccacgggatccacagctgtgaccacggcctcatacgtgtcgccgcttagcagtctcacacggactctgcgccgatcagccaccacatgggcgttggtgacaatgagcccatcggcagccaccacgaatcctgagccgttcgagatagggacctcgcggcccaagaaagggtgcctgaaatggagggaaagcacagataagaggaggctctgacccctcctacccgcccgccctccagcctgtggcttcagtgcctcccggtctacccccaccattaccggtccaggatctcgatatagaccacggcaggtgctgtcttctccaccacatctgcgatgaagttgtactgactccggggagaagcgggcggcgggctagggacggcggcgaggacggccggaggaccccgacccccgccccacaacaacaacagcactgcccccccagcgcccagcgccaccgccagccacgcgcgcgaacgggttccagagttctctgaggcctcccgggtcctggtatctggggtcaccgcagtcagttgtgcccggggacccggggtcccagacgtcaggcatgctcggggttcagtgaccccaacagacaaccgggcccagagactgggggtcccataagtcactcgggcccgggggtcagaagttcctgacgtcagcagggcccggaggtcaggggtcaaacggggtctcctcccccagcgaatgccccccaaagcccgccatgcccgaaggctccagcctgcaccccgccccgccctcggcgcagccatcagctccgccttggctgcctcctcgcccgccctactcagaggcggcacccaggacgcgagcaggcggacagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtaagagacccggcgggaagagaccgatccccgcgtgctctcggccttcggcgcctgaccacttcgcctctcgcccccaggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtggtgagtgtgtgttgaacagggaatctctggggcttgaaggggaaatttcccatccctggccctggcttaggcctcatctcatgccctcccctcagacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcaggtatgtggtctctatacattacagcttttggggtttttttttttcggcctactgtgattcctcccctatttctgtgctagttagcctctccttctagttctctacttaccagaatttcttttttctttttttcctttttccacagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaaggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggtgagggggttagaggacaattaataggatgtggcaaattggagaatggaattatggagctactacggcaaagcctgaataatatctctccctatgtcccacaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggca

SEQ ID NO: 10504 - DNA, 1118 bp, Homo sapiens
cagggttggtggtgactacgtgggtctggagctgactgccgtcctgacacgtcctagagctgcaagcaggtttgaatccaggatccctgtgactctgctgttcctctccccaccccctatattctttatccttttcccttcaggactttcccacaggttactaggtctcacataatttctactgcccttgaggacccctgcctaagtaagatttctactacctgccaacggggtaatagtctcaggtagatttctactacctgactatagggactgtcgactaactctcagtagccctttatcaaaatacctagcactgtttcctggcaggaaatgctgggaagggtgggccccagagcatgatcaactgaaggtagaggttaaggatcagggctgaggtgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccaggtgtggtgggggttgtgggggcaggcagattctgggagtggacaaagggaggacaaagggaggacaaagggaaagtggcctttccctgggcaaggggggactgggctgcgtggggtcatgaggaaggtgaacgaagagagatgggatgggttaggttggccctggaggctggtgaaagaccaggggactccccaaataaggaaagattaaagtggccatagttccctgagcacttctgactgaagtcctacatcttcctcactggctctccttccctacttctatcccagatccctcagtggtgtgcagagtttgcgctggccagagggttccagaaaggacaggttactgttactcagccctaccctcttgcagcccggagcctggctctgcgggttgctgatga

SEQ ID NO: 10505 - DNA, 380 bp, Homo sapiens
cccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaacttttaaaaaaaca

SEQ ID NO: 10506 - DNA, 176 bp, Homo sapiens
aggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctggg

SEQ ID NO: 10507 - DNA, 1118 bp, Homo sapiens; identical to SEQ ID NO: 10504

SEQ ID NO: 10508 - DNA, 6010 bp, Homo sapiens
aaaaaaagaaaagaaaagaaaagaaagaaaactcagctaggaattagaaacatcatttgtcctcttggcctgttcagctggtgactgtaggtaagttacttaacctctctgtatttcagttcacattccttggtgaaatagaaattaaagttaataatcacttctacttgtgaagaattttcagatctgaaattgctttgtttgggctttggcaagaaaaaggtgctaagaattccagagaattattggtaggagttgggagtagatcgttaccccagccaggctggacagttgggcccattggctaggaagtatttgaaagccctaagctttgaggtatatccccaagaacctcttcctggcagggagggttcctcctagttgcctcagtcagttagcatctccacagcacttctgttaagtttgcacagtacttccacgtcagctagcaaagacagtggcactgtgtggtggcagtttaggtggtgttcagattctacctttacacctgaggaaacagaaatcccagagatagaatttgagaatctcctttggtttatttcttaccaccccaagtttctcacaagcctttccaggatcaggcaagacaggttatcttggaaggcagaggctggtggtgggggcctggggctgggggagctcagaggcagcttttaactggagaccaagaagggaaatggccagtcaggaggctgctgctttttttgttttgtttttctctccagttcctgccctgttgtagctactaactagaggaatgttctggttgttttgtttttcctttttaaaattgacatgtgatagttgtacatattttggggctgcatatggtattttgatacatgcgtacaaagtgtaatgaccagtcaggatatttaaggacatttatcacctcaagcatttatcttttccttgtgctgggaacattccaattcttctagctattttgaaatatacaataaattgttaactatagtctccctactgtactatcaaatactagaacttagtcctcaccatatttttgtaccatccacctgctcttcattctcctcccctgcttttcccagcttctggtaaccccattccgccctctattggagggttgtgttttgattggctgcgaaatgcacagtgtggcttctcttctcccaggagtgggaggggccacctctagggtccaccagggggagctgccctgcagccctgggctcccatcactctggtccatcccctctcctctccctcctgagcaaatgtgctagacaagactgttccaggtatgggccagccagatggcagcatggtggtgagggtgcagatctgctggaagcaagagaatgtggacttcatgggttgtggagggaactctgcacttctgtcccatccccagtcagctcctatgaccctaaggcctgaagcctcagctcgctgtggagagaacagagcctacacttaaaattcttggaggttttgtgcttccaacaaccaagtcctttcaggctcagggttggaaaaagtttgtatatctgtgtgcacattgtcatttggacggggctcagagaggtgacctgccagctgacctgacgtggcctctcctcatcttctgccaggcctcaacagctggtcccctcaccttgctggcagacactaagggttacaggcagcctgcttctgggccattctgcttggttcttggtatgactgcttcctgtcactacctccacggtagtggtccaaatgccagctcctggtaaatggggcagcagagcttcaaccccttcatcgtcaggcctctgagaagggccacctgcacccaaaggtctaacccagttagtcaggtgcctaaattaggcaggtgcgtgctgtgagcctgaggaatgggacagcaggaaatgaggtaaccccttccacccccaagcaggtcgggttctgatcctccaggagtctgcaatgacatttccttctgctttctaagaaaatggccagtgtccacaaagagcctacctgactcattacgtagattctcaccccagcacttacttacccagcccctcatttgtacaagagcaggccaggggccccactgtgtatgaacctgtcttgttgaagcctgaggccctttacttggtatcatatcagctggacttaaatatgaaaattacaacactgcgtctatgaaagggtgtgcaatgcaaggtattcataaattctggttactttgaagtgctttttttgggtaatgctttagctggatttaaaggagcctgtaacaaaactgcctccgtttactggtgtacagtcccagatgtctatggattcctgcgggtcacctctccttttcctgctgccatgcctcctcctcccctggtcactaccacaccactgaaaatgagggggtcttggcggtgcgaagctacacttctagccacgatcttgtggggactggctgggatgaaaagtaagaaatacactgtttcctctctcacaggtctgggttttacccttaagctgaatgaaaggagagctgagacaagggcaggaagggttatgggtgaaatatgctgtgaaatccaaaagatattttctgtgcaagtctggtttcaactgtttgggcttgtctgaaagtgtgggaagaggtccagagctggagggacaacagagaggaagagtggggggtgacggatgggacccgaagtgttttccaccccatgggttctggatgtcaagtgatgagaaggttgctacggtttcctgagctacactcatctcccaggagaacatgccccatttctcctttgctcctgatggactgctgtggactgagactggaagagcagggtcctggaatacatcctgggtgctaacttgagcctctggaggccaggcccactgtgtgaagagggggaaagcactgctcacagatcagggttaacaaggcctgaggggcttcagcaggctgaggaagtctggaaccccagaagtttcatcatgactgcaggcgctgggaggtttcctgttccctggcttcaggctcacctcaggtcaggctcttcccagagccaatggggctaatgccgctgggctgggggagggctcgggccccagctccaaaggaaaggagacaaggcttacgtgttgtggtttctgcccagcctacacagcaggagctggggagactttattcgtttcggggaaagtgacaacaggaatgagatgaagtgtgaaagtgaaaggaaggggcaatactgagatgagaacagcctgaacaaagtctagtacaacactgcagccatccagagcttgagggagcggggaggtccatcaccaccaggccctgtgggccaagcacacccatgtttcttctctcttgtcagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacactgtctgtactccatgcgccacccccgctggtgacccagcaactgcaaagggcctctggtttgtcccgctctgggaggagactcagtggcttttcctcctcctcagctgcaaggatcctaccccagcccagcccagctctgagaaacaggactttgctacagcccgcctcaaagcatcttggtggacttctccccagcacgagctctctctacttcagggattgcaaactggcatcctcttttgccagtattgggtttttaagttttttttaagtgatcaccagcatttaaaaatcctatttcacataaaaagtcagaattctggcctctgacaaagcagacaatctggcaacacagggccggcactgtaagaacagctgagcagctgtggcccctttaacagggtgtgccctcttcaggtagccatagtccccacacagcccttcaggcctccttctcaccgtttgctcgtcatttgagcttacaaccctagttctgctcttccttgtgtagccccccagcccttctgcagccttactgacagctgtccctggcagacttacagcctctcagtaaaacaaaaccttaatggtcatctcatccgtttacccttccacaatctgaatcctttctacctttctaccgcctcctgacaaacagccatctcgtctctgctgtaggtaacccattactcctcaagcagcctgatcctgaactctcccccacatccctttctcacttgcatcccccagttcccagctgtccctcagtggctgcactgcaccctttacctgcacctccttgttgcttgagcctccagaacctacccctggctctgccaacctctccgcatc

SEQ ID NO: 10509 - DNA, 2858 bp, Homo sapiens
ttacgtgttgtggtttctgcccagcctacacagcaggagctggggagactttattcgtttcggggaaagtgacaacaggaatgagatgaagtgtgaaagtgaaaggaaggggcaatactgagatgagaacagcctgaacaaagtctagtacaacactgcagccatccagagcttgagggagcggggaggtccatcaccaccaggccctgtgggccaagcacacccatgtttcttctctcttgtcagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacactgtctgtactccatgcgccacccccgctggtgacccagcaactgcaaagggcctctggtttgtcccgctctgggaggagactcagtggcttttcctcctcctcagctgcaaggatcctaccccagcccagcccagctctgagaaacaggactttgctacagcccgcctcaaagcatcttggtggacttctccccagcacgagctctctctacttcagggattgcaaactggcatcctcttttgccagtattgggtttttaagttttttttaagtgatcaccagcatttaaaaatcctatttcacataaaaagtcagaattctggcctctgacaaagcagacaatctggcaacacagggccggcactgtaagaacagctgagcagctgtggcccctttaacagggtgtgccctcttcaggtagccatagtccccacacagcccttcaggcctccttctcaccgtttgctcgtcatttgagcttacaaccctagttctgctcttccttgtgtagccccccagcccttctgcagccttactgacagctgtccctggcagacttacagcctctcagtaaaacaaaaccttaatggtcatctcatccgtttacccttccacaatctgaatcctttctacctttctaccgcctcctgacaaacagccatctcgtctctgctgtaggtaacccattactcctcaagcagcctgatcctgaactctcccccacatccctttctcacttgcatcccccagttcccagctgtccctcagtggctgcactgcaccctttacctgcacctccttgttgcttgagcctccagaacctacccctggctctgccaacctctccgcatc

SEQ ID NO: 10510 - DNA, 973 bp, Homo sapiens
gccatcattgcaaccccaagccaagatgggctgttaaagaatggaaggcaggcctggggcagaagcatcctagtctggtcttgatttccccagcaagggctcctggcactgctggcggagagacccaggcccaagcatcccgccccatcaccccatgtccagccacagctcctggactggcacccagggtttgctcaactcccacagccatgctggcctcagtgccattctgggtcctccgccaagcccagaccctccgcagggagcctgtgggctagagcaacaggcagagctgggactgagcaagtagacgcagttagggcctgggaactttttgcccagaggtccttccctgggctcgctctcatatcacccctcctctgcccacacagcactgcccatgggggcctcaagggcctgaaggctctcctgagccacgagctcatgctcttggggcagatgtggcctgtgccaagctcctggttaatgggctacacagacctttctcagaaggactcctaccctgcttccctttccctgggtcaagattctgccagggcaggcagaactggagaaacatctccaccccacccccaccccccatcacaggcctggtaaggctgggagatttcccactgataagatgcacccaactcccagagagaagccaggggcagaggcaccagcagaaccagcagtttccctcacctggccccatgacacatggatttgttaagcactggccttcccaccatcagcagatccatttggactaagttttccccaaataccttaaacttcagttgtagagttaaaaactccaaataaaatactaacggcctctaggcccaaagttagggggcttggctcagtgggagcgagagcagcttggggggctgagctggaacacactcttcctgcagcctcttgccctgccttgtcaccagccccgccttccccatgcataaggctg

SEQ ID NO: 10511 - DNA, 973 bp, Homo sapiens
tgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaa

SEQ ID NO: 10512 - DNA, 973 bp, Homo sapiens; identical to SEQ ID NO: 10510

SEQ ID NO: 10513 - DNA, 1290 bp, Homo sapiens
ggtaattgtttgaaatctaaaatgtcaactttctatattttcatttttatgcacaacactgttcgtaaaggcagtaatgcttcgtgtaattactggtacataaaagtctgattttgaaagtcactgtaaactaagcctgttttctgcctttctttctagtaacaacccttcagcagcgtctgttacagcctgacttccagccagtctgtgcttcacagctctatcctcgccacaaacatcttctgatcaaacggtccctgcgctgccgtgtaagtattccattctgtagactgaccatttgtacaagaggaaagcaaaaataaatgtggctggtgtctgactaatgtcaaaacctttggaatgtattaaatacagaaaatacttgtagagaacatactaattgccaggcactattttaaatgctttcaatataaacagctcttacaactctgtgaggtaggtactactgttaaacctgttttacaaatgtagaaaatgaagtatctgaaggttaagtacatagggttaacccctaaaagaatagtgaaagagtgtgaacttttaggctagtgttcaggctcagggaggaccaataaaaaataatcaatttaaaagaaagcaagaaaaatcagcaaaatccaggctctggtaatctacagaacaaatgacagagtttcttcaataaataaattgtaaaaacaaaatggaaaagaaaccttttagaggagtactatccaacagaactttctatggtgatggaagtattctgtgtctgtacagtcccgcatgatagccactaggcacatgtggctcttgagcacatgaaatgtgatagtgcagctgaggtactgagtcagtctttaatttcatttaaataaccacatgtcgctagtggctaatgttacttaatcattctctagattagaagagacttaaaagtttaccaaacacaatgtatagagtttacgtagattcggattcaaacaaaacagaaagaaagggcccaggggaggagggaagaagggaaagaggaaagaaggaaagaaaaatttgtgaaatctttgagaaaatttaaacactggtagcattttcgatgctattaaaaaactattgggcagggcacagtgacatgcacttgtagtcccagctactctggaagctgaggcaggagaatcccttgagcctgaggagtttgagactgtagtgtgtgatgatggtgcctgtgaatagccactgcactccagcctaggcaacacagaaagaccctgtctcttaaaaaaaaaaaaaaag

SEQ ID NO: 10514 - DNA, 7668 bp, Homo sapiens
ctattctattcattgtgctagttgttgcctgaatacttagattttttttttcattgtgttattgttttataggccctgtgagacttatgctttaaggaggttatattttggtgtgtttcaaggttttgtttcaggatttagaactcctttgagcacctcttgtagtgctggcttggtactgacaaattctctcagcatttgtgtgtctgaaaaagactttatccttcattcatttacaaagcttagtttcgctggatacagaattcttggttgataattgttttgtttaaggaggctaaagataggaccccagtcccttctagcttgtagggtttcgccaagaaatctgctgttaacctgataggttttcctttataggttatctgatgtttttgcctcataactcttaagattctttcctttgtcttgactttagataacctgatgactgtgtgcctaggtggtgatctttttgcgatgaatttctcaggtgttctttgagcttcttgtatttggatgtctagatctctagcaaggccagggaagttttcttctattctttcctcaagtaagttttccaaacctttagatttctcttcttccttgggaacaccaattcttagttttggtagcttaatataatcccagacttcttagaggctttattttttattattattgttattattcttttttctttgtatttgtcagattgggttaattcaaaagccttgtctaagtgtgtctgtcatttcaaaaattgtgattgtttattatttatgctgtctttctctggagattttttttgtccataacctgtatttttttttttttttttaattcccttaagttggttttcacctttctctggtgcccctttgagtagctttttgagtagcttaatagttggccttctaaattttttttctgacaattcagagttttcttcttggtttggatccattgctggtgaactagtgtaatctttttggggtgttaaagaaccttgctttgtcatattaccagaattgtttttctggttccttctcatttgggtagactatgtcagaggaaagatctggggcttgagggctactgttcagattattttgtcctacgacattgttccttgatgtggtgctctccccctgtggcttcctgagagctggactgcaattattgttattgctgctctgggtctagccacccggccagagctatcagtctccgagctggtactggggagtgtctgcaaagagtccagtgatgcagtccgtcttcaggtctctcagttgtggataccagcacctgctctggtggagatagcaggagagtgaagtggactctgtgagggtccttggttgtagtttggtttcgtatgctagttttctttaatgctggttgtgctagcagtgaattgtcacgtggacagactcaggacctctggttagccaggatgtcacaggtggtggaattagctgttgttttctccttttgagggcagggttgttcttttatgagttgctataatgagttggttggcctccagccaggaggtggcgctttcaagaaagcatcagctgcagtagtgtggtggggatacaagcttgccctaaggttgcctggataagtatttgggtttcccaggtgatcagtggggccataaagctcccaagagtttacagtcttttgtcttgggctaccagggcaggtagagaaagaccatcaggtgggggcatatctgagctcagaatctccttgggcagggtttgctgcagctgctgtgaaggacagttgtgtggttctcaggccaatggagttatgttcccagggggattatggctgcctctgctgtgtcatactggtggccagggaagtaggggaaagccagcagtgacaggcttcacccagctcccatgcagccagcaaggccagtctcactcccaccatgccccaccaacagcatggggtttgcagggccaagattttggcccaggctacaagcctacttgctgaaaaagcaagctagccttttggactccgccccttcccgactgctgtggcttatgtgctcatatctgtacttcccctttacgccttccccatcttgattgtgcccaggaaaatttgctctccgtcaaagttattacaaagttcacctggaagtttctgtctccaagtggtccttcctcagttccactggcagcactccccaaggacccctgtgagattaaagtcagaaatgacttccctgggcttcactgggaaccgggagtgcctacagggctcttcccgctgttgcttcttctatttttatatttcactcggctctctaaattttgtttcagcactaggtaaggttaaatttttctcccatgatctggatttttaggttctccagtgaggatgtgtgtttgaaggtggattttccccctcttacacatgggcactcacagattttctgctgtctcatggattttgcagcagcaagccacttcttttaaagggtctgtgaattctttcagttttcctagtatgttcctgcagtagttcttggaataaaaattcacagtgtgagtctccacatgttgttctgtctgtctgaggggaagctgcaagttagtcctgcctcctatctgccattttttttttgccacctcatcctcttgagtagctgggactataggcatacaccaccatgcccagctaatttttgcatttttttatagagacaaggtctcactctgttgtccaggctggttttgaactcctggccccaagtgatctacccacttcagcctcccaaagtgctggaattgtaggcgtgagccactgtgcccatcctggtttgaactttttatgattaatatgtattgcttttataattaaaatgtattttaaaaattaaaaagtgtgatggagttggggaataaaatacagtataaaatgctatgttcttagaaataagtggtcctgtggccatgcagaaaaaaaataagagcagttgtgaggggaaataagtaatgaagttagagagcaaaaaatttccaagcctcttcattgcccatttcttcccatccttgaacttcagttttccatttcacttcggaaaacagatcacataacgaagaaaaattatcttagaagaaaaagggcaaacttgcccatcttaataatttgtcttctctattcattatgtgtctagtcagtgtagttgattaatttgatatgttttctgttagcttttttgtgtactgagtctgtgattttcttacagatgaacaaattgattgaatattaccagcagcttgctcagaaagagaaggttgagcgagatcgcaagaaactggcacgacgtagaaactatatgcctctggctttttcggtgagaatttggtactaaaatgatttgcaagacctctaaggcctaagaacagtgatcatttcagaaaatggccattgtcctagattcctgaatggtggatatcagagagagggattcttcaaattatagacgtttaagtccaatagttaggcttttgctatatcattagttctgtttgagttatttgtgttttgaggacatttgtgtttctttctccatcactcccctttatcttctgattatttccccagaaaggctgttaattttgtaggcactgcagagttccacgtacagcttttgtgtattacagaaagtctgagaagaaggaggtgggcaaatggtagatttcagtcatattacccctgtagcccacctttgacatcctggcagtagtggtttctcagctttagttataatttttttaacatcctcccctgtttctccaagatgaaaaacactgactttttacatagtgcacttgtgtggttaaatagtaatatatgcaagtagaatttttgataagaattatttatgagagtcattctctaccagtttacgtactgctagtaagaagaaagaaattaggatttggaatttttgttattttaccccgagttttatttgctctcatagtacagtttgttttctgtgtgcttgcttggggcccagcaaattgacattcaataaataacatttattgaatggcaatgatgtgtcaagctctgtgctaaataaacactttacatgtattactttacttaatcctcacaaaaatcctgtggagtatcatatccccattttacgcttgaggaaatgggacctagttaagcaacttgtcatactgcatccacatgaaaattagttaagtcattgaaaccctaagggttggtaaagtccatataaaaatacctagattaagctgggtgcagtggctcacgcctgtaatcccagcactttgggaggctgaggcggggggatcacttgaggtcaggatttcaagaccagtctggccaacatggcgaaaccctgtctctactaaaaatacaaaaaattagctgggcatggtggcgcacgcctataatctcagctacttgggaggctgaggcatgagaatcgcttgaacccaggaggcggaggttgcagtgagccaagatagcgccactgcactccagcctgggtgacggagtgagactctgtctcaaaaaaaatctagattagaatttaaaaacattaacacttgcaaagcacctacatttgcaaaaagaagtgaatttttctgaatagtccagtggtatagtcagcatatgcaccaatgtgtgttatatttagaggtagaatttgaattaaatgaattattcttccaattttcccatataacctgcctgctatatgcgtttgcttctatcttatgctgcattttttgtctctgttgcaacctgctgctattttggggctctacagcaacatactattcatgtagtggtaagttctcctttatgattcttgctgaccctgaagaagttagcagatgaccactggtgttccaggaagacgtctgttgtgtatcttagacactccacatagttcttgcctgagccgtagcttagatacttttagattactagcagaagctcacatttggttcatttttactgtattaatatagtttcaatctccatgtttagtgctgttattattttaagaatagaataatgatgtggggctacaaattgctttctttaaaagaagcctttagattagctttttttttgcttatttccctgagcttctcatgctatcctacccaaaattctttcttttgataaatagggtgtgtaaaagtggactttctaataggaatttctgaactttgtttaggacaaatatggtcttggaaccaggcttcagcgaccacgagctggtgcatccatcagtacccttgccggactttcgtaagtttagacatgaaatgactttgaggagaacagcaggtatcaaaatgaatatcaaataaatgagattaaaacacacacacacacacagttgtcaatggaaaagaagattctcatacttagaaaagacctacgctatacagatattctatgacagaggaatacttcaattattgatatcatagactgaggataatcaggtggatccgtgagaaattactcttttgttttgttttgttttgtttttttaatttttcagccttaaagaaggagaggatcagaaagagataaagattgagccagctcaggctgtggatgaagtggaacctctacctgaagactattatacaagaccagtaaatttaacagagggtaattttctgtgtttttctactttgtttctagtctacatctaattctgtttttgttatttatgtacctagtgatttgagatttttaatggaatagctgttagtagtaaaaacaatatgtagaaaataaaacagctgtaatagaggtaattgtttgaaatctaaaatgtcaactttctatattttcatttttatgaacaacactgttcgtaaaggcagtaatgcttcgtgtaattactggtacataaaagtctgattttgaaagtcactgtaaactaagcctgttttctgcctttctttctagtaacaacccttcagcagcgtctgttacagcctgacttccagccagtctgtgcttcacagctctatcctcgccacaaacatcttctgatcaaacggtccctgcgctgccgtgtaagtattccattctgtagactgaccatttgtacaagaggaaagcaaaaataaatgtggctggtgtctgactaatgtcaaaacctttggaatgtattaaatacagaaaatacttgtagagaacatactaattgccaggcactattttaaatgctttcaatataaacagctcttacaactctgtgaggtaggtactactgttaaacctgttttacaaatgtagaaaatgaagtatctgaaggttaagtacatagggttaacccctaaaagaatagtgaaagagtgtgaacttttaggctagtgttcaggctcagggaggaccaataaaaaataatcaatttaaaagaaagcaagaaaaatcagcaaaatccaggctctggtaatctacagaacaaatgacagagtttcttcaataaataaattgtaaaaacaaaatggaaaagaaaccttttagaggagtactatccaacagaactttctatggtgatggaagtattctgtgtctgtacagtcccgcatgatagccactaggcacatgtggctcttgagcacatgaaatgtgatagtgcagctgaggtactgagtcagtctttaatttcatttaaataaccacatgtcgctagtggctaatgttacttaatcattctctagattagaagagacttaaaagtttaccaaacacaatgtatagagtttacgtagattcggattcaaacaaaacagaaagaaagggcccaggggaggagggaagaagggaaagaggaaagaaggaaagaaaaatttgtgaaatctttgagaaaatttaaacactggtagcattttcgatgctattaaaaaactattgggcagggcacagtgacatgcacttgtagtcccagctactctggaagctgaggcaggagaatcccttgagcctgaggagtttgagactgtagtgtgtgatgatggtgcctgtgaatagccactgcactccagcctaggcaacacagaaagaccctgtctcttaaaaaaaaaaaaaaagtattttttcttttttaggaataatgatagtactttgtttgtttgttttttaatgtctttatcttttggagatacatacagaaatatttatggaggaaatgacttggtctctgatatttgttgcaaaataatgagggatgaggaatgggtaagagtataaatgaaacaagattggccattgttgctaatttttgataacaagatgctgattctttttgtttgtttaacctgagagcatagattcaagtcctgcatatatattccgaagttgataatcgttgaagttgggtgatgggtacctagagatttgtaataccattctatatttttgtacacgttagaaaatttctataatgaaaaacctttataaaaagaaagaaaaagaaggggcaaaggaacattgaattggtagttcaaatagaaagcctgggctcatgcctgtaatcacaacactttgagaggccaaggcaggaagatcacttgagcccaggagtttgagatcagcctaggcaacatagtgagaccc

SEQ ID NO: 10515 - DNA, 414 bp, Homo sapiens
catgaaatgactttgaggagaacagcaggtatcaaaatgaatatcaaataaatgagattaaaacacacacacacacacagttgtcaatggaaaagaagattctcatacttagaaaagacctacgctatacagatattctatgacagaggaatacttcaattattgatatcatagactgaggataatcaggtggatccgtgagaaattactcttttgttttgttttgttttgtttttttaatttttcagccttaaagaaggagaggatcagaaagagataaagattgagccagctcaggctgtggatgaagtggaacctctacctgaagactattatacaagaccagtaaatttaacagagggtaattttctgtgtttttctactttgtttctagtctacatctaattctgtttt

SEQ ID NO: 10516 - DNA, 2929 bp, Homo sapiens
ttgggttttttgttttttttttttttttttttttgagacggagtctcgctctgtcgcccaggctggagtgcagtggcgcgatctcggctcactgcaagctccgcctcccgggttcacgccattctcctgtcctcagcctcccgagtagctgggactacaggcgcccgccaccacgcccggctaattttttgtatttttagtagagacggggtttcaccgtttagccgggatggtctcgatcttctgacctcgtgatccgcccgcctcggcctcccaaaatgctgggattacaggcgtgagccaccgcgcccggcctgcttattgggtttaatctgctttagaaatgtcctaagaagcctaaaattaaatattttaagtagaaaaaaataattttaaaatagtatgttatactattactgtggtttatatacatatattaaatggtctcttttataggaaacatgtctggaagtttatcacattaagcactgtaaaattaaaggcaagagctaatcaccttttagcaaaagtactctgtatgcaacagttgcaaatatgaaagctattatttagcagttgataattgcctgatacaaaatataaacaaagtacatttactggattgtttttagtttgcagctgccctcaaatatcccagataaggatgtctcataaatcaaagctgcagtacaattcacttagtggttagttaggccaatcctccccgccattatccttgttcttccccaccgcccctaacccctgcagtggcaccatattattaaaaacattaagtacctggggtttgtgcttcaggtcaagacatcatttgcataatttcaaatgacagacaacttttcatgtaaaaatgatgctttgtggtcacaattacttcaaaaagtaattgttttcaaataacctgacataccgtaccttagcaattacaaaaccatgattttgacacatggcatttgtaagatgtgaacagctgttcttctgcttaagtttagagtgctgcaaaacttgggtaatgactattttttcagttaacataaccagcccacggtacagcacactgtatcacaaagtacaaatccaaggaaggtaatacctttgctaagttgcggaattttggcaaatcagtacaggtctctttaatatgataaaactgtatttttgtgggagtcatgtataactttaggaataattttcactccaaaaatatttaagtgccagctgatactattaaaaacattataatggtttttaatggtgatttataacaaagcaaggataatggcggggaggattggcctaaccactaagtgaattgtactgcagctttaatttatgagaaatttatgagaagttattttatacaaactaatatgttttaaactacacaatatctcttcttaagtgagctcccctgttcaagctgttagagtatccagcagcagagcaatgcatgtctcgaggaggtggctccgctcagttgtggggttggtccaaagctggggagagttccagtgtgttgaaagctttaaaattctattttaaggagatttactgtcaataccaatttccaaggacttctttaaaaattgttaaattttcacataaatactggaactctcaaaattagacagttatttcaaacaacattcatttcagatgatcccttatatttagaagccctgcatctcgttggtttgatcaaaagtcatatagccttataccagcttattttttttttaattctgcttaaaatataggtttgttgggaggctgaggcaggagaattggttgtacccaggaggcggaggttgcagtgagccaagattgcgccattgtactccggcctgggcaacaagagcaaaacttgtctcaaaaaataaataaatacaggtttgttttaaataacaaaatataataaatagccagcttggagagacctggggcacccatccaatattgtctaccaactttcatgattgtttctttgcacatgctgctgctgccattggagtccctatgctttctcttgctgaggctgtcagctggaagatgaaattattaaagtatattatttgatcacaacgtagttaagttaggaatcagtaatttctttatagcaaaacttgcaggatacaactaaggctgtgcttagctatacagtatatattagaaaagaagaaatattaaaagattagcgatgtcagcatccatttcaagaagttagaaaaaaaacagcaaagtccaaagagaacaggtgttaataaattaagaaaccaaaataaaatacaataaattaatataaaatacagtaaattaagaaaccaaaatacaaaagggcaacagaatcagaagttgatttcttaaaaaagattagtaatggaaatagttatatataaattaaattgatataaatttatataaatatggttatataatgcaccattaatatagtaatacctaccaaaagtaaagttaccttttgtctcatcaacttcacttttaggaatctaccttgcacctccacaaatacaaaccaaaatatgcagagattatagtatatccgcagaatgagtactataaatttataaaagaatgtgttaatatgggatacttttttttttttttttttttttgagacggagtctcactctgttgctcatgctggagtgcagcggcgtgatctcggctcactgcaagctccacctcccaggttcacgccattctcctgcctcagcctcccgtgtagctgggactacaggcgcccgccactacgcctggctaatttttttgtacttttagtagagatggggtttcaccgtgttagccaggatggtctcaatctcctgacctcgtggtccgcccgcctcagcctcccaaagtgctgggattacaggcgtgagccactgcgccc

SEQ ID NO: 10517 - DNA, 387 bp, Homo sapiens
aattaccatttcaatctcactgcttgttactggtctgttcagagttcctatttcttcctggtttaatctaggagggttgtatatttccaggaatttatccatctcctctaggttttccagtttgtgtgcataaaggtgttcatggtagccctgaatgatcttttctgtttctgtggtatcagttgtaatatctcccatttcatttctaattgagcttatttggatcttctctcatcttttcttggttaatctcacattctatcaatttggtttatcttttcaaagagccagcttttcgtttcatttatcttttttattgtctcttttgtttcagtttcatttagttctgctctcatctttgttatttcttttcttctgctaggtttg

SEQ ID NO: 10518 - DNA, 14036 bp, Homo sapiens
tagacttacactttacactgaattgaagaaaatcataaaaaggggttttgccacctggatgtacagcagaacataattaaatttaatcttcttgggacagtgttttaatgggataaatcagctcccatttaacctcatacatagcgacacaaagaaaggcctttcatggcgcacgaggtgtataaacaaagggaaaccatatctttctgggcaaaactgcttttctggattgtttattatgtttaatcagcattgtggaaaatgcaacaatatctgttcatggacttgagaaccccagagtgggaacagcaggtgcggatgtggggagaagaaaggaggagggtctggagagcggccataggggaggcaagtgtgaggagccaggagtgggggccctgggctgccctagacagggacatgcgggcaccccgtggggtctttggcagctcacaggacaatggcagtggaggtctgctccctagagggcgaagggggcactgaattctcccccagtagcctcttctctgatccttcctcattctggaaaaaaaagaaaaaagaaatccttaggggaaaaggatgcaggcagagttagtatcatagaactcagaaagcagaaagaggaaaggaggagggaaaggaaaaggtgacaggaaaagcagatcaggcaaaaaaaaaacaaggtggcagaggaaggggagtcagacgaacacctgggacagggcagaggggagagtggggagatcagagcagaggagggcgcagagaggcacagggcggcgacagttggcccaggaccatggtgatggccacattccccagacagcaaaggggagagctgcatatggaaagaagctgaggggcaccaggcccagcctcaggttcgggtgcccctggccccgcactcctacctgtcccacacactcaccacccagactcacgctgcccagaggcccctccccgacaactcaccaggggctgggagctctggccacacaagtttcgaagacctactcccaaggaaaccaaggacacaatgaccttcaagacacagacagccaggaacagggcacggattgctgtgaacaacttctggagataagggaagaacaaagatagtcaggtgtcagctactccaatgctgcccacatcaccaccctctccacccacccaggcactgactctatccagcttgctgctcccaccacagctgactgtgtttccagccacagcttccatcccgttggcttgtctgcagagtgaacttatcactccctgtcaagaagtggagactattccttcaacccgtagaatctggaagggcctagaactgctttggccacagtgaaagtgacactatacagtgacagggaagcccttagctggtctggcagcttctactttctgtctcctgaaatgcttgcaactagggtactccccattggaatccagtttctgtgctatgagaagcccaagccaagtggagaagccattgccggctcttgctgacagcccccgctgagctccggaccatgcaactacatcatctcagacctccagcctcggcgagcacttggataacttcacccccatctgactgtaactgcatgagaaaacccgtgagtgagaatggctcatctgaatccagccaactcacagcaccgtgagaaataataagttgtcattttaagccactacattttggtgtggtttttaattcagtaatggaaaactgtgataccaacacaccagaaaagccagaagggtgacccactatctcctctctgaaatgtctcctctttgttcctcaccctccttgattcagagaatcttcgtgtcatgaggtctgaaaaatgtctgtagcttacattaaaacctcctgaatgaaagacccagcatgaagtccaagctcaaagagcctacatctctgtcctccagggcccccagctccctgggaaaaaagagctgtgatgggtccccgaagactggactcttcctgctcaccctcagcatctgcatgtaagctctacactcctccttctgccattggttctcttgacttcgccgcatccatctgtacccagtggtagggaagacagggtctgagcgatcacacacagtgtcgatgtataaaaagggttcagtttgccagatgaagctattcacgcagaggacaacagcagccatagctgtagcaaagcctgccagggtgagcaggctggatatatagccctggaagagaaagagggtcatgacacacgctccttcaatcggtggaagagtcatgaggtccccgcctcaaatccctctcctcttccccagcccttgtccaggaaaccctctcctcccctccaagaaagaccccaagatattgacaaccaaagggcagaagacagataatggagcagaattcaggagggggtcagtgaacaaggtggagagagggtgtccaagactcacagcaagtttgcccgggtgcttctcatggacaatggccccagctcctgctgcgatcacctgaaaagagacaccagaaaaaggcctccagtttactcttctgaattggtctatcatcaccctcccaccagcagttcccagaatagccaatgtgaagcaggatcccagggacagacaaagaactctgacacacagaccaggattccacctatacctgccccacccctcccatctgtcttcaagagaaaaatggaagtgacagggttttagctacaccccagagcagcctcctcatggccaaaggccatttggctccagagactttggtcgcttccccaaagccccaaccaagatccataagcgccttcttgcccatcaccacttgcctccctccaggctcacagcctgttccttactcaccacagaccccgcccagaaggcacagcctgaggcactcagcacagtccagggccccaagctgagacacactccaagaacacaactcacaacccccagcaatatctgagtcacctgcaagacaggatgagaaaccagaccccttcccgtgagtccacatgccccggctgccctgggaccagctgcctggctcctacctaggtggctctcctctccttttcctctgccttgacctctctgcagctctgattctggaagattctgtccccttaaaatccatgaagcagcactggcctgggtctcccctcacccttctcataggcttggctatttatccttcatcaatttttcccaacttcaacactttctcatcccacctgaagattcccacttttccccccccattctccttcagaggtcccattgtcccatccaaacccccagcctgacctgagcttctggcctatcctttctcttcagatccaaacacacactcttgagggctctgtggcagacacaaagaagtgccgctgagacctccttcaagaaagggcttgtttgattgctgacagcctgcagttgtcagctccttcagggtcaccctaatttttcaagctgaagacacacactgaggagggccccccagccaatgattaagcaagacagtggctcaagggccatctccacccagtgtggaactcctgcagtgggcaacctttgcctgggagctcccccactggcctggcagagtctgcattgcagcctgatggttcctcctgctcaatcctgctccccctcttttcatttcataggtgtcataccccaataagccgttcacacacccaactccgactcagaagagaactcctcttcttcctggaaaacccaactgtcaccacctccacatcctaccagcatctcggatttgtcacatccaaatcccctactaccacacacacacacacacacacacacacacacacacacacacctctcgaatggctgctcctcctgactttcagggctccgatctcctggtcacccacacttcaaccctctctgcatgctgtgaatgcctctctttccttatgccccaaaccccttcactcccatgccatggaggtctgtgaaggacagggactcctttgtctcctcaccatttctgctatgattatgtgagtgcagatcctcgatccttctcacctggatgcctcctgactctgaggcaggttcctgctcagaatccattgacagcgttctcactgtcaaagctgattcaggacagactcctcacctggtcgttcaaggctctcagcaatatgggcccaaatcacccattcatgaagcccattccctttactcttaaccattatagaacttgccctatgccttctggcctctttgcctttgctcctgccattctttaacctggaattcttttttgtccatcttccacctctgtctatacctattccttctccattcagggttctcctgccctcaaggatgtcagatgtgcttctccctcacctgatctacctttagttccagtcattagtgtagctgctgttccttctgatggtcactgagtacttttagatatagcccagggattctctctgtagcttggcctgaagtgctgaacacattgccttgcacctgtaggctttcagtccatgtggggtcaataaaaccgaattaacagcctctagactgttcttcctgttgccctacctctggctgggaccgactcctctgtgccaaagaggaggtcgattcttcctttccatccaaatttctgtggggacacttacaactttttcctacacagaatgagatataaatagtgatttctcatgtccctctcatgggaattcaacccactttcctcttttgcatcctattgaagaaggagagtttccactgtgaaagctgagcctacaaatggggtcattcttgtcacactcaactaaaacagagtcgagaggccaggggcaaaaagcactcggggcacaaaatgttgctcccaaaatgtaattctctacaaatcaggctgctgaagctgcctgctgcaacctgaaaccagctttatctacagcttctgaccttgctacaactctaggattagttttactcatgccatcgctcacccatcagagctcaccagctccccaaaacctatgatctttcatgaagggcaatatgtaacatttctcctttttataagcctctaaccttctctttgttctaaagacatactggagaccacctggtctgtgtgtatgccccaaattgcaattctctcctcccaaataaaacgttttaattttgaagatttggctctatattttaattgacctcatcacctcgttaacgtgccccccaaccccgcaccaccccagtcttacccctagagccagctgctcataaccaatcctggctgtggaaggcacagtgtccccagggtgaaaaagaaacttcttcagagaacctccagctttcagcagttgtgtcaaagctgactcctggtggatgtggacgttgacgtgggtgggctgggatggcctagaggccatagcaactccattcacaatcaccgtgttttgcgtcatcctgcctgccagggagaagacatatagcagtgaggtctgggaactaggcgagggaaaaatacacagcacaggtgaaaggagagaaatagtgtctttgtcaagatcccagctgggcacaatagctcacgcctgtaatcccagtgctttgggaggctgaggtgggtggattacctgaggtcaggagttcaagaccagcctggccaatgtggcaaaactccctctctactaaaaatacaaaaatccgcacggtggtgtgcacctgtagtcccagctactcaggaggctgaggcaggagaatcacttcaacctgggaggctgaggttgcagtgagctcagatcttgccactgcactccagcctgggcaacagagtgagactccatctcaaaaaaaacaaaaacaaacaaacaaacaaacaaaaaacagtgtctttgtcaaaattcaaaggggcttcccagtgcagatatcaatggcactggaaatcaatagtgattttacacataaaaaagttaagagatacaaaagggtatatatacctttaaaaccttatcgctcatctttttccctcaaccacctatttgccttgcagatgcaaagtaatattatcagtctcttataaatcctaccatgacatttttgcatacaaaagtgtgaaaaagtatttctgcccccttttcccacaaatagcagcatactatacacactgatttgcatgatgctgtgatcacacgatcatatgtttttagaataatcctacatgagtccataaaaagtgtcaacctaaataacagagagaggctctccaaaagaaaatgagattgattctggaatagggcattgcaatgagaatatgcttaccatagtaaatcatgtgcacgttcagggaggtaaaggaagacaaaggtttttaaaggaaaaatggggagacttacataatctctttgaggtgatcatccttggctacaaggatcaataacaagggtgacacaagtccagggttagacaggcagttgctggtggatgtcctcacagaagtatttttttgtgtaaggttgtcattttacagagtcctttgtgatgacttttgttcccaggttatttacgcatgagaaccctgccttgtgggccttccattttcagattttttttttaactcaagtgactcgattatgattctgacaactttcacaaaagcttcttcactcatttgtgtaactgcatatattttgagagtatgaattcctcataatttatttaagtggttccctattggcagacatttaggttatttctaatccttttccattacagacaatgtggaattggcagggcaccaggaatgcgcatttgcaattttagtagatattgtcagttatcctccacggaggtggtagcaattcacatgcaggaggcaaactcttttatctttttccttttatatggggaaaaatgcattgattttaatcaattttatgtaataaaaatgtcccattttaaatgtatatctcaacgagttttgacaaatttacacatttgtgcaattacagctacaatcaagataaaggacattcctacacagcaatacattccctaaagcccctccccagaaaatacccccaaccactggccatgagcaaccactgacctgctttctgtaatgatttccatatatttttaatccatggttttcttttatttcatttttttattatgtatttatttatttattcattttttgagatggagtctcgctctgtcgcccaggctagggtggcgcgatctcggctcactgccagctccacctcccgggttcacgccattctcctgcctcagcctcccgagtaactacaggcgcccgccatcaagcccagctaattttttgtatttttagtagagacggggtttcaccgtgttagccaggatggtctcgatctcctgacctcatgatccgcccgcctcggcctcccaaagtgctgagattacaggcgtgagccaccgcgcccggccagttctctttttttagagagagagatggggtgttgctttgttgcccagggtggtctcaaactcctggactcaagcaatcctcccacctcagcctcccaaagtgctgcaattacaggtgtgagccaccacgcctggcccatagttctcttattatgagtgaggttggttgtcttttcatatgttcagggccatttttatttcttcttttgtgagctctccgttcacatcctatgtccttgtttcgttttgttttgttttgcttttttctatggaagttctttatctattcacaaaattaccgtttgtgatatgagtttcaaatgtttctttacaatttgaagtttattttttgaccttgcttgtatattcatacaatccatgttctatttcattctatttatggtgtctagctcttacacttttaaaggacttccccgtttcgagattataaaataatcttccacattttcttctaagtgcctttatgctttcagttttcacttttaaatgccgaccatctggaatttgggagctgggtgaccaaccttcgccgttgggagacacggatccaagttctgttgctgtcattcagatgtttaacttctgaaagatacgttccatttgcggaaaatacatcctctttttctcagtgatttaaaattctctcctgagcagaaatgaagttcccctaggaatgtaggcctattctagtccttatattctgcccattggcatgtctcatgggctaggcatcattaccacaattttaacatggagcttaatgctaattgggctgtttcatgatcccctcgtgtggtttttctttcagaattgtcatggccatttttgctagactacttcttcacatgcactttagaatcagcttgcctggctctaaaataaatcctgcataggcaattctaatggacatcctggctaagtatcacagtttaaatcaaatattattaacaattctaataacacctcccattcgtactctacctacttttcaaagcagtttcactctttcacccacctggcctccttggggttagaaaggacaggagttagacaattccgcacacgtacaaaggagcttcagactgcttccagcccagccccagattccagccagaccttcccttgacggcccaggcctcgccctgagggcacctcgggttccagctacctccgggcccccaggaccaccgcttcccccgccccacgccaacccctagatctgcctcgcccccgcctgaagagtcggatctgaaccaggccggcaccacggagattcccctgcgggccgcccgacgcctggtaggtggtgggctcttcccggctgccccgaacactttcctctgtccagctcttcccgtgccccggggctggggaaagcgtccggcagccccgccgctccctggccccgtcccaggagccaccccaccgtagggctccagccagggtccaggcgtgcaggcggcagaaggtggacgggacgcgccagccccaggcctctcctcccgctctccagccgtttttctggggagaaacacctgcacccagctgtccctccctcctacgtgagtcctcctggaaaccaggttggaggaagaaagacgtcctgtggacaggacggggtgggggcatggccctggggactcctcgtgacagagggtcctgcggcaagagggtctcccgggccgcggaggccctgcctcacctgcagtcctccgggagcccgcggccgagcagagcggacactagctgaccccgagcaggggagcgacgggagggcggagacggcagatgcacgggtgggggctgcggccccgcccaggctgcgcggtttcccgaaaccagctgcggcccgggggcccggcaaagggggttccgcccggaggagcggaccgggcgggagaagaccgagcccccgcgcgccccctgcgctcccactcgcgcacacttgcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccaggtgcggccccggcttttgacctacctccgcaccgcagcgcggtccttcacggggcaggggcggcgtgaacccgtcgggcgtgagcagcagtcggtggagcgggaggtcggcggtggcggggatgggggtatccggagcgcagccggggcgcagctgctggcacaggagctccacaggcagccaaggactcggtcctgtcccagagcctgcggactgtggaggggaggccgcaggaagagcccgggaggagggggtgaggggtcgaggtgtggggcgctgcttgacccagacgccagggccctgggaggaggatgagggggacagagcagatcttgggcgaaaggggaggttcccgcaggctctgtagtcgccgcagttccagcatggtcagcaccccctctgctacacacattcccctcgtgaggggccaggggtgcggccctgtgaccaggacagccattcattgggtgactttgagccaccactggcccctgacctccccaactccaatgaaatctgcgaaaatcttctgacagccgttcctctctggtgctcccttcctcatagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgagtgtgacggcctgcctcgtcgggcggcgggaggaactccccacctccagccgcagcagcactctctgccagcctccctctgaacaggacaccgagccagttatgtcttcttacttagcgatgtgattctctggccttctcagtaagagcctggggaggggaggctctgggctgaaggggtgtggaggagccactgaccatgcagagtcccaatcagtggagccctgagtccatcctttcctctgggccaaactcaggatgggccggctctcctctccttcctttcccttctcttttctcctcctcctgcctcttcttctttctccttctcctcctctttcttctccttttctcttctcttctcttctcttctcttctttctttctctctctctctacctctccctctctttttggggttttagcggttaatccctgcagtggcaggtccacctaggagccgggatcttgggtcctttgtctttcaggtgatgcagatcgtgctggggatcttgagtgcagtcctaggaggatttttctacatccgcgactacaccctcctcgtcacctcgggagctgccatctggacaggggctgtggtgagtagagcaggacagtgcttgactgcctgtgagaggggtggggcattgctctcctgattgccttcctccaacatggcgccacagaatgctggcagtcggagagatctgattatctaggaccattccctgcctgttcagatgagcaaacagctgagggcggtggtggcatgtcctattcacactgtctgctctcccatacccttcccagtgctgttcccaccaggctggctgcctctccctgccttcaacagttaatgtcaactaaggatctaaggacctgctcatctccagatacttgcattgagatggggaaggcagagcgttccagatagtatgtggtcccccaggaagcatcaccccctggttattctcattgtcctccacaggccctgtacacaatggaaacccaggaattgttgtcaacagatgggtgtgtgcagtttgcacaggagctgggtaggctggtcatggtacctacactctcagaatagcactaaaacactcatatttactgacagaagccgagagtaattaccttcacccagcctgtggcaaaatacccagcttaattacagaattagccaaacaggattcaggtccacctgtccactgggacatactagatttcctgttcttcaagcccagctgagtggattattgggcactgttaggacaggcttctagacctaacagtgcccactctgtatagactcacccttcattgagatcttctccagcaccccatgacttttatccacaggatcccaccatccctagaactttcataaagcacttggtgttgtttaaaaaggaaggtttagaagggaagaggggctcacacctggcttgaccacaagctcttaggtgtcactaaagcagggccttttgcagcctcaggagttggatccaggctccaccctctcagcaattatcttaccatggataataaagcttagcatgaaacctcccgcccaagctgtgtgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggtaagttcagggaagggcatgggaggggaccaggttcaggctggaggtcaccccaatctcctgccctgttgcaggcttctctgggccttgcccttttttcccccgactggactctgagagagactgaaacacaaagatttctctctgcctcctccctccccaggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggtaggtggccaaggggaaggggcagcagcaggtggggcagggatggccaggccaggccaggggcaagagtcaggttctccaccagaaataggtgttacctattctgcaccaagcttgcgtattgtcaccaaagacaaagcatcagacaaaatagaaatggctcctgtagggtgttacagacaagtgggaaatacaagcattaaaataataataaatgaaccactatagcaagtgtgccaagtgctgcaaaggtgttaaatgcatgttttcccttgatcctctgaagtcttggaggttatcagggaatcaaatcatagcccaaacctgtcactgtacaaatgaggacacaggcccaatgtgagcagtttccagctgtattctgtacattgaatgcattgacttcccctccagaagccacgaacttggagataaaggggtagagattttcccaggtcaataaggagcatggggacagagcaggaaggcagctgtcatcctggtgcttatggccttggccctctgtccccaggccttgttcagaacccttcaggccatgctcttgggtgtctggattctgctgcttctggcatctctgacccctctgtggctgtactgctggagaatgttcccaaccaaaggggtgagtccctaaggtgtgtgcctgtgtatttggggcagtggaactgctcaaaggagacaggaatggacagtggacagtttggggaggagaaaggggcccatgacccaagtcccacctattatcatgcctgtctttctacccagtggtggcccagcccagaaagcccctatccccaaccaagtggcccccaagtcaaagagcccaggaatccagggaagtccatatccatgctatgcctttggatcaggtaccatgctgctgattctggtagctccagagctaagctgcccctggaggagagactccgccctttctctcccactcacgattgtcttgcctttcctcttccattagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 10519 - DNA, 481 bp, Homo sapiens
actgcacttaataactatgtgaaagacagtaaatgaagcctagagccacttaagctggagagttacagtgaaggacccagtataaatcttcactttcagaggacatttgggaaaaaatccactcctttgagggagatgacaagtaaactcttggtgaaaggagtcagatgaagattcgtgaatacaagccggccctaacatggacttatggatggaattcccactccttggataaacccccaaaccctgagaaaataatttaaaggttctcaagatggtagtgacccctgacacctgtcagaaacaaatgcaaattctgctggagaaatttaccttcaactaaacccttaaatgatcagcatgactatattttttaaagtgagacaaataaatagaaagcaaaaaaaagatgatgattataaattaagtttatgagtaactgcaataaatataaatggataaaatagtccatttgaaccag

SEQ ID NO: 10520 - DNA, 488 bp, Homo sapiens
ggttgtgtttagatacatttttatttacaaaattcaatggcaggctggatttacccctcaggctgtaatcggctgaccctgtccatattctgaacacactcctgtctcgcaggcttctttacaagcctctatgtaaagcacaggctggtgagggccccaggaagagcagcaccgccctcggcacaggcccctactccaagtcctgtgcaggagcaggtcttgcccagcgcagcagctctgcacctctgtggcaccgctctgccaagagggaaggtgcaggccctgcagcccatcgccttggatctgaagaccagccctgtggggctgctaagtcatgaaactggcctcatggagatttcataaagcccctaccagctttcctgcccttcagaaatgcttacatctatatatttatgttatatcttcatatataaagaaaatggaaaaagtcaaaatcagtttgctatcatttacaatgaaaggaagga

SEQ ID NO: 10521 - DNA, 148 bp, Homo sapiens; identical to SEQ ID NO: 8938
  misc_feature (136)..(136): n equals a,t,g, or c

SEQ ID NO: 10522 - DNA, 86 bp, Homo sapiens; identical to SEQ ID NO: 7987
  misc_feature (21)..(21): n equals a,t,g, or c
  misc_feature (65)..(65): n equals a,t,g, or c
  misc_feature (74)..(74): n equals a,t,g, or c
  misc_feature (76)..(76): n equals a,t,g, or c
  misc_feature (85)..(85): n equals a,t,g, or c

SEQ ID NO: 10523 - DNA, 130 bp, Homo sapiens; identical to SEQ ID NO: 7216

SEQ ID NO: 10524 - DNA, 116 bp, Homo sapiens; identical to SEQ ID NO: 7991

SEQ ID NO: 10525 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 10526 - DNA, 118 bp, Homo sapiens; identical to SEQ ID NO: 7220

SEQ ID NO: 10527 - DNA, 16463 bp, Homo sapiens
gtgcaccgggtataatttcttcaccatatgcaggggctgctggatttgccccagccattggatttcctcaagctacaggtgattcttttaagttggatttgaaatgacttttaatgaagttgtatattttctaggaacttaccaagatgaagaatgttatcatatttgaagaatttaccataaagcattatgcatatcagctgtagaagtgtagtgatttgtatgatatatagcttccttgttatttacaaattattctctctggtcctatttttaattccagtaatcagtatgtgttctgcatcatttatgtttgcttttggcacaaataactataggctaactacattaaataaccttagatttgcctttccagttgttatataaaatgtataagctgctctgtctttactgataaacttatcaattatgtgttgaacagacctgtcttatctttgggccttcaatgcctttgacagtactcaacaaataatatgcagtcatactatacattcactattcatctttggaaaaccttttgtcattaatgggttttgaagattacgatagaggggtatgcatgctgtttatttcaggggatatatattttgtctctttagctaatggaggtaattaagagataggagttgattaatacgttgataatgattcccattattttcaaaacagtaaacaaaatgaatttgattataatttaaggaaaagagaaaatgttactttatggttttatctctggtgtctaaagaaaacactgaggttggtgattaggggaatgacagagtttggtaagcctactccacatatttccaacttaaactgattcatgactttaactacattttaaattgcaacatagctgctttctggcagtaatctttatattctaacctttgaattctgggaattttaactactctctctctctcttttttttgttgttgttgtgagacagatagctcactctgttgcccaggctggaatgcagtggtgcaatcttgtcttactgcaacctccacttcctgggttcaaatgattctcatgcctcagccttctgagtagctgggactagaagtgcatgtcaccacgcccagctaatttttgtatttttagtagaggtggggtttcgccatgttggctaggctggtctcaaactcctggcctcaagcgattagcctgcctcagcctcccaaagtgctgggattaaagggtgagccactgcacctggccaataactactctctttttgatggagaggatggagttaacagaaagagtgatatgaaggttgaggttttaaattttaccatcttggtggtttttagtatatcttaacatatgtttaattaagtgaatattctacctattgtgttaaaaacatagtttatttatttgaagctcctcaaggtttaacaattggtggacattttgatatgttttccctcattttggatatttcttttagatatactctatatataaatattaattaatattaagaaagatgaaaagtgaataaaagagggcttctgacttgataagacttttaagctgatagaagatacacacacacacacacacacacacacacacacacacacacacaccctacagtgtagctcaactgtgctcttagctcatgaataacagacatacaaacagcaaaagttatgcaaaagtcagggttggactggaggggcatgggaatatgtcatgtgaaggctattgatttcgtgcagtagtattcagcctgagaatgtggtctgcacagttttaaaattcagcagtatggatgatggtagttatgaccttcttagattatcaagcagaataggctgaatgtaaaatatattataatttaattacatgatttgtggtgaagtggtcagactgtttattttaaagagtcattaaattaaggaattggttcattttgcataaactagaggttttaccttagacaggttttaagctgagaacacaaaatagtgggaaagtgtgctgttttaagtatagtgtcagtattctgctgttactgagctttcaggatttccatagtacctagagaagtagagagctcagaacatttctgctacaaaagaatattgaattctgtaaatatctattttggtcagaataatatttaatatagcattttatacagtcacaaaatgtttttcccatataaaatgtcatatagcactacctagcatgcatgtttttgactttctgctgaaggactttaaaaaaatacatatctgattttatggtagaagtcagtatgaaaagcatatacacttgatagaagggtgttaggatatatctattgtaagaaacagagggagtgtttgtagttgatagaccctctgaaaagcctaatagcgttaggcccagtgagttcagttactctgcagagtactgtgtggataatagagcactaagtatagtaatgtcaatagatgaggagctcagcttgcagacagactctgtagggcagaaaactggccttcagtatctttatggtagccttgacacattttctttctgtagttttcctttcctctttatttacttaaattgtatcaagtgttacagttcttcaaataattagaatatgaaatgcttttggtatttttaaaaggtctatcagttccagctgttcctggagctcttggtcctctcacaatcacctcttctgctgtcactggaaggatggccattcctggggctagtggtataccaggaaattctgttctactcgtcacaaatctcaatcctgatgtgagttgaaaagtattatatgtaaatagtctttcaggagaaggtatagtagcacttttttctttctttcttttcttttcttctcttctcttctcttctcttctcttctcttctcttctcttctcttctctcttctcttctcttctcttctcttctcttctcttctcttctcttctcttctcttcttttcttttcagaaaggattttactctgttactcaggcttcagtgtggtgctgcattcactcactgtgacctctgcttcctgggctcaagtgatcctcccacctcaggctctcaggtagctaggattacaggtgcccactaccacgcctggctaatttttttttttaattcttttgtaaaaacaggatcttgctatgttgcccaggctggtctcaagctcctgggctcaagcgacacacacctcagcctcccaaagtgctgggattacaggtgtgagccaccatgcctagccatggtagcttctgatccagggttgtattcaaattaaaatgcttaagtttgttttaagaacttctattaaaattcatcactagtatatacggaagaagcatataaaaccatgctttaaaataaaatcaactgccattacagtataaataaacttattttcaatttttacttaaattgtcagacacttaactttgtgttaccctttacagcttatcacaccacatgggctttttatcctatttggtaagttcatttttgctattttattattgtctacaggtgtgaattgagcacatttcacttttttagtaatatgtattgattacttctgtgtgccaagtattgtgctgacactgaggataaaacagtgaataagacttagtaagtaattacagtgatgatttatagtatgggaaatataggttttgtaaagggagtgtaacgcagggagacctaacctagcagagggactcaatagaaatgatagttaagctgacttgttcaacatgagtaagaatcagccaggcagaaagggagggcaatgtcttcacaggggaggggagaggggagagatgggtcctggtgcatggaagtgaaggaagcccagtggtgagcataggcaagcataatggagacctggtgaaggtggacagctgcgtagggtcaaaatcgtgaagagctgttaaaagctttgttaaggaatttggtttttacctaagaacaatcggaagccattgaataattttaaggcaagagagtggtataatgcgattcaggttttaaaaatagtctccaaactttcgaacagcatagaaatatgagaacaatgaaataagcaatatttactattttaaagatttttattaaggacagtttatttttccataaaacatgattaacatctaatgagcagtatgattaatatgctttgatattactaaaaatccttgttttcattttgattcagtaatccaagggtagattatttcactacttgattttaatggttgtcatagctgaagaagataaatcataaatatatataatctaaatgcaggggtttcattgttgctgtacttcaataattatttcattatttttttcatgtaatccaccaatttttgtcatgttttatctagaaaagttagattttttccccgtaaatcagtggatcttgaaaactgttgtgtttgaatatgtctgacaaatagagttaaaactcactgatatgcttcatttgtaagatttttaaaataagatagaaaactgcttccaaattttttgaatgtgatagttttagagacagggtctcactgtttcccaggctggagtgcagtggtgtgatcatagctcactgtagtctcaaactcttgggctcaagcagtcgtcctccctcagccttccaagtagctgggattataagtgcaagccacaacaccaggctgataggttttttttaatggaattttttcagatgtaatttacaaccatacagtttacctgctttgggtttacaactcaagatttttgtaaattcacagttgtgtggccatcaccacagtccaattttagaaaattttcaacgcccgagagaaattcctcatgctcatatgcagtcactataaaagtttttattaatgattgatgcatgtaattttcagtaataaaatcaagtattaataatacattttaatatgactcttttctagccaaagcatgtttcataccaaaagtagttaatttctcactcatttaaaaaatggctgggtgcagcagctcatgcctgtaatcccaacactttgggaggccaaggcaggaggatcagattgtttgagaccaacctgggccagatagtgagaccccatctctacaaaaaataaacacccacattttgcaaaacaaatggtatatgtttagtttttaaagaatagttacatcaccatcgtgttatttctgagaaaggtagcaaattcggaatacttgtctccattttaaatttttaaagtgccattagtatgataatgatgtaactattgaaagatttttttttttttttttgagacagggtcttattctgttgcccaggctggagtgcggtggcacaatcttggctcactgcaacctctacctcccaggttcaagcaattttcccacctcagcctcccgagtagctgggactacaggtgtgcgccaccaggcctgactaatttttgtattttttggtagagacggggtttccccatgttggccaggctggtctcgaattcctgacctcaagtgatccacccacctcggcctcccaaagtgctgggattataggtgtgagccactgtgccctgctgaaagatcttatttttataatattgatgatactctgtagcacataaactgaaatatattgtaatacactggatgaaaaaatcgagtgagactggaattgacttcgtagaacctgttggctttaattttatctatatattaaaaattcaaaaactgtagttttttaatattggtttatataaatagattagtatagataagagtttgattattatctttccataccccagtgaatcactttacccatcctttaggatatgggacccactttggggaacactagggtagaaaaatcgagggtaataagatgagttaggatcaattaggttgtcctgattgtccgagtgtgaaatggtgttgatagctttgatggtagcgaggattgggagaggtggacaaatatgagagatatttagaccatagaatcaatgggtgctggtgattgattgggtgggtgtcagggtttgaggaaaggaagaagtcaaaagatgactcccaggtttctggctggagcaactgtgtgaatgatggtatttatctacagctttagtgagcactgggagtggggagaggaaaggggggatgaatcattttgggacataataagtttagagtgttgatgggacatccaagtgaaaaagagtaagtacatgaatagatctggaactttggaagagataaaaatttgcaggtgtatgtatggaattgccaagggagagtaagaaatgccttctttaagtatattagtaaaattaattaaacacaacacaatcagacgttaaacacagtgttttgttttgttttaattaggagtctatggtgatgtacatcgagtgaagattatgtttaataagaaagaaaatgccttggttcagatggcggatgcaaatcaagctcagctaggtactaatgattaataattattaataataatgtgaacttgccccttttgtgtgtgaattttccttcaaaatacagctagtaggaatatgattttacaaaagaacacctccttgtgataatgccttcattattatttgcatctgtctatatgttaaggttaaaaaatattcatcactcttctaagtctgaagttcatttgtctacgtgaacatattgttaatttctagagctttgaccctagggtttttccgttaagtttaataagcatgatttgttttatttcatttttttaatttattttccttccaaattaagttttctgtaaccactgagtggcttaaaagtttgggcaaactttgtaatgatgatacaagaaagggttcatggcttcactgttataaaagctgtaaagtattactcaaaatttcttataaaaatgccttgcttgagataaaactaatatattcagtaaccatttcatgaatacttactatgttccaggcactctgaaacttcatagcactctgctcagaaaatattttttgtttgttttaaattgcttttcttatagtgaaatgaagtcatttaatatatttccttgagggtttttggattttgaaacccttttcaccctcaaactgataatacagttttaaataactacataaaaataatttatggtaatgttgtcagatactactgagaaatctatcctaatactcaaactttaaaattttcttcccatgcactagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattccgtatgtacctaataagttattaatcacttagatgatgaataatctacaatatgtgatgtaggagaggttaaaacttctgaaattgttctaacctagcagttgtcctggtcaacagtttctgataagacaatttatttgccatcatgccttcagaaggttatctccaatcctacactctaaaatagaaagatacctgttttaaaattttctttccaaatagagaattcacaactagttatttttcagtgatcaaaggtcataaaaaaaattctaggcagaagtattccattggcacgtatttgtccatctgtttgtagaagtaatgactcttacgttaaccaatatgacaaaatcaaattgtgtatctaagaatttggtaaaaatggatttcatactttttatctacaagctgtaaagccatagatatggtaattacttaaaagctaaacgttattttcctgtagccactgtacaggtctctttattaaccagtgttgtatgtgtgctttagttatcttcaaactcagggattgacaacctgtagcctatggctgtttttgtatggcctatgagctaagaatgatttttacattttaaaatggaagcaaaatattttgtgatgtgagaaaattatataaaattcaaaattcgccttttataaagtttcgtgtaatatagctgtacccattcacttacgtgttacttatggctgctcttgagttacaacagcaaagctgattagttgcagcagagacaatatggcccatacagcctaagatatttactgtctggccctttaaagaaaatatctggctatctctgtcctaattgttgaagtccttagtctacaaaaatggcagttttgttcatggactttggaaattgttaaaacaaaaaaatggcagttttgtataatttgaactaatacataaaagggactataagctttggaaaagagataaaagctgtgggggatgtgtgtgtatgtgtgtaaaaatttaaaaacttgagggtatagagaggggtgaagtctggaacattattgagaatgagaatgggaagtgaatagtaatagagaataattactcagaagaatgctgaatatccggcctccctgctggtctccagttaggctgcatggagaaaccttgaatccaagtggggcagtggatcaaacctcataccagccgggaaactggtagagtcaaggaaaaaaaaaaaaagtagattaaaagtagatgacatggaccgagaaatttagcagctcattactgtggagtgtagggtaaatggacaacaattagatactgaggcaggcacctgtcatcattagcttttaatttttttaaattaatatatttttttttgagacagggtctccctctgttgcccaggctgtagtgcagtggtgtgatctcagctcactgcatcctctgcctcccaatctcaagtgatcttcccacctcagctttccaagtagctgggactacaggtgtcggcatgcccagctaattttttgtatttttttgtagagacagggttttaccatttgcccaggcagatctctaacttctgagctcaagcaatctgcctcccaaagtgttgggattagagacgtgaacgactgtgcccagctctgttgttagctttttaaatataccacatcacgcaggagctgggctccagttgcaacctacataggacatgtaggaagaagaagaaaggatattaatattcttccaagttctgggtactgtactggtgctttacacatgttgcctcatttaatctccacaacaaccttttttaaaaaaactgtgataaaatacacataatttaaaaattacagttttaactatttttaagtgtacagtccagtatacattcacattaattgctttacacattattgtgcgaccgtcacctctgtccatctgtagaacgttttcatcatcccaaactgaaactctgtacccattaagcagtaaccacctttttcctcctaactcccagctcctggtatccactattctatgttgttgttggcattattatccataataacctttgaagtaaggtattttcattgtattaatgaaactgagacttaggttaaaaaatttactcaaagtgatatacaagtgagtgaggaatagaaagtgaacccaggtctgtcttcctacagagctaatgattgttctgctatactgtccttgttggcagttgtgagatgaatctacttttagtcagttgactgtcacgtgatagaccactatattagttatgtatggctgtataacagaccaccccagacttcacagcttaacacagtagtaaatgtttattatctcatattgttactgtgagtcaggaatctagaagtggcttagctgggtggctttggctgagtctgtcataaggttgtaatcacgatgcaaggcaaggatgtggtcatctgaaggttttaactggagatagaggatccatttccaaaatggcttagtcatgtgcctgtttgttgaccgaaggccccagttccttgtcatgaggacttctccatagtgtcttcacggtgtccttccaaagctaatgattcaggagaggacatagtagaaaccacaatgtctctcagcttcaaaagtcacacattgtcatttctacagtatccaaagtgtttacagaggatacctgtgctttctatgggaggggaataaacaagggcatgaatatgagcaggcaagagtaattgggggccaccttagaggctgacagccacatacacacattcagaattaccctgcaaacagttgaaaatatggaactccagactgtagcagacaagtcagagctaggaaactttggaagtactacagttgattactaaagccagtggtatgactaataagaataaatatagattccaggcacagctgcattaaaagaaaaaagaatatagaaagatttttcttgccctttatatacctgcacatgtcttctgcaaggattgagacaaaattccattgcttgacgatacatgtcagtttttgaacatctttcagggaacttccaaatcaagtctttgtcatatggcttaataattctgtttgaaatgtactctagagatttgatgattgcaagagttaatctgcttcacttgagaatgcggcccaggtagttgactccctctgatgttttcacagcccttctgttacagtggatgatctgaagaaccttttcatagaagctggatgttcagtgaaggcttttaaattctttcagtaagtctttgctttcaagaaatacattaaaattatttaatatggtatgcaaattttaaaggtagttcagtgaagtcttctggtggaggaaggagtttggaagcaaaattcattctaaatactttctgtatttcttataccattttcaggaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 10528 - DNA, 2711 bp, Homo sapiens
ttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 10529 - DNA, 692 bp, Homo sapiens
gtttccctttgtcttacctgtaattctaatgatgtcctattttcttttcttttccatagccatccatctaaacgtgtcatggttagtgaatagtgagcacatattcaaacaatgttcaaaatgggaaaaacacaaaatctattaactgtctctgtcttcatttaggaataattctcgttttgaggagcaaagtgctttcctaatcttcctatgatgcaccttctctggcactgccccgtaatgcaggggcatggcggcatgctttcttgcttgcacactcactctcctttttctttctctctttctccccatatgtgcagtgccaaactacagttggaacactatttccagttttgttcagtatttggcttccctacggcattagtatacatacactttgagacacaaggtgtgatctcaaaccaaatttgtgtcctctttaaaaaggtagcacagatactagctgatgctacattccttttccttagacaaacgttttacttctcagatctttaaagaattgttggattgcagaagtctagacttagcgttcattgtatattttagtctcctggaagtgggaatttattttgaatggaatagaaaattaggtaatcactactaatctttgctggcttacctgtaaaatctgtggtctccataaatactgggaaaataaataggtattttta

SEQ ID NO: 10530 - DNA, 691 bp, Homo sapiens
gtttccctttgtcttacctgtaattctaatgatgtcctattttcttttcttttccatagccatccatctaaacgtgtcatggttagtgaatagtgagcacatattcaaacaatgttcaaaatgggagaaacacaaaatctattaactgtctctgtcttcatttaggaataattctcgttttgaggagcaaagtgctttcctaatcttcctatgatgcaccttctctggcactgccccgtaatgcaggggcatggcggcatgctttcttgcttgcacactcactctccttgttgtttctctctttctccccatatgtgcagtgccaaactacagttggaacactatttccagttttgttcagtatttggcttcctacggcattagtatacatacactttgagacacaaggtgtgatctcaaaccaaatttgtgtcctctttaaaaaggtagcacagatactagctgatgctacattccttttccttagacaaacgttttacttctcagatctttaaagaattgttggattgcagaagtctagacttagcgttcattgtatattttagtctcctggaagtgggaatttattttgaatggaatagaaaattaggtaatcactactaatctttgctggcttacctgtaaaatctgtggtctccataaatactgggaaaataaataggtattttta

SEQ ID NO: 10531 - DNA, 13754 bp, Homo sapiens
gacgcgagggttgcttgggcagcgactgtcatggcggcggccgccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggtgaggccgggcgatgggacccttgggaggctgagggcctggacggcagtggggatctctgccgagaagaccacgcgcctgggaggcgagggactgcgggccttgaccttgaccacaccctcgcctcgttcgtgaatcgggcgtcacctctcctgccccctcaggccggctttcctgatgaaaattgggttagagaatcggtgctgtggttggggcctgaaagttattacatgacatcctggctaacacggtgaaaccccgtctctactaaaaatacaaaaaattagctggacgtggtggtgggcgcctgtagtcccagctattcgggaggttgaggcaggagaatcgcttgaacccaggaggcggagcttgcagtgagccgagatgtgccactgctctccagcctgggcgacagagcgagactccgtctcaaaaacaacaacaaaaagttattacgtgggtgacttcattcatccgttcattcccttaaattcattctcttaaataattctttcaacaaattgttcctaagcaatatcacgtgccaggtgaaagagacaagagcctggtcttcatggggcctgtattatactatgtggagaagaatgttgagcaggaacactgcagaggaaggatgcagacatatggaaatgcacatgcagacgactctagggcagcagttgtttgaggtttgaaaaactgaaagaccattgtgactagacagccccgagcaaggagagacgaagtctgcacttgtccttctgtttttcccttaagttgaaggggaggtgcccatgattttattaaactcatattgaccatgaggtcatgagagggcatccatctggacatgtccagccggctcaggaaggacagatgtggcagcagtgtgggatttgccattaggtagctgtgtggccttgggagaagttgcttaacctctctgagcctcagtttatagaaaggagaggctaatagcatctgtctcactggattattgtgaagaatgaatgaggctgtggcatactggcatgtgctcagtaaagcattactgtgaatgtcacagtggccaagagagtgatttgcaaagttgatagctgaagttgagggtggctggtttacatatgagagaatgtagagagaatagagggttaaagatggaatcttgagaaatgttagggaatgacaggaggaagaaatcttagagacggagaagatgatgtcagtaacatagaccctggattgcaagtctccaggcaagtggagagtttgagtggcaagaggggggtgtcctctgcaccggtggtcatccaaaagcatggtcccttccaggatgatcccaatagagtaatgcagaaaacatgccaaagacaccttcatctctgtgtttgcttctaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatctgtaagtgtctctgccttctaagaaatccttgctggggccaccatttcattacttttaaagagaaattgctctttaaaagtcatttgaaagttgttactagaaagcaaatcagaagcatcagatacattctaggttgaacttccataaaatagtccctgtggcagactttgtgtgtgtttacagtatgggcttgcattattttttactttttgtaggctagaagttagctaatgattttaaacgagacttattggagagccccttgaagaaattttgattacattccaaatgctgggcttggtttcagcactctggtgccacctgcaggaagcatctatgaacgcatactatatatatatatatatatatatatatatatatatacacgctgtatacttaggaactatattttcaagaaagattaggtttcctttgggtagggactgaatgagctaacgagcaaccctgtgtattcctccttaatggtctgccttggcttgtttctttggctctaacgtgtacttccctgcccacagtaccggggaacatcagactggaagaacagtgtcatcagtggctgcatcacgggaggagctattggtttcagaggttagtaaacggctctcgaatgctttttctttgtggccttggacaacgtgctgaggttgtcatttccaaacacacgagtgttccagggacacttgatcttcttccctctgacaaataaatcatgtttgtttctgtggtaactcggttttggaaacttgtaggatctagatgagggtttcccatcgttggcactactgacatttcgaccagacgaatctttgtcgggattgggtctgttttgtgcattctaagacgttgagcagtatccctggcctctacccacgagatgcaagtagcacccccgtccgttgtaacaacttttttttttttaaagagaccgaatctcactctgtcgcccaggctggagtgcagtggcacgatgtcagctcactgcaacctccacctcctgggttcaagcgattcccctgcctcagcttcccaggtagctgggattacaggcacccgccaccatgctcagctaatttttatttttttagtagagatcaatttcacctggtctcgaactcctgacctcgtgatctgcctgcctcagcctcccaaagtgctgggattacaggcatgagccaccacgtgtggccaacatttttctcagtaattctagacaattgtcttttaattttagatataaattataatggtaatatctttctgcccttggggattctgatttctacccattgaatgctaagtacagatattctagaaatattagattatcagctgcaaaaaaaaaaaaaaaaagaaaaccaatttgctgcctcttctccccgttggcatgtccattcagagcgtggtggagggccttggtgacttgactttcctagaagcagcagtgttttatcactgggccactttccatctgtcatgccctaacttacccagagcaaaaagccagttttctcatcttctgagagacaggatgatttgctgtcatgaaacctggttttgctcctcaagcaccatttatgatgacggactgacttctccgccggtcgtcccattgttcagcttcaccagggcctctttgagaagctctgctgtctccagtactgctttgatcaccttcccaggaatgtattccataaacaaatcagggtcaaggccatatgctttcatttgattccgagggctgcttctctcaaccagtttcctgcctgcgaggggctatttccctaagactagaaataccctttgaaggagaaaagctaaacaaatgtagttagataaagcgcactggattagatcatatacactgcttcattgatgtcttccagagctatgatcgtttgaatgacttacagtgcttaagctcatttcatgacactgagggtgtgccaactttccgtgagtgcctcgtgacccagcagctgtcaccacaggtcatgttctttctgtttgtttgacagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggaggcccgagtgtttgtacatgagtgatgatgtcaaacccagctggtaacaccttccttgggtcatgtttgccattttcttggaatgaatgtgagttcctgctcagggctcatgtccttttacagtgaattctatataacgcccctcccagtctcacagctaggaggcttcatcactgctaggccagttggagcgttccctagagctcagaacaaattgtttcctctgctgtccctaaatataggacacctacaagcactctgaagcaagggcagacattcccacctggtacctgtcaaagtcctaggatgcctgggatcttccatctttcagtctagcacgtgggaccaaatacaagagatgctgccctcacaacagccttggaaaagatgagcgccagggctgtcagtacccatcggttcagtaagcgaggcattgtccacgctgcctattcactcgagagatgaatagtttcctgttttcgatggctggggagccagtatgagctcataaaccaaacagcaattttcagagacatctgttcctgatcttcagaataaactcagtgtccagttgcttcggctggtgggagccaatattcacgccactgactctctcaaagggagggtgggccctcggagacccagcttctctgacaagcagattagaccaaaaggctgcctcaaagatatgccactttgaaggaaagcgtagagaagcgtttacataaaagaagacgcttcctgttcagtggacaacttcatgccactttcaaggcacaccgatggccaggtgggacatttgtactgtagcagcacatggcaaaggtgagccagaagcagcctggatgctggctgatccggaggcctttgtgaagagcaaggagagggctccagcccacctccccgcagctctgccccagcccccgtgggccacagggaggctcaaggggagtgaactaggtaaacagattcctggaaactcacatctggatgcagctggaagagttaaatatttacattggtggcttccctggaccaccgcgaacacaaacatccacaccacagggctgagttttgtgcaaatgatggggctttgcattttttattaacattttcctctcacgtggtttacatcaatttataataatctacataagttgaaacagaacatagacaaaaaaatatatccttaccaacttattaaagtcagatattcatgaagggtcccatcctacctgtgtatcagcagaaactggcagccatcagccattgcccagcaagaacaggcagacctggcgtttcttagcctgactcctgctgggcacagcccaccctgctgggcacagtgactggaggttccaggctgcacagtccctggctcctgactcctgccgggcgcagtgactggaggtttcgggctgcatggtccccggctcacaggagaccctgctgggtgtttccttggtgcagtttagtccaggtctggcacctgaccctccccactctgggggtgggatttataaatatgagcctttgcatttctcagcctttgcagccttcccatagcctgttctcacgttgcctcagcgagcttggggctgtggggctccctgaggctgagacgcgaaggtgcccagtctgggccgtgactcactctgccccttcctgtccatcactttggaagcaagcaggagccttctgtgccacacaccgacactcggatgccaggcagggaccttaggaagggccaggcactgcatctttagactcaagttcaccgcctttcccagggagcaagggctccttgctaagctgctcacaggcagccgatggtcagtacttccttcctcttgggcatgtctttcctccgtgcacagagtatttactgttctgcccaaggccacaggagtaaacaggctcaaaaagggcctctcaccgcgcacgcgctgcagcgttagggccggcaaacccttctttaagactcagccctgagcacaagcaatgggaactgagctccccagccctgagggcccggaaacgacgctctgccacacagaagagccggggagctgtaactggctataagtcgagcccctggagctgcatctgctctcctaggctgatggcccgaggctggcagccgcagctcgtgtgggaagtgtacggtgggaacacacctcactccttcctagtaccgggcaatgcgtctgcaagtcgggtccctgctccctggcgggtgcctacagcaccaacaaggaggccccagcagaacccagcccctagaggcggctgtctgattccccactctccccacaacttctggagttcccagtgtttacccaaaaggctgtatccagaagctggggcggcaccacaatggctggccaccgtgggcctgtgcctttgcttcccaggtcctggaggaccgtggcagtgcttggctgtggagtgtgtgtaaaatctaaggcaagagtaccacgaggtcctgcggtgccagggagctcctggctgcagcctacctgcctggacacctgcttcggccacatcagtcaccctccaggaagcctggcccctcttgaaaagcccccacaacttgctcctaagagctgagctgcctccccgcgacccgggacacccagcgtggcatgtgcattcctcccccgttcagcctgtggtgtttcctcagcagcctgaccgcctcctcccccattctctcctgaccctctggctatctcgatagcaggtcacctgtgagtctttacactcaaaggaaatagaacagcagggaagggaactgaaaagcagtagaagaaacagtcagagatgcctcactgatagacaggaggccgaacaggtaaaccccagaagtggagattcccaaacggaaaattccagaaatgggcgctccagctctgtgctaagctggggacgagtgtgagtgtgtctgcttgtccaacatttgcacaggcagcaaggcaaagcaggtgtgctcccaaaggcggagtctgaggaggggccggcagcggcaaacggcagcatcaaacagaccactgctgccgcggcaacccagggcctcttcagagctttcaaggcgatggagcgaagaccaagggtgcacatgcatgcaggcaggctgggaaggaagagcgggtggaggaagactgaggggaggctgccaggagaccgccatctgggagcagggccaagagagaagctggcagcagttacacagcgcaaaataaaaggccttgggctggactcaggcggaaagaaagtgctggaggaaatgaaagaacaaagcgggctgtctgtgtgcccacgccgggccggtcactaccttttctgcctgacaagtgtacataaaacaattcccgaacagcacggagcatcagacacaactagaggtatggagggcaggaggtgggatgcggtggtgaggctggggctgggcagccggctttgtacaaggtggcacaaaagacgtacgcattccagttcttggaagctggcttccctcgagtctggagtgctgggtttgggagttttctattgcagtctttcaagtctgagttggaccccaggctggaggggctggttccaccacccgcccgcagccaccctgcctcgggctacacgtcggtggagaagtacagtgtgttccgcttgagttctgcgaaggaaatgggggggtgctgcaggtagtagaggaggacctggacctgtggggagacaggaaggcggaggctgggctccctgtcctaggcctcgtccttgctgactccagcctgtgttgcccctcccactccctagactggctccggccaccgccccttcctggggagcccaggtgtgtttgcctttctgcagccgtggaaggtgctacggggcagagggtcgggggcctagggccacttccccaacctggccataagcttctgctctgtcctgaggcggccacagtccggcccctgctctgggtcttgcaggaatcccagggaagcctcccgcccttggaagcaacctcagagcttccacccatgaggacaagggcccagcatctccccacccctgggcttgctttctgagactgaggccctcctgagaatgcagccagcatctctgggccctggtctaggctcacatgtttgttttggcctgggaggggcagaagtgtctacagtcctgcctccctggtgacaccccatagcccatcaacccagcttcccacgagggaagaggtgtggggactctgagctgttctctctcctcctaaggggctggtctcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctacgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccgtcaccctccgccagccacgggcccgggcggtgccagggtacctgcgccatgacgtcatgggaccagatgtccgcagccgaggtgaggtgtgctttgctctccacttctgagggtctcagtaacgtgggtccaaacacggtagccaggttgtgaagtgacattttgttgatgggctccttctcggcaaccctaagaaggagaagatggggaggaaagaagcccttcctcagcagccactcggagctccaggacccttggccttcgctgtgggaactcctgaaggactcctggaaggggtcacctcgtctctgtctcctaggagtggggacctcccccgggggaaggggactcatccaggagagcagggccccagccatgtgccagtgttctgtgctaacatctccagctgctgggtccccctgaactgatggtgaactgccagagccagggagcccacagatgccaactccagctcccttgcctgagagcagatactgttctgaaaactccctggaacaactcacactcgccgcagtcctttgaggtaaatatgattatcgtcacccccatcgtgtagatgaagaaaccgaagtacagaggggttaagtgacttgcccaaggtcacacagccagcaactggtagagctgggatttgaaccccggtagctgcctccaggacctaccgctctgttgctttctcatgtgctaagtggcccaaaagaagagttaaggtgggtggggcaggggagaaaggcaggcagggcctggagcccagcaggagtcactagctagacccggggctctgccagctgtgctggggcaggagcagccctacttccagatgagcccggggactgtccccccgtgcctgtccggaaaggtcggcctcgtgggacccagggcttcctcttgtgcctctccggaagggtctgcctcatgggacccagggctgcctcctatgcctctccgtctgcctcgtgggacccaggattgtcctccctctggatcctctcctgcttctcttactcaacaggccagatgctctgcgatgcttccctggggtaacagcaggagctgccatcagggctggtgtccaggcaggcccagggtcagcaaacatatcagagggcctctggttctccttcagtctcaaaaaatgtttctgggctgagacccacccaccctaagcagcgcctctcaccctcaataccatcattcccaccctccaggcaggagctgtggctgcgcctgctttggaaacaggcaaacaaacactgtgatgccaacaggcagctgtgcagcggggccagcccctcaccacacgcgcgcacacggtccagccaggggcccagatgtgggaacagactgtgcccagttcccagggtggaagccgaatgaattttcccttcccactcctccccacaaggcttgccaaatgctttcggaattggttggggctctagtcctggccaaaccagaggaaaaatgtttcatgatgggaaaaacaagacaccagccccgggcgcgtccaggtctccactggctctcccgagcctggcgtggctgagctgcagcggggggcctggccctgagctggggctgagctcagggaagaattgttccgcagagcagtctgagggggctccccggtcctggcgtgcaggtgggtttaagggacgcccagggaccacctccccacgcaagcctgaggacctctgaactttgctacaagtacaaccaactttagccactcttggttggacctgactagaaagggtggtgggaaggcaagaagggtctgaatttaggatctggaagttgagggctctaaggacaggtctgctactaacccaagcaagtctccgcctggtgtggggactcagtttccctatgtctagtgaggtgtgggccaagaccagtgggtttcaccttttttgactgtggcccacaatacaacccatgctgtaacacagtccacacgtctctatgtaactgaaaagcagcacctgcatcaaggcttacaatgtatcctcctgctgtctgtcccccactgctgtccatccccactgctgtccattcccccactgctgtccatccccactactgtccattccccactgctgtccaccccccactgctgtccaccccccactgctgtccaccccccactgcatctagaaatggctacattcgttgaatgaaccaccagtaggttgggacccactgattataaaacctgcctgtagtcctgggctctcaccctgccattctgagcattctatggtcaatatttgaggttactactggttacgggacccaaatatttctcaaaacagaaaaacatgagtgcaagaacttggaaagcaaactctcactccccacagacagcccgatggaggccagcgcccacgaggagggactgaggaggtggggttggggccactccccgttaccttttcacgaggagggactgaggaggtggggttggggcccctccccgttaccttttcatgaggagggactgaggaggtggggttggggccgctccccgttaccttttcaagtgttccagcaggaagaggaaggtgatgaggttggggtcgggcagggagcggagcaggtgcatcatgcagttttccttggcagcagggtctgacagggctgtgggagagaagggccagtgtggcgtttggctcctggggctccccgccagggcccctgtggtcgtgaggctgtgggcccctgcgggagagagcccaggcttccaggcctttggggagcagaccccacaggggagggcctggtgtctgggtgggctgtcagcagctgcttcctccaggaggccccaccacgactggtaactcagccaggaggccggctggtgggagcagacccccttcctgcagctgactgcataggccttgggtgctggggcatcccctgtctcgtaacaggacaccccctggtctgtgtggctaaggttaagccagtagggacatatcctgccagcggtggattctctttctccaccccttctgctgctggagcgtgggtgcaagcagccttccgtgggggctgaagctccagtctgccccaggagcagagaaggctgaagggattccttggggctgggtttggcccaggtgggtggaggcggaaggcctgctggccggggccctccgcagaggtgacgggacggtgtgtggtcccgctggaaggctcagcacaacccatctcgagtgccctatggcttaagccagcctcctccttggttctgggatgctggcttctggccactcacctcagggcagtcttccctggatgctcgagcttccaagcaagaggccaacgtccaaataggaagcagaaggggctgcccatggggacatcaggggcaagaggcaggcgagaaagggcccagtgtctgcaccaggtcccagcaggccacacctcaccctcggacccctcagccacaggccccagtgcactgggaaggtcagccagcaaaggaagccacagatatttctcctgctggttacttctccgggcagggagtcctggctcagtctggcccagcccagtcctaggagccctcagggcctcaccgatgccctccatgaaggctgggtagagtcggtccgtgaggagcggctcgggcagttcccggaagtacagcttgagcgtcccggcgatggcgttgatgtccatgtcactcagcatcagcaggatgtccttgttatctgc

SEQ ID NO: 10532 - DNA, 565 bp, Homo sapiens
caccatgtttgtcagactggtctcgaactcctgacctcgtgatccaccggcctcggcctcccacagtgctggatgacaggcgtgagcccccgcgcccggtccgtgcatttacagcacaagttcacgcttatctacaaagcatccacctctcaccgcaccttccgggaccacgggatttaacgcctcaccgcccgatgacagcacgaggtggaaagggcagcgacaatgctcgcgcgtcccctcccggcgatccggagcacggcagccccggagcgcgcggccactcctcgctcccctcaggagctcgtaagagccccgcgcggggccgaggcgcgagagcacgcgcaacgcttcctgggaaatgtagttgggtgtcggattagaactacaaatcccggtactcaccgcgctgcagccccgaccgtgagggcgctttctggtgaatctgaatctcgtttgtctgtgacatggggaaagctgtccaagcccaattccattttcacaagaggctttctttttggaaacatgatagcggtctcgctggtgtgcgcaccaggagcgttgc

SEQ ID NO: 10533 - DNA, 1812 bp, Homo sapiens
gtaatgacctgtttgaggccccttctgtcctacccggtttgatctcccatcacctccagatatttcaattcccaggtaaactcaaggcagttgaaattatattctggaacacagtcttctaaagttgattagaaatgttatcagagtacctaggattcagtaggaaaaggcaaggtagtggatgtaaacagaaggtggtttcttatacagaggttaatgtgagcagaacacaccaaagtaagagaaatcaacccaactactgtgagacacaaaaatctattgtttctctagaatagtgggtcaagattgcagatatggagggaaatggggacacagttgagcttatgggggcctgaatctgtcctgaatgtctaaaccacctaagttctgtataattttgtggtttggtcaagtaatgtaccatatttgctgttggttatggtcagcacctggagctgctgagaacggtttgggtgctagaaatgaacagaagcacaagtcaccatactccagtgacataactcaaggaagatttgggtaaagggaaaattcatacttccttggtctccagggacagacagtccacagactttgaggatgacatgttcgtcttttcaaatatgttttacctagatcatttccttgtgttgttggcaattctcctgttacgtatttctagatagttatttaatggcatttcttagacaatgggaagaattgtgcagagcatggcatttgcagtcagagcttggtttcaagccttgtcctgtgatgtaagagctttgagaccttggagaggtcatgtaacttctctgaatctgttttctcctctgtaaaataggaacaatatttacattgtggagctctgagaatcaaataatgtcatgcataatacattcttcaacactatactaattactaagcacctaatatattgttattttgtttgttttttaaactgcatattttgtcagtgtggcatctcttgtctgtgaaatattcctttaacacatgtggtgtattttctcacctacgtatgtttcctcttcctaagtagtttaaaacacacacacgcgcgcgcgcgcgtgtgcacatgcttattcattgactaagttatccatgaacctgtcatttctgtcttctggagcaacatggaatctcatatttctatcttaatcacatatgtttaattttgcctttgttttgtggtctgtgggtacatttgttatttttagtatcaagtcatttggctaaatcatattaaattgcaatcacctaaaatcccctggttattttgacttaaatgactgtcatctttggtttcccttacttagaacgtcacacagttaattttttttttcaacctaatggcaagtgtgtgtgtgtgttcttggagtagttctgctggctatgaagagtatgtagtaatatgctaaagcttggtaaactcttcttttgttgttttggaagatggagtgttgctctgttgcccaggctggagtgcagtgatgtgattttggctcactagagtctccaccttctgggctcaagcagtcctctcacctcagcctccctggtttgtggaaatacaggggcatgccagcatgcccggataatttttgtattttttttcttttgtagatacagagtctcactatgttgcccaggctagtctcaaactcctgagctcaagcagtcctcctgcctcagcttcctgaagtgttgggattacaggcatgagccattgcacctggccctaaattttaacagatacaaaactataagtttatacttaaaaaaaaaaaaaaaagg

SEQ ID NO: 10534 - DNA, 1809 bp, Homo sapiens
gtaatgacctgtttgaggccccttctgtcctacccggtttgatctcccatcacctccagatatttcaattcccaggtaaactcaaggcagttgaaattatattctggaacacagtcttctaaagttgattagaaatgttatcagagtacctaggattcagtaggaaaaggcaaggtagtggatgtaaacagaaggtggtttcttatacagaggttaatgtgagcagaacacaccaaagtaagagaaatcaacccaactactgtgagacacaaaaatctgttgtttctctagaatagtgggtcaagattgcagatatggagggaaatggggacacagttgagcttatgggggcctgaatctgtcctgaatgtctaaaccacctaagttctgtataattttgtggtttggtcaagtaatgtaccatatttgctgttggttatggtcagcacctggagctgctgagaacggtttgggtgctagaaatgaacagaagcacaagtcaccatactccagtgacataactcaaggaagatttgggtaaagggaaaattcatacttccttggtctccagggacagacagtccacagactttgaggatgacatgttcgtcttttcaaatatgttttacctagatcatttccttgtgttgttggcaattctcctgttacgtatttctagatagttatttaatggcatttcttagacaatgggaagaattgtgcagagcatggcatttgcagtcagagcttggtttcaagccttgtcctgtgatgtaagagctttgagaccttggagaggtcatgtaacttctctgaatctgttttctcctctgtaaaataggaacaatatttacattgtggagctctgagaatcaaataatgtcatgcataatacattcttcaacactatactaattactaagcacctaatatattgttattttgtttgttttttaaactgcatattttgtcagtgtggcatctcttgtctgtgaaatattcctttaacacatgtggtgtattttctcacctacgtatgtttcctcttcctaagtagtttaaaacacacacacgcgcgcgcgcgcgtgtgcacatgcttattcattgactaagttatccatgaacctgtcatttctgtcttctggagcaacatggaatctcatatttctatcttaatcacatatgtttaattttgcctttgttttgtggtctgtgggtacatttgttatttttagtatcaagtcatttggctaaatcatattaaattgcaatcacctaaaatcccctggttattttgacttaaatgactgtcatctttggtttcccttacttagaacgtcacacagttaattttttttttcaacctaatggcaagtgtgtgtgtgtgttcttggagtagttctgctggctatgaagagtatgtagtaatatgctaaagctttgtaaactcttcttttgttgttttggaagatggagtgttgctctgttgcccaggctggagtgcagtgatgtgattttggctcactagagtctccaccttctgggctcaagcagtcctctcacctcagcctccctggtttgtggaactacaggggcatgccagcatgcccggataatttttgtattttttttcttttgtagatacagagtctcactatgttgcccaggctagtctcaaactcctgagctcaagcagtcctcctgcctcagcttcctgaagtgttgggattacaggcatgagccattgcacctggccctaaattttaacagatacaaaactataagtttatacttaaaaaaaaaaaaaaa

SEQ ID NO: 10535 - DNA, 2235 bp, Homo sapiens
tatatatatatatatatgtacacacacaaacacgtacacaaaaaatagccgggcatggggctgcaggcctgtagtaccagttactggggaggttgagatgggaggattgattgagcctaagaagtggaggctacagtgagccaagattgcatcactgcatgccagcctgggcaacagagcaagaccctgtctcaagggaggaaaaaataaaaaaataaataaaaatttaaaaaaagaacacttgaagttactcagatcaggactcatgcagagaaaagccaacaggagcaacaccccacattaggggaggaagacacctggggattcactgacttcagttgtgtgaattttaccctatgaccttgcttgctttatgagacagcagaggtggccaaggtcaatcctactgctctgtggtgaactctgcttttctctcgttaccataggtaaagggtcatgctcctatgtaagccttcctgttccccagtcatttgtgcacggggtaggccatcatctcctgcctattcaagggaatgactagtcctgtcttctgtatcctcagtcaccaacttctcagttagtgttggaccaagcctatgttcaaaacatgactgagacagacctcaatccatagagatttatttagccaaggtccaaggacacatctaggaaaaaatacgggatcacaggagcatctgcgccttctactttttccaaagagggttttgggaacttcagtatttaaaggggaaacagcaagcaggtgaggaaaaaaagcgaggaagtgtaggcagtgacagatgctcacattcttgtgaaactctgtttaccctagtaaatctgcattttacatgtgaaaagagggagtaaaggaaatagtcaataatgcattcctctcaggataggcccacgtggatttttaatcttgtccttgccctgtgaagataagctggtaactgacattgtcagggtgagattcagcagaactcagttttaggactaacttacagaggagctgtgtatcctgaagattcagcgactggcaaggaatttccttgggagcaatgtgtgagggaggccatctgaggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagtctattttctttcacacccatcagcactgttaagtaagcaggaagacaacctgaggttgtctctttactttgagttcctacataataaattgcagcctaatttagtacataaacccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttggtcacataaaattggttaaatttaacttctctaaagttttgtattaaattgtatgtaaaacattggtagcacaatttggattcagatacccaaatattgactatgataatgtaaataatccttaagcagactgatttacaaaggcctgaacaagtttgatattctgaatattcacttcttctgatgaaaaaattgccaagaccttacaattggcaggaaaaaaaatgtgtgttggttaaataagttatgttaacaacaagaacattaccacaattagaaaactcttactatgccaggcactattataaacacacctttgtaccttttttaatcctgaaaaatttctaataaatatgcatttaatattatttgtatttaatattaagtgtatttaatattgcccctgttttgtgaattaatgcagcaataaactggcttgcaatggtgatgtattctataaggcagccattgttgtcataatgctacataacactacccgaatctcagttgcttataattcaagtacttatttttcttgtccataatctgtgaatcctgctgaaatcagctagactttgctccaggatgagggattggt

SEQ ID NO: 10536 - DNA, 1416 bp, Homo sapiens
agacggtgtgtcagaggtcaggtgaatatcgcagatgaggcaaaactttgtagcccaattcgttcaacttttgaagtgttggttgtgcgatgtgtggtcaggtgttgtcgtggagaagaattgggccccttctgttgaccaatgccagctgcaggtattgcagttttagatgcatctcatcgatctgctgaacatacatctcagatgtaatggtttcgccaggattcagaaagctgtagtggagcagaccggcagcaaaccaccaaacactgaccataactctttttgggtgcgaatttggctttcggaagtgctttggagcttctcgatccaaccactgagctggtggtcgcccgttgtcacggttgtcatataaaatccacttttcattgcacgtcaaaatccgattgagaaatgcttcatcattgttcgatagaataaaagaaaacatttcaaaatgacttttttgatttttggtcagctcatgaggcacccacttatcgagctttttcacctttccaatttgcttgaaatgccaaacaaccatagaatggtcgatgttgagttcttgggcaacttctcgcatagttgtaagaggatcagcttcaatgattgctcacaattggttattgtcaacttctgatggccgacaactgtgcttctcatcttcaaagttcccatcccctttgtaaagcttcttgaaccaccactgccctgtacattcattagcagttcctgggaaaatgcgttgttgttgttgcgaattgtctctgctgctttacgacccattttgaactcaaataagaaaatcgctcaaatttcctttttgtctggcatcatttcaaaagtgtaaaataaatgtaaaataaacagcaagtaagaagtcattagcaaaaaagaataaagtgagaaacacacattgaaatgatgtataacataaccacatttatttaagaatgtattccaatatcaaatgacaaatttcaacaatgcaaaaacctcaattgcttttgcaccaacctaatatatgtatccctcaaacaactaactatacttagcatctctcaatgtgctcactgcccatttttatatcttctttgaagaagtctctctttaaatgtgttttttaaaggaattttcttgttaatattgaattacagttataggaatttttatatcttcaagatataagtgctttattagaaatatgacttgcaagtaatttctcccagtctatagtttatgttttcatgttcttaccagtaaaatattaattctttgtcatacaaacataaacaaattttattaatctagcaagtagaagtaacttggaagtcatacttgcaatattaaggagaacttactgtttcaacctagtccttcaagaactaaaatgtaaaaaagttaaatagtaat

SEQ ID NO: 10537 - DNA, 371 bp, Homo sapiens
tgaggactgtggttctcaatgcagaaaatttgaccttggtttgtactttttattaaaatggagctttccatgttgcatgctaggcagaagttagaactataaggtcatacttcaagtagcttaatccatctaacagacctggataactcaaacagctagctaatgtttgtgtttcccagtacaacatttaacatgatactatttttcttacctatgttatttatgatatgtagtgtggtttatacttggtaagcaagtgaataaataaatgtcccagaggccaagtggagagaattattggattatattaggtcagatggggtggggaaggaaggaaggttactttgtgaacaacaagttgtcgtttctgt

SEQ ID NO: 10538 - DNA, 2056 bp, Homo sapiens
ggtgaggggaaaggtatgtgtttgcatcttctgttagcgatttctgggattctgaatcttcactgtcacttagttctgtgcagttgtgggagatatacccagaagacacaggcaaatacaacctgggtaactagctaggggtttgttcccaagtccctatcttatatgtcctggcgagctgccctaaactacgtgtgaggaataaagactgtgttctttcagctcagacctgtgattcttgagtgttttaagagtcttttaaaatctatgaaccctctttccagcaagtcgtaaatgtacagaatagttttgtgtaggttttcagggaattcatgaataccactaaagctgttccagtagactgtattgggagtcttataggataattactggcaggcttgggcaacctcttggccccattcccttagctgtgtgtcttgatgctagccctgtgaaagagtccttcactcttaagatttagagcccagatgacctttgccagccgtttaccttttttcctggggtgtcttgttgatcctgctgggtttctatgggtacaagaccctcttaaacatgaagcagctctatatttgtcgttttaaaatttattttattatttttaacaaattggccagagaccgcctttttaaaaattttctttcctttccttttcttcctttcccttctgtttccttcccttccccttttctttttcttcctttttttccttttctttcctttttcctttccttccttcctttcttgcctttcttcctttattgctttcctttcttttctttctttcacccaggctggagtgcagcacactgtaacctcaagttcctgggcttccaagtagctgggactataggcacacaccaccatggcccactaatcttttttctttttttacttttttttttttttagagacgggggtctcattatgttgcccaaggatgatctcagactcctgggctcaagcagtcttcccaccttgatctcccaaagtgctgggattatagatgtgagccaccatgcccaatctttgtttttttaattggcaagtaaaaattgtgaagacttatggtgtacaacatgctgtgttgataatgtgtatacattttgtaatggttaaatcaagctctttaacatgtgtatcacctcacatacttatttttttgtggtgagaacacttgaaatctactctcagcaattttaaagtatataatatgttgttactaactgtagtcacatcactatgatgtgcaatcgatctcttgaacttactcctatctacctgacattttgcatgctttacatctccccagtctcccaacccccagcttctgagaaccaccattctactttctgcttctatgagtccaattttgtttgctttagaggtggtacctcactctgtcacccaggctagagtgcagtggcacaatcatggctccctgcaatctctaactcctgggctcaagtgatcctcccgcctcagtctcccaagtagctgagaccataggcgtccgccaccacgcccccagctaagttttaaattttttgtagagataaggtcttatcatgttgcccaggctggcctcaacctccaaagtgctgggattgcagttgtgagccactgcactaagcctgagtcgacttttttggattccacacttaagtgagatcatgcagtatttgtctttgtatgcctggcttatttcatttaagataatattttccaggtttatctgtgttgtcttaaatgacaagatttattttgttgttgttaaggctgaatagattctgttgtatatatatgctacattatctttatctcctcatctgttgatggatacttaggttgattccctatcttggctattgtgaatagtcttgcaataatcatgagagttcagatatctcttcaacatattgacttcattttttggggatatatacctagtagttggttttatatccatctcattaataactacatgaaagacaaaaagagaaaagaagaataatccagctatctaaagtcacgaaaa

SEQ ID NO: 10539 - DNA, 2698 bp, Homo sapiens
caaatgtaaaactttttttgcagaaattatagtatatgtgtcacaaatactctagttaaaaattatttagtcttatttgtgatatgtagatttgtttattgtattagctaatatttaactggctgaattcttttgggaaagctttctaatcagttgaactttaacaatgatctcttttgtatttgatgacttcttttgttgtgtatagtctgtgttagaattgttttctatttttctgaattttctctattccattagctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggtaaggactgcgatgctccatattctcaccataaaatagtgtcaccacagagcttcagagatgtctccttgaacatgtgagctgggtctctttaatgtaacttctgactagtctccaagacccattccagttaacacttctttcagtagttttacaatactttttgctcaattatgtgaagtgtgacagattttaaattttattcagtgacatagctctgaagtctttatttcaaactttgaagcagttattaatatggaaaagtgaaattctataaaatcctgtttctctgatttttcattgatttttgctggcaggcaatagcgtgtttatcagaatgtttgttcctagaagagtactgtagttataaagttaaaggcatttactgcagtaagattttattctagctgtacgtgtactagtgatcaaagctattaaaactttgtgttagaatgtatgtcggaatatcaaagcagcagcagcagcaggaggaggcattgcagctgttttaagttttggctgaagtcagattttgaagcctgaatattttatgttaagataaaagaaaaaagaaaaaggagccaagggtgctttttcatatttgtgttttattaatatataatcagtttgtttgctattttaagactagctggggcaggtgggctggtatgtgcctggagtcccagctacttggaaagccaaagtgggaggattgattgagcccaggagttcaagttcaacgtgggcaaggtagtgagatcctgcctctagaaaacaaacaaaaagctccacagactagttggaaatgtttttttttaaaaaaaaaaacaacaaaacttttgggctaagaactatttgccaagttcttaacatgcacatcggaaatctcagacccttgtcctttctagataactttaaatgaaggctctagatgttaagtggtttatatgcttcactgtctctaagaaaaataactatagtccagtatccttttcttgttttaggcatctgtcatcagttctggggaataagtttgaccatggagctgaagccattatgccaactatctttaatttaattccaaacagtgccaaaattatggccacatctggtgttgtagctgttaggttaattattcgggtaagtatgttataggccatgcttgaaataagcaagtggtaaatactgatggttgataaatattagaggcatttttgttaacataattatattgagtcattaaatttattagcataattatattggaattttgtatatatatcatcttttccccctacttaattgtggcatgtgagctttttataatccataatgtgaattatggttgtgttataaagttaatgaggtattgattgttaactcactattggtttaaaatgttcgaacatccggtgtctgcttctgagtttatattgtattcttgttactcggatattactcttagtcttacctccttagtcccagtccttccgttttaggtattggtgcttgtggttttactgttcacccaaaagtttaattaattgcacataagcacgaaacaaaatgttctctttggttaggttttctaggcacttgtttgtttaaatttaaataattatccaagtaatttatacacaggtttttaacaaaatctaatagttcacaaaggtttaaaatggttttccacattacctccccaccactttcaagtcatttttgcccagaggcagctcttgaaactttgaggcttgatgatgttgtctaaaatctatccagaatattcttgattattggttatttactttgtattataagttcttactgttcttacttgcactgcctgctttaactgttaaacccaaggtcattattggacatttctattgaaatagtatcaaaatatattggtctgatgactcctttcaaacccactccttttaaacccactcagatgtctacagctgagataatttagacctcatactaatgattgttttaggcttatcttcatgtcatcatgttgcctgttcttaactctgtaaattttctaatggcttttgacaatatcctgtgaattctttttttcttttaaaactcactgacattctaatctgaatatatatgtgctataagtaggttagtaaggaagtgattctcttaattttgttttgtttttgtatttgcaagtgttgacctctgttttttgttgttcttcacagcacacacacatccctaggttaatacctgtcataacaagcaactgtacctctaagtctgtcgcagttagaagg

SEQ ID NO: 10540 - DNA, 2056 bp, Homo sapiens; identical to SEQ ID NO: 10538

SEQ ID NO: 10541 - DNA, 2698 bp, Homo sapiens; identical to SEQ ID NO: 10539

SEQ ID NO: 10542 - DNA, 18733 bp, Homo sapiens
caggaactggcgctgaagaccctggggacagatggcctttttctcttttcctccttggacactgacggggatatgtacatcagccctgaggagttcaaacccattgctgagaagctaacaggtaccaggagagactggcggctggggaggagggcgccttggccaacggtgtcttcactgagcaggagcggccgtctggagtggagggaagctcgtgggatctcagaggccctggactcctcccagctctgacactttgtagctggtggcttgggcgagctgctccagcaacccctgagcctgtttttctcagacttgtgagcaataataccagctaacattctttggtctgcgaggtagctcacgcctgtaatcccaacactttgggagatggaaggatcgcttgagcccaggagttcaagaccagcctggtcaacatggcaaaaccccatccctacaaaaatacaaaaattagccgggtgtggtggtgcacacctgtagtcccagctacttgggaggctgaggtgggaggatcactagaggccatgaggcagaggttgcagtgagttgacatcacaccactgcactccagcctgggcgacagagtgagaccctgtctcaaaacaaacaaacaaagcaaaaccaaaaaaacaaaaaaaccattccttggccacctcctccgtgccaggtatttaagtatttcatgtgggttctctctttaaacctcacagtagccctgggagatggacactgtcatgatccccatgtttaatagtctgagagactaaggcacaggcaggctccccagtttcccaagctagaaaggtgcggagccagggctagaactggggccatctggcttcagggtcctgcaccagctcacaggtttcagtagagaaaagaaatgcacagtgacgaatatgcagtagatttccaatagacagcagctataactttttttttttttttgagacagggtcttgttctgtcacccagactggagtgcagtggtgcagtcacagctcactgcagcctcaacttccctggctcaattgatcctcctgcctcagcctcctgagtaagtgggaccacaggcatgtgctaccacgcccagctgatttttctatttttgtagagatgcagtctcactacgttgcctaggctggtctcaaattcctgggctcaaacgatcctcttaccttggcctcccaaagtgctggaattacaggtgtgaaccaccgcacccagccaggagctataactatcattactaaatctgaaactttgcttaggtgctttcagatttctattccattctttgttgttgttgttgttgagatggagtcttcctctgtcacctagactggagtgcagtgacataatctcagctcactgcagcttctgcctccctggttcaagcaattcccctgcctcagccttcccaggagctgggattacaggcacctaccaccatgccgggctgattttgtatttttagtagagacggggttttgccttgttagctaggctggtctcgaactcctgacctcaagagatctgcccgcctcagcctcccaaagtgctgggattacaggcgtgagccactgtgcccggcctcctattccattcttgctatcatttttgcctagtgcagtcagtgattatttatttatttatttggttaaagatgaggggctgaaacattctaatgaattataaaacgcttctctcgctgccccaccaccaccctaacctctgtgcccattttcttccaacttcttgtgacgtttcttgaacttaggatcttggacacctacttattacccagattgcctggtgtaagtcagtcattgatgggaaaggcaagagagacatgctggctgtttcgggtgcataagcttcaaagcgctgtcactagcctgctgtttttcaggggtgtattgtgtaggttggttccgtgctggcccggtgacctgtgatcactgctagaggaggaaggttggatgaaaaatgctaatgagctggagtggatgtgtatcaatgtctctcagtggcaggcagttctgtcatgaaagcagatgggcagataaacaggtcgtccccttgtggccttgcctgtacttcttgttttgcatacacttctgcgcatttgcacagctacctctttgtccttttttgtggccagagtgagagttctctcataatgacatgttagcaaagcttgaggtgcacttttaattttttgcacagaaatctttttctccatcagggtaaaagaattcccccattacctctaggctgtgaatgcaaaaatggaccaagtattgagaaatcaaagggcagggggaatcaaatccaagcaggaaatagagccaactagttctatttggtagagttatgagagtgtttaattttctgccttatcccttaaaatttttacaaattacctataatgggcaaatgttactcataagtcaggaaataaaactttttattaaaaagccaaagggctgtaaaatgctgagtagtagtattataattaataacattattaccaactccatttgacaaatgagaaagcaaaggctcagagaggtgaagtcccttccccagatcatacagctaggtggtgggggcatcatcattattattggtttttgttttttttgtttttttgtttttttttttgagatggagtcttgctctgtcacccaggctggagtgctcggctcactgcaacctctgcctcccaggttcaagcaattctcctgtctcagcctccagagtagctgggctgggattacaggggtgcaccaccatgcccagctaattttggcatttttagtagagacggggtttcatcatgttggccaagctggtctcaaactcctaacctcaggtgatccgcctgcttcggcttcccaaagtgctgggattacaggcatgagctgccttgggaatcattattattaatatttatctgtgatatcagtaaaataattgaataagcaaggcttactaataaccctgcatattcctgttgctcccttcttcttgggtttctagattgcgttttggaaagttttacctcattgacttacaaatacagaaataagtgattcttcagaatagggatttggatcaggagcagcagggagtgctcattaaaagggcagattccagactctcacccctgcagattctcattcagtaggtctgaggtgggttgtgagcatctgtagtttaaaggcatcctgggtgattttgaggacttctggttgagaactgctttaatgcatcattcagcctgctagccagtcagtcagcaaatgccaggcatcatctctgtaccactaccctgccctgagagggcagacagggcaagacccacccccgccctccgctggctacactttgttactggtgactattactcaccccttttgaaataggcgtcatttgtcccttagcctttcaaaatgaatccttctatactgggaaggttatagacttgccagatctctgagcaggaaaagatccaagaaatcaaatccagccacactgccagtccagcccctcctacagctggggcaatgccccccccgcccccccccccccgccgcaaaaaaaaaaaaagcaggggaaagtgggtctcctcactctcaaaccagtgctctccctatgacaccaaagagcctgtttctgtttcttgcttcattcattactccggttcccttgactgagttcctctcagtcccagaagacctagaaaagggtcgtggttggtcatgggtttcgagtaaacaggcctgggtttcaatcccgattcccccaccatctagctatgtgacctggggaagtgactttacctctctgaacactttctcatttgtcaaatggagttggtaatgttattatctgcctccctgggctatcctgaaactaaaatgcgatacactggttgttactttggtgactgttaacaccccagctacccccaccccctgcctggctccgttaatcaccagctagtgtggatgatgagggagaggtgagccctgtagcataagggcagtgcctctccgatgtctgtgtctcatagggtcaactcccgcggccagctgcgaggaggaggagttgccccctgaccctagcgaggagacgctcaccatagaagcccgattccagcctctgctcccggagaccatgaccaagagcaaagatggcttcctaggggtgagttggggaccacaggcagtggggtcatctgtgtgtatcccgaagatgagtttctgctccattcatccatctttcctctgccctctgtgtgcccactagagccaggccctggaggtccatgtgcggtgatgttgtccctgctgtccaggcatacagcctgctgggggagcaggagagagaagcattagcttctgccccagactggggaatctgggatagcttcctagaggaagtgacatctggtagactgcaggatgaggagggctcagcagggtgactgagcacaggttgggggggtctcggaggaagcagcagtgcagtagagaccctgttagtgcagccgccccacatactatgatgattatttcccacacactatgatgattacttcccacacatccatctcttccccacggggcatagcatgatgcctggctcctgataggtactctgttgaactctgatgatctagacctgaggtttggtccccagcagagggctgtggggtggggagggcacctgagaaggtggaggtaggaggtggacagatgctctccttgccagcccctccccaacccaaggccctttggacagggtcctgagcgcattgcaggatgaagctgcctcagcccctgcctgcccttttgcactctctcccactctctcctcccctctgtgggcttcctctgttccaaccacaccagacttccttccttccaaatccccaggctttcttccaactgggagccttctcacatgtggttccctctgccaggaacactgcctctctgtgcccagcccacacagcccgacccagccttttcatctcagccaatgccacttcagcacgaacagaggcctgaaggcaggagtgccaggctggtcactgaggccaggcagtgggtgtgtctgggcccagggggcatgcaggacccacacaggggcatcccaatcagtggggccaggagagaaggtgccagaccccaccaagggctttgttgcctgcctttggccttcattctatggtggctgaatatcgtgcagattttaaataagacagctttctcatcagacctgggctctccaggccagggacggggcatgtgtagaatggggagaagtgggaggcaagaagaccagttctggaggggagacggaggagatggagagtaagggcagcctggaggatgctggggaaggaagggcagggagcggctcctcatggacagtgggtgggcaggagttggatgactcaggcttctggctgtgaccaggggcatggtgggctgcttgcccagatggggactgtaggcggggagggagtaggggatagagaatgaggtcagtctgcacatgttgaagttgaggtccccaggggatgttggatgtctgctgcccagcagcagccccttggcagtgcccaactctagagcctggcagccacatggcaaaagaaacttgggaatgaccttgaggctggcacctgtggcggaattgccacctggcccagcccagggaagcagtgctggggagcccctttcttttttttttttttttttttgggacggagtctcgctctgtcgcccaggctggagtgcagtggcgcgatctctgctcactgcaagctccgcctcccgggttcaagctattctcctgcttcagcctcccgagtagctgggactacaggtgcccaccaccacacccggctaatttctttgtatttttagtagagacggggtttcaccatgttgaccaggatggtttcaatctcctgacctcgtgatccacctgcctcggcctcccgaattataggcgtacagggattatagggattacaggtgtgagccaccatgcccggccgggagcccctttcttaacctcatcgctgcaggttcagggagggacagaaattccaaggaggagctcacagggaagggcattgcccgttttgggtcctgtttacttgccgtctcccactataagctccaagaagacagggtgcacagtgtaccctgatagaaacttcctatacagtaggtgcataaaacattttgtggaatgaacaaatgaataaacgtgttcttctcagccaaggagacagtgcagcagataggcaggagtccaggaagtggtcaaaaccggtctgaccttccacaaaaggagatggggaacccatctccatggatttggcagtgatgggctggtctgagcagataagtccgcacagacaacaagaactggggtgaggcaggagcagcacccctagccctggcccccgagcagagccccagcaagcccagcacccatcgctggcaggtcccctgcagggggtggcaagcctacaagcaggacccaggaaggcgggctcggcctggcccggcacagccagctctgccttgagaaccgcctgttaaatctgtctctgtgggagctccctgcctgctttcctcctacctcccaccaagcctgagctcctgctgccagggaggtggcgacagaagagggaatctgctgttccccaaatgctggccgacgtgtagacagctctgtggtctctgagcgtcctctccgagccatcagcttgtcagacagaggcgaggcaggtcaccgatgaggactcgggcttagggaaggccttttgcccagggtggggcaggctgtacttaaggcagggcccttctgggggtggccttccttccccttccctgtggtctcatcctgctcttgaccctagagatttcacctcaaacatgattggccaccaccctcatcggacttagctccaaaccgaaaccctgagctggccagtgggacattagtccctgggaggagacttggagaggagactggggagggagagtagggctgctggagggccagggaagccaggcagggtggtggcacccaaggctggcccatgggcttatgcataggatggaggtgggactatgtgaggcacagagccccaccatccccattccaaccttgccctcgagcgagctgctctggcctgggctgcgcctgggtgggctgtgcctgggtgggctgtgcctgggtgggctgtgcctgggtgggctgtgcctgggtgggctgcagaggcactgcagcagggagaggagcctctctctggcgggatattgctaagcttgtggccatcataagggcaggaacctccctggggtccatctgctcccttggtgtgggctggctcggggcttgagggagacctccacccacatggtacaggagaccccggagtcaggttctcagattcctggagctttgctttcccccgccccaggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtgaggacagctggggtgcgacgtggggcccctccgcccgagcccaggagtggccacccctctgtctgcgcctggaccccagtgccaggcctgctccacctgctctcctgccttcctctggacctgccccctccccatggggcccctgggccgtcgggtctgggctgacccccaccccagcggatccaggcccagcgggacccagcaagccagtacgtgcctcccgccgcccccaggtcatcatccaccggctcctgagcatgttccaccctcggccctttgtgaagacccgctttgcccctcagggagctgtggcctgcctgactgccatcagcgacttctactacactgtgatgttccggtgagtgggccacactggctggcctggagcaccggggaggcatgacggtacagcgcccagaggggagggcccagcttgagccccccagctccacctctcctcccactgccgtcttgggcaagcagctttggctctctgagcctcagttttctcacctgtggatccgggtgctgatgacttcctcgtaaggcacgtgagggttcagaaagaaaagttgtggaacttgcttggcacggggctggtagccatggttgtgccatccacacagaagtgggaaggacacccagtcacacatgccctccagaagctgtgaaggctgggggagggggtccaggcagggcttccagaggaggggcatgtgacccgggcctcgaaggatgagcagcatttggagagcctcgctgctgcccactggcccatccacctccacccccacactcagcctcctctccctgatgattctggccaaggcttcccgggctcctggggagaaggtgggcagctctggtgcagcagatccccttccccacaggatccatgccgagttccagctcagtgagccgcccgacttccccttttggttctcccctgctcagttcaccggccacatcatcctctccaaagacgccacccacgtccgcgacttccggctcttcgtgcccaaccacaggtgggagcttgaccctggcccagccttggctccctcctacagcttgtcctgctccccagctccaggagcctaggggcctcttctgtctctgccccttcctttgctccccagagcccatctcatggggctgacgtggcaggaggcggcatgaggcaggcaagagaatgagctgatcacccaccagctcttcccaggcacccgtggcctggccctccacctctgtgcctgggacccagtgcagcagtccgcagacccttcctgaagctgggcctccccgccctcatactgctgacaggccccaggcagagctgtaaccgcagcctgtgcacgccaccaagaggaaggccagcagctaggcagggacccagctgtggggtccaggaaggcttcccagaagaaaaaggtcatctcagcagagatcagggctctgagggttttgctgggcagaggaacagcacatccaaaggccaagggcaggccctccactgctgcagagccccagaggggcttccgggacggtgctacaccagccacctgcttgcctcacctcctcagggctggccacctgtcagcagagtagaggaccccggaggccctggcttcaagtttgtccagattcctaactgatagcaagtggccaccgagtgggcctgagtgaccgctctacagggatgagacctggctgggagccaggaggtctgcagttaagtctctgctgtggaacccattggctgtgtggctgtgggcaaggccctggccctctgtaggcctgtttcctcatctgccggatgggagactgactcctggcctacttcacccacagggcaggcgtgagaggatggtcgggataacatgggaagagaaaattgcccctaggagtgggggtggcttccctccctccccagagtgggaagggcaggggcttcccggtcaaagggaaaaggaagaggagggcacaagccctccatctgctcacctagggctgggcacacctgcctccatcgcagggttgttgaggagggggcctggactgtatgggacaggaggagagaggcagtggccagctccaggaccagctgttcctgggctcatgtctgaggaccaggcaccagggactgctgacccccgggggttacctagctctgccctctgtgccccctgctgcggaggtggtggtttgccagtgctggggctccctcgtgcggcggatctgcagattgcactgctcggctcagatttcctgctgcccgccagaggcctgtgcagggaccacggtgctcgttttcattcctgccccaccctgtgacccgccttgaggcactggccatctctctgcttcaaagggtcctggagagtacacgggccatggctgtgcaggccctttgtgaattgcgaggggcagggctggcggatggtgaagtggctccagtgccttaggaaggggcagcctggtggggaagagggccagggctctgcagccagaatcccagtggctctgagagcaggtgttcaccttgagaaacctcagtgtcctcatctggaaagtggagacagttgcaggtattatgtgagataaagtgtgacacagataatgggctttgatgatggtgtcactctgccctggccatcccaggtctctgaatgtggacatggagtggctttacggggccagtgaaagcagcaacatggaggtggacatcggctacataccccaggtgagcgcacaggaggctcccatccaggtgggctcggctgcagggccccgccctccctctgcaatgagtggagcattttggagggtctctaggggagcccctgaggattcttgcccatctctgagccttccccctaccactgacctctggcccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtgaggctgggcaggggtgaaggccagggtcaggctgcatgggcagaggctgggagctgtggagcagcagctgggcacagacgctggtatgtgtgcagggcttgctactgaggctgtctcactgttgggcccagctgtgccagcggggcctccccgctgccattcagaacttggaggaagaggccaggtgcaatggctcatgcctataatccaaaactttgggaggctgaggcagagaatcacttgtggccaggagttcaagagcaatctgggcaacatagcgagaccccatatctacaaaagaatttttttaattacctgggggtggtggtagcacgcacctgtagtaccaaagctttggggaggctgaggcaggaggactgtttgagcccaggagttcaaggctgcaatgagctatgattgcgccactgcactccagcctgggcaacagagtgagactccatctcaaaataaaaaataaatgaaaataataataataaatagaacttggaggagacatccatcccctggcttagtagcacccacttcacacacatacaaacacacacactaacatatatatacacacacacatacacacatatacaaacatacacaaacatatatacacatacaaatgtacatatacacagacatacacacaaatatatatgcctacacacaaacacacacacacacacacacacacacacacacacacacacacttgcacacactacagactcagcccgagtgggaccctggccgctttgatgatggcttcgctctgtctcggtgtggccccaggtctcctacttgccgttcactgaggccttcgaccgagccaaggctgagaacaagctggtgcactcaatcctgctgtggggggccctggatgaccagtcctgctgaggtgaggggcccggctggatctaaggggagcagtgggaaagtccacaccttgtggggtaccagaggctctgagaccaatgggactcttctgttgagttgtgagggcctcagggactgcccatggtaggggcgtggggtgagggcttgggggtttctgtgctgagcccagagggagctaccagatgctgaagaaagggccctggcagactgggttcaaactcagccattgtcagcttggtaaccttgaccaagtgtcttcccctctgtgagcctcagttttctcaatagtaagaggggataacacacttacctctcatagctgtggacatggaggtgaaagtgccgcatacactgtaaagtgttatatacgtgtaagagaaaaaatcgggccagaggctgggcttgtgttaattgattcaggaaattcaccagaggccccctagatgcaacgtcctttgggtgtctggcagtgggcacaaagatgaacaaaacagtgccccaccctcaccccgtcaaccgtcagtgcagcagtgggctgggtgcttgcgtcccacagtgaggaaggcagaaggggtccctgccctcaaagggggagacacagtgcaaaggcagacaccaaatgagtcagtacaagcacggtgagtgttctacaggggacagtccagagtggcaccagagtgtataactgggggtcagggaaggctttgtgaagacagtgatatttacgctgagactttgaaggatgagtaggagtttctcaagtgaccggatggagtgttccaggtagaggaacagcctgtgtgaaggccctgggacacagagcgttcattggatttaagaagctgtcactgtctgcaagtccccagggccaggtagaacccctaaccctaatctcagcccaggatgctggtatattattgatgttaattccaactatcatttattcagcacctactctacctcaggctctttgaatctgttatttcacttgggtgcagagactgtcctgcagcccgtgaggtctccccaaagcaagattgcaccccagcaagatgtgggggcgcctcacccttctgtcttcctgaacaggttcagggcggactctccgggagactgtcctggaaagttcgcccatcctcaccctgctcaacgagagcttcatcagcacctggtccctggtgaaggagctggaggaactgcaggtgagcgggcaggtggcaggaacaggagcgtccggaacagtggtgggggccgcggcatcaggagtgtgcaactgtccccacagaacaaccaggagaactcgtcccaccagaagctggctggcctgcacctggagaagtacagcttccccgtggagatgatgatctgcctgcccaatggcaccgtggtaggcacccccactcagaccccacagggcccaggcacctcggggccccgggagcaaccagcaggaggcgtggatgtgcagacttcatcaggcttcgggactgtccctgccacttcctggctgcaaagcctcaagctggtctcttacccagtctaagcctccgttgtccccgtgtagaaacaggaatcgtgatgcaggtgttggtcatcgggggctgcgcagcagtgagcatagtcctgaggcagagtcagcgcctccctagaaacacagcctggaagggaaggctcaccttggaccatggcggccagtcctgggatggaaggggagggaggagccaggccttgtgacagagaccaggagagggccctgagccaagattcaagaccccacctctccctaagggccccttacctagcactcagcaagtcttctcactggggcctcacagcagctttgggagatggatggtcatgaatacccattttataaacaaggaggcccagaaagttgagagactggacaaatgttgcagtcaattaagtgcagctggctttgaaccgaggcctgcccttgagcctcagatctccagctcttctgatcaaagcgacccctcatcctttaagtcccaaggcatggttagtgtgggacccagggctgtaggagggggccggcttcctcaggatcttaggatgggagcagttcaggagcaggggctgtcacgggagaggtgtccagtgagggtttggtgtaaaggaaagggcaccaggcggaaggcatctgctgtcccaggcgcaagggtgatgagatggtgtcggggaactggatgaggctgggcctggttgggagaaccaggcctcccattcatatgaatgttgattgaatgctgattcattcatttgttcatctactgggcacctactgtgtgccaggcacaaagataaagacacagccccgtgctgaaggagctcagtctctggagcgagaggccaaaggagaggcccattgaatgtgaggctgcagtgagagaagggagcacggagttcaggatgggagtccggggtcacaggaacagaggagaggggtcatttcggggggcgggggcagagggctagtagaagaggtgatgttggaaggtgttgggttttcacttggtaggcaaggcagggaggagccccctcgtcagacacagggtgatgagatggtgtcgggtgctggcgagggcttacggcagcactgcctgcccaccatccacctcagacaaggacagtcaaggcctgatagcatccctgcttctccccatagaagagagggcacagggagcctgggggcccccctccgccccacttgcctcacccggcccttctcccaggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaactagagtggttctaagtgcttttcctttgagtggcatgttgctcagctccgtccttccatggggtggctccctcttggggcagagttgagctggaatgctttcaggtactatcttacctatcgaaggcttgagtgacttgcccaaaataagttttacgatagaacaagtggtaggacttactgttttgagaatctggtgctctctgttgagagagatctgggagttaaaatcattgtcttaaaagcagagcctgagacaggcatgaagtgtttttttgtttgtttgttttgtttgtttggtggggctgggggggagtgtacttccagaaaaaccagtaaaagaaggaaggaagcagaagagggaaaggaaaaatgctgagcaggaacagtctcagcccagccttggcctgacccacagtggaagagctgtggggcataaaccacactgcagagctgaactggccttttggaccttttatcagtcattggcttgggaggtgaaggaaattcccaggtagggagctccgttcttcctgcaaggggatctgagtgggacaccaaatcagcatctacacccaggacagacagccagcgtggacttgcatgatccgccatcgcacaggagggaaaggtaatgattaaaacacaatgtgccatcctgggaagagggccagacctggaagtcaatcttcagcgtttgagatatggtggagatcagggtggacgacctctgaggtctctagccaggaccagtcacataatttgcacagccccgtgcaaaatgaaaacacaagaacccctattagaaaatcatttcaagacggcaacagcaaagtactaaaccaagtacaggattctgagcatgcggcccgttgtgactgcatgggctgttcacccatgaaaccagctctgtctctggcagaggggactgcaggctttggaaccaaggaactccagcctgggagccaggcacagcccgaggctgtgctgaaggcagagaaggaaatgtgacccaggaactgcatgccacagaccaagacagtgagggctggagcacaaagagggagtgggttagtgagcctggaaggaatgtggctcttcccacagagcctctggagtcttgtacatcaagtacccatctaataagcaaactcattgaatataccgtgtgtgtgtgtgtgtgtgtgtgtgtgtgtgtgtgtgtgtgtgagagagagagagagaggctaaaatagaagaaagctgcaaagtgctggagggcaggagtcaagaggagaaagaggcccattctgcgcattcttgctggagagaggctttgcaaagggacctgcctgggaaccaagaactgggaagggggccagggtgaggattctgaagtttgccctaggggtaggagcatattttaggggtcgagcgacacacccctgggcttccagaagtcggatggggctaaacgtggagagcaacaagcagggagacgcgacgaataccaggccgagggatctccaaacgcagccaactcctcccggggacacagaccccgcgggggca

SEQ ID NO: 10543 - DNA, 12988 bp, Homo sapiens
gggcggttgaggctgggcggcccaaggtggaaggaggggccgtgaggtgagagagtccgggagcccgagcttgaggtgagaaaggttctagggaggcgcggaggcgggagcgcgaccttccagcccgttagtagactgggtctacgtgccgggcgctgtgcggagcccgcagctcctgttcccgcgcgagttctcgcgggagccgcagctgtccgtctcacttggcccgggggaaactgagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcgggtccgggtcctgtgggtccaagggccgctgggcaggcggcgagcacttggccgaccttggcccaggtcgggtcgtctgccgcgggggaggggcgactcgccctggcgggtccccgcggggagagggtccgcgcgggtctccggccactgctgcgcgcggcaaagtttcactgagcgcggcggcctccgtgggggcccccgggaccaggggtgctgagcagggccctgcgctggaggagctcccgttctcctgaggggacgcctgtcagcagacagcaactgcagcctccggagggctgcggggcgcagaggtgacaagacccaccggtgctgccggcgaaccgggggaagatcttctagccagtgacacttgggggcgggggtgacagctgagttggtgttccccttcattcgtttagttcagcgcgttgaagcgctcactgtgtcctaggcagacaccgtgctgtgcgcggggatcacagttatctagttcctctcgcgaggactccgagggacaggcagggtgctgcggagcgcacaggaaaggacctgaccctgtcgcagggaaggaaggtgatgcttaagctgagctctgaggaatgatgaagaatgagctcggcgaagggggtgctggtgtttgatgcagggctcagaggtgggcccagtgttgggggttgagggccagtgtggctggagggcaagggggagagcaggagggctggctgcgaagcgtgcaggccttggtgctcagtgaatgtggtctagagacggcagagaaagatgggtttgggactgattgtggattttatcctgtgttggctctagtaagccagttttaaacggatgagcgatgtgattaactgtgtttgggaaggattcctctggctgtgtgtgagggttaggcccggctgggtctttggaggtaaggtcggagaggaagtggcagtaagcaccgttagtgcaatttgtggccgacacggacattcagcacagagcctggcacacagagggactctgataataaaggcttgaactgagccgagaagatggagcccacgcaggaggtggcaggacctggaccaggctttgggtgctttgcactggcatgaccactgagtgaccttagacaagtgccttcccctgtccaacttcctttccccatgtgtatcgtgaagtgaatgacacctcgtctcccaagggtagaagaggggaccctccacaggaggtctccagaaagagctgctttgtcagtctagtctatctcccattcagagcctgtccagggctccccagtgacccggacctcatgacttgccccctacttttgtagctttatcatgctctgctcctctttccatgtccttcaccttcttgtgctggacctgtgctcttgctgttttgtcttcatttcctactccctcgcaacttactacagggcactagggccagagctctgacctcatctggccacctgcctaatgctactcagcctttgctagaagtatgtattcatgtcctatcactctgctggacagcgagttccttgagagcatgactgtgtcttactccttccatagcccctacggtgcccagcacaaggcctggcacaagtgggtactgttggtgtttgatgaacaagtgaatgaacgagcacactgattgcatctgctcaccatgcaaggactgctgtgaagagcagtcagatgtcacctcacccatctgtgtcatgttttaacagttcattaagcactcaaccccatttcactcattgacccttaaggtagcctccagtggcagcttttcctgtctcctttttccagatggaaaaaccaacattcagaaaagttaaataacttgcctgtagctacaaagccagaaggtggctgagccaggataaacttttttggctctttttctctgtagctcatgagactgagattggcatgagctggtgttcgttctcctattttctctgatctctccctttgcaagggcccagcagtgcttttacatctcatcttcaagaatgaatcctgggcttggatagtacttataatttggctagatgagctttgtagctaccaaggattctatttgcatctttagaagttttgcctcaagaaacctgagagcccaggaaggctcttgggttggccaagctcactaggcaaatcttttttttttttttttttttttgagacggagtctcgctctgtcacccaggttggagtgcagtggcgtgatctcggctcactgcaagctctgcctcctgggttcacgccattctcctgcctcagcctcccaagtagctggtactacaggtgcccgccaccacacctggctaattttttgtatttttagtagagacagggcttcactgtgttagccaggatggtctcgctctcctgacctcgtgatccgcccacctcggcctcccaaagtgctgggattacagatgtgagccactgcgcctggccgcagatctttaacagaacctttaagagtctggacttagagctaagtgttgggtgagggcagcctcttgggctggttttctcccctgtgaagtcatggctctgcagggcctggttttttggggcttgtgtggtgaccattaaatccccactgtggggggttgtttcacaagagggaaatctggtgctcctccagatggcctgatatgaaggagtcacgcctcccgcctcccggagctgcccagtggctgccttgtccttcaagtgcaggagctggttcaaatgtcaggaatggaagccactgtggtaaggggcattcccagggcaggggtatggtggggaaggttgggtgctgggcctgctgaagtactgtaaaaggttctgagactctccagttgagcactcctttctccagaggcctggaattggagcaaggccaccgtttcactccctccccctaagaagaaccaactatgatcctggggcacttcaggagtcagtgtatgtctgcctttctgtacagaggacgggaaggaaagcctggataatctctacactcagctacttcctctccccttccctgaccctcccaacattgactgccttagcagcagcaggtattcccttgggtggctggccagggtgtaggctggcaactggggaacctgccctcactataattgagagttgacttgcccctagagagtgccctgtccctaggtttgtggaattcagtctccacaaacctagagaggagaggacaaggacagtagttggattcattctctggggttgtagctgtctccgtctctttgctccagaccatcccaatctggcaaaacaagccacatggggctgctcgaagtgtagtaagaagaattgggaccaacctacccttgaagccgtgtgcccgggcgtcctttgaggtgagtatgttggaagggcaggagagtagaggctcagacagtgctgcttctgtgccccaaaccccttggtactgcccaagtaggttgtttcctggtcacttttcattctgttatgaaatatttgttaaatgcttataagatatcctggtcactgtgtcctcctgagtgcatacaaacctgtgaccacaaggaacctgacaggtcccccacatgggacactgactattgtgatttttgagttgaactctgcttttcttcaccagccctaagaattgaccatgtagccagtatttttattttattattttttgagatgaggtctccctatgttgcccaggctaggtcttaaactcctgggctcaagcagtcctcctgcctcagcctcctatgtagctgggattacaggcacaagccaccatgcccagctccactatttttagtgtttctctgaggccataattcctcagccttctctttttggccaatctgggcatcctttactggggtgctttggtcttacctctgtgtctagggatcctttagcacccactcagcagcagagattcctacctggcccaggtctcttgagaccccttctgtggtagaaagctaagtagcatttattagtcccagctgcctccctctaggaactaaatggttaagcaccagccccaaactatatggttcagatgtgtgcatttggagagctgggatacaaaagaaatacttgtgctttctacccacacagaggagatagaaatatgtgcatgaaaggatgtgggcccaggtagaaacagaaatgaaggagccaaatctgtataaaagatgctaagaagcagagtctgtaggaactggatctggaattagaagaggtgtcagggttggtattagggtcaggaatggagttggaagtgtcgcaggggtagggggcaggaaaagctgtcccagtattcagattgccagctatccagaattgtctaaagatcctgggcaggaactggtcctaacttgcctcagaagcatcagaaaaaaaaaagggagacagctagggagtgtggctcactgcatagaggccgtccccacacttggctataccctcttcagttctttggccagatgctgggcagagacaatcaagggcacaggctctcacagagcaggaatgtatgtgagcagtattggtaatactagataacatttactgagcacatactatgtgtcaggcactgtgctgtactttatatttgtttactcatttaattgccaagagcaaaggagcattcagggctaatcaggaaaacaaatggaggcttcccccaaatgccctattttagcactagttcctgggtcactggaagttcttctctgtgtgaccttggagtatcacttaactcctgtgagtcccaggtttcctatctaaatgcaggagcgatcaatcctggatccatctaccataccaaataatttgtagcagaaacagttgaatcttacttgtgtgtaaatatgcatttattattattattaaattaccttaaatattatttaagggactcttaccaatttattttgaaaatttaagcatatgaaaatattaaaattatgaaaagtaaaaggaaaataaattacctataattacatagtaataatacaataactattaatgtcttagtgtagtcctctttttctagatggatgttttttactttgttgtaatcacagtcaacatgactgaatcctaatttttcactttactcaacatctctaggttgaggagctattttaagaaatcctattatggttccttttgtataatcatttatttttatttaaatctaaatatattcaaattttcaggtttgtttaaaacagcattgctgtaacaatgtagatctcaattagctatacaggattataaaaagctagtcaggaaaaatttcctattgctgtaacaggttgtggatgaccttgtacttgtattttcaccagagggcacagtggttttagacagttgccatctctactaaaaggtgactcaggccttttccactgaagacacagaactgtttgtaatcccatagactctcatgtgtcttgcctgtttttgtttttgaatgtggctctgttgtccacgctagagtacagtggtgcaatctcagctcactgcaacctctgcctcccaggttcaagccatcttcccacctcagtctcctgaatagctgggactacaggcgtataccaccatacccagataatttttgtattttttggtagaggcagggttttgccatgttgcccaggctgatctcaaactcttggtctcaagcattctgcctgcctcggcctcccaaatgctgggattacaggtgtgagccaccatgcctgactgtcatctggcctctgttcaatgttttcgaccaggaaccttcttctgccccctctaggaagccttcctgacacccagtgccggattaggtacccctcctgtgtattctgcagtttctgattggctcatcatggcatctgtaaatgttgatgacttttgcttctccatagaccctgcccaacatctctgacctgtgtttgagagatgtgcccccagtccctaccctggctgacatcgcctggattgctgcggatgaagaggagacatatgcccgggtcaggtagttgaggcagtagctggtctgctaaggaatggagaacttcccagaagaggtggcaggcagcaaggagagaggaatgagaactgtgggctcagagaggagcagaaccttactatactactctcacagaagtgggggaaggaaccttaggagcacagtggcctgctgtctctaactgatctacttggttttccctggtccaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcaggtaggagcccctgtgccagggccagaacgtaacaggctgttcctttcccctggctcttgggcaggataggggtaaagaaagtggtaatccttggtttgcaggtacttaggttccgggccctggggttgtcctgaagcctggctagccagtagtgcctcttagatggtttctaccagccattttgggctgaatggtttggttaagaacaaaatattaacctgtgaccccaggcagagtccctcccttagcccccaaactgataccctcttctaagtgtctttaagatcacatcttacataagcccacagtagctttttttttttctcctctgagtgagtcttgctctgtcgcccaggctggaagtgcagtggcacgatcttagttcactgcactctgcctcccaggtgcaagcgattctcctgcctcagcctcctgagtagctgggactacaggggtgtgccaccaggcctggctaatttttatatttttagtagagacagagttccaccatgttggccaggctggtcttgtattcctgacctcagatgacccacccacctcagcctctcaaagtgctgggattataggtgtgagccaccgagcccagccagttttcctttttttggagacagggtcctggttcttgctctgttgcccaggctggagtgcagtggcgcaatcttggctcactgcaacctctgcctcccaggctcaagcgattctcgtgcctcagcctcctgagtagctggaattacgggtgtgcaccaccacacctggctaatttttttatttttagtagagacggggttttgccacattaatcaggctggtctcaaactcctggcctcaagcaatccacccagctcggccttccaaagtgctaagattataggcatgagccactgtgcccgcggttgaaacaagagtctcattctgtcacccaggttggagtgcggtggcacgatcttggctcactgcaacctccacctcctgggttcaagcagttctcgtgcctctgcctcccgagtagctgggattataggcgcatgccaccatgcccagctaattttttgtatttttagtagagatagggtttcgccattgcccaggctggtctcaaactcctgagctcaagcaatccacttgcctcagcctcccaaaatgctaggattacaaccatgagccaccgcgccctgctttccttttcaatacaagaagtaaacattccccccaccaccactgagacttaccctttttaagcacctatcttcccttgccttgttgtttctaccaggaatcacaagtggctttaccacttcagttcttatactgctagtgacattgtccccatgccccacccttcaaagtggggagtttcatgacattatgttatgttttcttatctcaaattggtggacttttttggtggaaggagaatttcataaagttggagatcttggccttaaaatacagtggtcgggcactgtggcttacgcctgtaatcccaacactttggaaggctgaggtgggtggatcacctgaggtcaggagttcgagaccagcctggccaacatggtgaaaccctgtctctataaaaaatacaaaaattagctgggcatcgcagcatgtgccttgaacctggaaggtggaggtggaggcagaggtggaggttgcaatgagctgaagttgcaccactgcactccagcatgggcgacagagtgagactccgtctcaaaaaaagaaaaaaaaaaaacagtggtctattatgcaaacaagccctgtaacccacccctccagctttctgtctacagttaaggcagaaccactggaaatggatgggaagcctgccttaaccagaggcatggacagccaacaggtggatcgctcccaagatgctcagggcttatcttcatattcctcccatcctcattttttcactctgcattgactcagagtcatagctctgaaatttatcatttggtaggacacatgaaaatcatggtgttctttgaaatcttcatgtatttaatttcttcacatggaagttttatgaagaattgtactgaaactttgttatttcttggctacttttttgtcatccaagagacaagcagaagtaacatcttttttagaaacatagtttttagtgtatttagtgtttttaaagtatttttagaaatgtaaaaactgaggaaattctctccactgaaatttggggaggttgggaggtctgttaccattctggttttgctcagaacatgtcttctagttcacagatagcaagatttcaaaggagcatagtcaaaagcactagtctagttagagaaaaggacaaattcaggccttagctcttatctctgctgctttggcctatgacagggctgtcactccacagcctattgtggaatgggagcttttaaatgccaaggccattatggggctgggttttcctgccttcctggaacactggaaaagcccagtgcttctacagctttctgagcccccgagtgagaagcatagtggaatgaccctccactggctacagataccatcctggctctcccagattgtcatggtgtcagcccaggaaatgaatgttcagtaggcagggctgtggggagaagatattgctactgtgttctagccccaatgtccacccatgcctattgttttctctttcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgtaagtatctgatgaggagctctggtatctatttactcagagttgcccatggccaattatgtaatgcaacatacttacatagtaagttcttagtagtaccatatgttatgtcattcataaagcttgctgactacctgcttgccagtgcctggggccccagtttgaggaaagagcaacactacatttattgggtttggtcaccccaaccaaatatgaggctagtagggattttacaagaaggctcatctaatccaacttctgtcctcaggtggctttaccacttcagtcctcatactgctagtgacagtgtcttcatggcccacccttcaaagtgaggggttgcatgacattatgttttgttatgttttcttatctcaaattggtagacttttttggtgggaggagaatttcataaagttggagatttctgctttaaaatacagtggtccattgtgcaaacaaaccctgcacattcagtgatttgagaataaggcttttgagactcaccagtagttccgaaacctagctgcccatcagaattgctcagatttgttaaaaatacacctttaacttactaaagtagaaccccaaggagtggagctctaggtttttccgatggagtatgagggtctttggggaatacctaccttgaaaaacttcatctggcaaagaagcctcagggagtcaccccattgcatagtgtttctccagttgtgggttgcggtttcaacagctgcacaggactcaccagaggagcttggtttgaatgcaggttcctgggcatttgagagccagaccttgatggccagcacccagcttgtgcagctctgtttgttaatgcagatgaaaaactgttttggggacagggaagcgaggtcctctcctgagttgataaagttcttgttaaagggaaagttacttgccctggatccctttttgtctcctgggatccatttccctctgaaaagtagaccaggctaagtgactccctcattgcttcctggcagttgacccatttagggaagtcactcttaaccttccttcactggccctagtcaggttggtcatactcacccatatctctttggtcttccacattcccaaattcagttgctgctgtttttggtcttctctgagctgtcttcttctgaacaaaatgttttataggttgactctcaaactttctcttacttgccttttggaccaaattagattcaagacccttattgctagccccctcctcccacttgtgtcctcagatcagaaggagctgggtcagtgaataagaatgggaaagtaccccagtcagcaaaggttcagatatgtcaccaaccaaacgcagtccctcttgtttttgctttgaaggttgaatagtcagtcttggctcttatatttagcttaatcaccagtaaaacaccttcatgatgaatgtatataagttcactaggatttcaagcaactattttccaggtatctaggaccctcttatatgatgtatcagataacttgggcctacttcagtctggagttggttttgttcccatgagtttcttatgtgaatgttttgctctaattctggctctcataaaaaatcatctcccctgaaggggagacccggtggtaggaaatcccaagcacaccttttctccagaactatcaagggtcagaatagccaagagtcatcagtcacttcccctgctgaccctctggggaaatgctactaagaaaacagggccagaaggcagaagcttagccaccagaggccaactctaacagactgatggtcctttactttgcccatactttatagctatttcaggaaatagtaaagcattctagttaatagatgagatctggaaccagctagtttggttctgaactctggattcaccgcttacttgctgagtgactagtgaccttgggcaacttgtataacctttctgtgcttcaatttccttatctgtgaaagggaattgtaatggcacctacctcgtaagattgttgtgaggattcaacgagataatgtattcaaaagatatacagcactacacaggaaagagtaagtactcaagctattattgtgtctctaggaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaatgca

SEQ ID NO: 10544 - DNA, 1849 bp, Homo sapiens
gagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacaga

SEQ ID NO: 10545 - DNA, 1848 bp, Homo sapiens
gagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtcctgggatggtcccacgactagggcctgcacatttcttacaatggcaaagcattttttaaaatttagggtcaggttgaaaaattctaggactaattctgtagagaggagggactgttaactaacgtgagtggggacagaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcagcggagggaaggaagggatccttgtacctggagatggagatatcttgtggtttaagcaaatgtcccactgaaagtgattcaaatatcaacagaattatttcaggttaaaacaga

SEQ ID NO: 10546 - DNA, 5338 bp, Homo sapiens
aatataggattaaataattcccacaaggtaagaaggggaagatatcagtgagatgaaatatactattaccaaaggtatgtcacttttcagcagggtgtgttgttatctttgagtcagacacaacaattacttttaagccctgtggctggtttccatgagatagttcccatttgaggttggagtctgccattaccttgatgctggcttttccccaggaaaggagtagctcctagatgactatagcttaactgtacctgctcccttttcttcctaaagtgtctcggtagtttattccagtaacacaaagagatcaggatcaaatgagacaaagtgggctttacggttgtgggttgctttttcttatttttttccaactccatcactgactcattgtgactttgggcaagtcatttacctaccctctgccaattattcacagttacacaatgaaaatacttcattctcaaaacattcgtaagactgtctgccttgcagactttttggaagtataagagattatagtgccttgggattttttgttactttcctagcattcaccagcagtttgtcccatagtcaggtgcctgtttcaatgagagaatgtagtatgcagaatgctaaggtttcttcctgaatttcctcatattttaagaaagtgccacaggttgtttttcttctatatggtcaccttgaactattaataggacttaagattttagaccttagtggaggatgctgtgtttactgcttctcaaggatagcatgttttcagtatgaggattatctttggccagactaaggtggaatcaaaggtaggagagaggcagtagcttctgatttgaatattgcctttccctatgtttgaagccctaaaactgctaactgtgtacaactgtgaatttcaaaagtctccccagatgatagaattaactcttaatttaacaagatgtcctttgtgttgagactgagctagactaatagaccgggtatgtatttttaagctctacagcattacttgactaaacctctcttttggtttgtatattaaaattatgccataggcaacctcatctcgcatttaaaacctctcataaattagaaaactttgaatggttctccaaagataatactgggtgttgtacaaaatagcagcacaagccttcttttcctagaaatgggtacagattcattgcaaccacatggcttgggaaagttcaagctgctacccaaccagccttaatttgtgagttacaaatttaatagtacttgattcatagagggaacaaaaaatagacccatagtattatcatctttcaataggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaggcccactggggttgggggggttaaacacgcataatttattatgaatataaatttcccatgtttgtttctgtgtcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaaca

SEQ ID NO: 10547 - DNA, 799 bp, Homo sapiens
aaaaaaaaaaaaaaaaaagcccagcatggtttgactggatagacacgcataatttattatgaatataaatttccatgtttgtttctgttcctaaaccagagtacggggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaaca

SEQ ID NO: 10548 - DNA, 9261 bp, Homo sapiens
ggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggtgagtgacacacagttcccccatgtagtccccaagttggctgggggactctagaataggataagccaccctgatgaggctggcctttgttggatttctttggaggagtttttttgtttttattttgagatggagtcttgctctgtctccaggctggagtgcagtggtgcaatctcggctcactgcctcccaggttcaagcaattctcctgcctcagcctcccaagtagctgggactacaggtgcccgccaccacgtctggctaatttttctatttttagtagagacgaggtttcactatgttggccaggttggtctcaatctcctgatctcgtgatccgcctacctcagcctcccaaagtgctgggattataggcgtgagccgctgcaccatgccttttttttttttttttttttttttttttttttttttgagatggagtcttcctctgtcgcccaggctggagtgcagtggcgtgatctcggctcaccgcaacctccgcctcccgggttcaagcgattctcctgcctcagcctccccagtagctgggattacaggcactcacacccacgcccggctttttgtatttttagcagagatgaggtttcaccatgttggccaggttggtctcaatctcctgacctcgtgatccgcctgcctcagcctcccaaagtgctgggattacaggtgtaagccaccgcccttggcctgtttttgtttttaagagatgaggtctcactgtgttgcccaggctggacttgaactcctgggctcaagtggtcctcccacctcagccttccaagtagctgggatttataggcacaggtgtgtgccaccgtgcctggctgtggagggttcttcagaggcagagccctgggttggtttgaatccttcatgctttgtgctgctaccttggttcacttagtacagagggcagggggagtggaaagggagaagtgagatgatttgggggcttcctgggacctgtgtactaagttgataggggctcgttttcaatcctgtgttgtgtgcctccacaggaattgaggcatcggacctgtccagtctgctggagcagtttgagaaatcagaaggtgagggaacatgggtagttttgctccaactctttttttggtgatacttttttgggcccagccctgtagttgcttaaactagggtgagaggggacagccttagccactggagcagacccctaattggaagagagagacaagattgaactgtgacggtaatccaagccagggacggcagtgatacagtaaggaaggtattaaagagtagactgggaatccaggccaggcgtggtggctcatgcctgtaatcccagcactctgggaagctgaggcgggtggatcatgaggtcaggagtttgagaccagcctggccaacatggtgaaaccccgtatctactaaaaatacaaaaattagctgggcgaggtggcgggcacctgtaatcccagttactcgggaggctgaggcaggagaattgtttgaacccagcaggcagagattgcagtgagccgagatcgtgccattgcactctagcctgggccacagggtgagactctgtctcaaaaaaaaaaaaaaaaaaaaaggaatccaagcaggttggggttgtttagggacatttttctagagggaagtagctttcaggctgggcattgaaagacaggtaggaattcacagagagaatatgtgtggcaactaaaggcagagggtaggtataggaagaatggcatatggcacatttgaaaggcaatggatagctggctttcttagtataaggcgtggatgtaggtgctatggaggacactatcttcttctcaaggagcttatggtctaactggggagaagaatctacagaaatgattcctgagttggtaacaaggcaaaatagaaaatgtgatttgtagaacaagagtaggctgtgaggccaggaagctagttaggcagatcatagatcaccttgaacgctaggcttatacatttggactttatctcagattcagtggaggaatgtgggtgtttctgagcagaaaagagacatgattaaaaatagtacttgggcatccactggaggagactagatctctttggggagatcccaacagggaatatgtaggcaaagtggattttcctcctttgggtctcaaagcaagcccttctgtgccgcctcagtctagaacatctggttgggcttttaactagtatggtttctttgcagccaaaaaggagtgtcctcctccggctcctgctgacagcttggctgtaggaaactcagggtaagtatggagacatgagcgagttaccctacagctgttagtcagcagccggctgacactccaggactgtcaactggatgcctctgttgcagggacgctgtagtcagctctagagtctttccctgtttccccaccccttactctgcctatcactaccgggcagtgtcttgggtggtgaggtgagaacggggcatgttcactgccctccagctgattccagtcgggctccaaatgtcctagaggtgccttttatctcctggcaagtcatacctttggggatttctttctttcatttaataacacttcaagtttgctcagtgctggtaatggtgtaacttaaagtggaggaagatgttaatggctaggagtcatttttcatgttcatgatcctccatcctgttctgccaagcatgttcccctccacattgatttcaggttggtgtgagctgggcaggtgagactcgatgtgaaggaggtggggggtattcaaggtcatggccagcctgcctcttggaattgggcagggctcagttgagatccaatttgtagttcagtcaataagacccttttgtgcaggaagaagatgatggaggcagtttgtgcatcccattcttctctgcacccaccccctcccattgatttctgagaaaggcaaatgtataagatattgagaaggcaatgaatcaggctttcccttttccccccccgccagcggcgttgacattccccaggagaagaggcccctagaccggttacaagccccagaactggccaacgtggcaggtgggttcagggtggggaattctgcctgtgattagtctatgcagcaacacttgctgagcctactccaaatccattgtgtgtaggcgttaaggacatagagatctgatctccagccttgagatactcacagtctagggggcagacttgtaaacgaatgagcatgttgagtatcaggtgctatgttacagcctatgggctaggcgcagtggctcgcgcctgtaatcccagcacttgtgggaggctgaggcaggcggatcacttgaggtcaggagttcgagaccagcctggccaacatggtgaaaccctatctctactaaaaaaaatacaaaaattagttgggcgtggtggtacacgcctgtagtcccagctacttgggaggctgaggcaggagaattgctaaaatccaggaggtggaggttgcagggagctgagatcgtgccactgcactccagcctgggggacagagcaagactatctaaaaaaaaaaaaaaatgtcgggcgcggtggcccacgcctgtaatcccagcacttggggaggccgaggcaggtggatcacgaggtcaggagatcgagaccatcctggctaacatggtgaaaccccatctctactaaaaatacaaaaaaattagccgggcgtgatggcgggtgcctgtagtcccagctacttgggaggctgaggcaggagaatagcgtgaacccaggaggttgagcttgcagtgagctgagattgcgccactgccctccagcctaggcgacagggcaagactctgtctttaaaaaaaacaaacaacaaaaaaaaacaaccatggattacagtgagatgtgaagagggacagtcagggaagggttatatagaaactaatcccctaagctgaggcttgagaaactctatcaggtggtagatttagggaacagggcattctaggaagacagagcatcttgaatgaactgaagaaacaaaaccaactgggtatgttttggggaattgtgagaggcttggtttggctggagtgtagtagctgatcagggcagtgggcagaggtaaagcgagagataaaactggagtggtaaatagaaggtcagattattgggacctcgaatgccatattaagctctttggactttatcctgtgcattgaagaaactttgccagattggtttttgggtgctccatctagcaggaatgtagaagacaggtggactctgaagctgcaagtggggagacgatagatgatgactgcatgagtgcaggaaagatgcagcctagaagtcaggcagtactcgggggaaggggcggatctgagaatggagagcttagactctaggacctggctactaggtttgggtagtgagaggatgagggcttcaggaagaccctagctggctggatttctcttgctggtccccaagttggggaacatggggaaggggcagttgaagcagtgggaaaagttgggctgcttaccttgcttggtgtactttgtgagatgaggtgggggtctctggaggctatatacacggtatttggaagcgtagaatcggatctcatcctgctatctccatcctccctccccaccacagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtgagctttgatggccctgtaggtcctctccatttaggaagttcacgtacttctgtggtttactttgaaagcttttacccgttgactttggtactttcaggcgctaaggcttctatttctgactttggcttttgtgttttcccttttcctggattgttgaaggaggcaagctgtgagacaattgcttctgtcccctgttggagcttggggtgtcaggtctcctgcttctttgagacctgccttggggagacttttagggtttgattttgaccatgttgatttttttcacatactgtatcagccttcatttttggtattctgggcgctatgtgaggtagtgggttacttgttaatagaaaatagttcttcccttaatcatctgctgaggaaggtgtctggggcagttcctttgggtgtcactatggcctcatctatttcctggcagtatctttttttctcagtaaccaagttttcccacttaatgaagaattcttgggttttggagatgatatatgtcttcagaactggcccatactacaagtctagcagttaacctctctcatggtcacagtatttcagtgagacctggtaggggagcaatagtaacccaaaagacccaggcttggccccagcaccacagatagctgggtgtgagacctagggctcacccctctccctgagtctccatttattgttcttcctctttctgatttgttaaatatttttcaatttttaagtgcacaattgaaaatgtgatctcttccaaaacacttcacaacattccaggtacacctaaagttccatgaagggcctcagtttgttcatctctgaatgaaaattgttcttctagacctcttctactctgctttgtctttggtcctgagcttcctaaaagaaaggcaggactggggcctgggtgagataagcagagtatacctgaaccactcccagcattcctgcatgccctcttatccttcaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtgagcatgtgttcagggagcgccatgcacctgggatgcaggtgcctaagagttgagtcttgaattgtcttatgtttggggggctgatgacaccctcttttgtcaggtacagctcttatcgttcacatgaccattaccaaaggcaaagagtgctacaaaaggagcgtgcaatagtgagtagaggaacagatcatgggaggatggggcttaccccctgagccttgagctcagagagctgcctgcagctgtagccctggctaatggtgtgttgattttttttcatttccaaacataggaagaaagaagggtggtcttcattggaaagatacctggccgcatgactcgatcagagctgaaacagaggttctccgtttttggagagattgaggagtgcaccatccacttccgtgtccaagggtaagcttgggccccaggctcaggatgttctttctatcccattcatctaccttggtgtttctttgtcttgcctccttgctctggtgtgctgagcaatatggggcaccttcatttctgcagtcagagggttggccactgggaatgagaagaaccacctctgtaccttgggatgctgtgtctcctctatggcatgggcccatatagccactccagcccctgcctcactctcctcctactagggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttggtgagtggagggagggcctaaagctttggaatgcttcatcccctccccagaagggttcctaaccctttgtgagtggggctaggcagacttaccttagtttgacatacaaagaacccaagggggctgggcatggtggctcacgcctgtaatcccagcactttgggaggctgaggcaggcaaatcacgaggtcaggagttcgagaccagcctggccaacatgatgaaaccccatctctaccaaaaatagaaaaaattagctagaggtggtggcacgcacctgtaatcccagctactcgggaagctgaggcaggagaattgcttgaacccaggaggcggaggttgcagtgagctgacatcacaacactgcactccagcctgggctacagaacgagactgtctcaaaaaaaaaaaaaaaaaagacccaaggggtgggacgagaggagaaatggggactggggactctcctatctctttgacttaaaattagagcagttttcactccatccgtttttgggatgggagatagctagccatttgcagaccctgtggttgggaagtgtggtcagagaccttgaagtttgtctttacctttatagactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaactcccaa

SEQ ID NO: 10549 - DNA, 319 bp, Homo sapiens
gtctttatatggtgctaatgccaaatgtattcacttttcctatctgaacatggtccagggacatgcctctccctggtcaggtgcaaaaatcccactggatttgaaccttggttcctcagatgtattgtctaaaatgagtcatttaggacagtgcttctcaactttaaagggaatttgaatcatctagcgatctttttagaatgtagattctgacaatgggatgatgatactggtccaggaagggattttgataacaaggacctagagaagctcacacttgttccaaagaaaggttttctaaactgcgacaggtgtatac

SEQ ID NO: 10550 - DNA, 797 bp, Homo sapiens
agagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtgcacagcccccaactgggaagtgggctatccttccaaagacttccacagggcttgcagacataccttgtcttgacataccaccagccccagccaaaaagacagct

SEQ ID NO: 10551 - DNA, 1804 bp, Homo sapiens
aatggaaaagagtgattgtgagtgttagatatggcctttccctttcgtgcttctagccaccttgtcactgattttggaaacctcacttaacctctatgggtgggcctcaatttccatctaaaatagagaagtagggaggaattggatcaaaccagcccaagaaaatttaattaactatttcaaactctaatgaaaaatctctactttaaaaattgaaacacaaaaatgttctgggaggttctattcattgtctgctttcctacatttgccctgattacaagactgagttccttgataattgaaaccatgtctctttatctagtgcctagcatagtgccaagcacacagtgtatgcacagcctattggtatgaaagagaacacaacttcattaattctcatatctctccagttcacaccccttcatctcctgtaaaacaccccttcccctacaattatttctgttagtctctaggtgtttcttgtattcaagagtatgtccacagtttgggtgcctctgtgcattccttctatctgagcatctgccatcattggtgctctgccatgccactgctgggaacatttgacccctctgggagcatcttcctaatagatcccataaactgcaaagccttatggttaccaaaatgatggtgtatatatatatacttggagccttgcaaagcccctaatgaaagtatttccttcaccagctagaagtactctcctttagcgatcagattaaaacacacacccaggtgtgtgttttaaagaaaaaggacccaagagggaaaaagtttccaaggcatgaatgaattaagagtggcaaatgctactgagatagaaagattaggacggagaaaacagcactcactctgacagtattctttccaactggatttggtaaataagagtgaagaggtacctcgagtgagcactgggagaagtcatactggaagggataagcagtgattgacataagaaagtaaaataaattcaggttcatccagacacccccataatcttgccttgacccagaaacattgtgttcacaggactttcagcttcccacccccataagtaagcttcctaattatgatatcttggtcttgccaagcatttagagggccttactctgtggccctccagatagtgatttgaatgattaagtaaacctctttttagataagtgttctagtccagtctaacatcagcttgttggtctttttggcactgtcattgtccagtaccagcacattcttggctccttgccacatctctggcctcaatgtgggaggcaaagacagtgagcatttccagagtggtgagatgggtgcagcacataatgaggcgatgaccacacagcatctctgaacagcatgtccacacagggctcgaagtcattatgctgcatgtccacctcatgtccacaatagctgagcagttgagattggtggagtggaccttctcattactcatcatctagaggaaggtcctcatcatctctacttctcaaaggggtagaattgaacctgaacctgcttgacagacaagagcccaagcctaaccaaggtggctgccatggtgacccttgccctgaaagccatttccattaatttaaaaattgtaggtatataggaactataataacaggcttaaaattaaaatttgctctgtttgttgggtcacacgtgtaatcccaatactttgggaggctaagccgggacgatcacttgagctcagaagtttgagactagcctgggcaacatagtgagatcccggtctctaccaaaaaaaaaaaaaaaa

SEQ ID NO: 10552 - DNA, 231 bp, Homo sapiens
atctgaggtcaggagttagagaccagcctgaccaacacggtgaaaccctgtctctattaaaaatacaaaattagccaggtgtggtggtgcatgtctgtaatcccagctactcaggaggctgaggcaggagaatagcttgaacccaggaggcggaggttgcagtgagccgagatcgcgccattgcactccagcctgggcaacagagcaaaactccttcaaaaaaaaaaaaaa

SEQ ID NO: 10553 - DNA, 109 bp, Homo sapiens
ggcaggagaatggcgtaacccaggaggcggaacttgcagtgagccgagatcacgccactgcactccagcctgggcaacagagtgagactccacctcaaaaaaaaaaaaa

SEQ ID NO: 10554 - DNA, 170 bp, Homo sapiens; identical to SEQ ID NO: 7565

SEQ ID NO: 10555 - DNA, 147 bp, Homo sapiens; identical to SEQ ID NO: 6794

SEQ ID NO: 10556 - DNA, 131 bp, Homo sapiens; identical to SEQ ID NO: 6213

SEQ ID NO: 10557 - DNA, 143 bp, Homo sapiens; identical to SEQ ID NO: 7597

SEQ ID NO: 10558 - DNA, 170 bp, Homo sapiens; identical to SEQ ID NO: 7598

SEQ ID NO: 10559 - DNA, 154 bp, Homo sapiens; identical to SEQ ID NO: 7620

SEQ ID NO: 10560 - DNA, 207 bp, Homo sapiens; identical to SEQ ID NO: 7631

SEQ ID NO: 10561 - DNA, 162 bp, Homo sapiens; identical to SEQ ID NO: 6214

SEQ ID NO: 10562 - DNA, 100 bp, Homo sapiens; identical to SEQ ID NO: 6215

SEQ ID NO: 10563 - DNA, 193 bp, Homo sapiens; identical to SEQ ID NO: 7396

SEQ ID NO: 10564 - DNA, 187 bp, Homo sapiens; identical to SEQ ID NO: 7657

SEQ ID NO: 10565 - DNA, 153 bp, Homo sapiens; identical to SEQ ID NO: 6795

SEQ ID NO: 10566 - DNA, 202 bp, Homo sapiens; identical to SEQ ID NO: 7667

SEQ ID NO: 10567 - DNA, 203 bp, Homo sapiens; identical to SEQ ID NO: 7398

SEQ ID NO: 10568 - DNA, 158 bp, Homo sapiens; identical to SEQ ID NO: 7682

SEQ ID NO: 10569 - DNA, 193 bp, Homo sapiens; identical to SEQ ID NO: 7690

SEQ ID NO: 10570 - DNA, 195 bp, Homo sapiens; identical to SEQ ID NO: 7691

SEQ ID NO: 10571 - DNA, 141 bp, Homo sapiens
agtcccagcaactcgggaggctgaggcaggagaatggcgtgaacccaggaggcagagcttgcagtgaggcgagatctcgccactgcactccagcctgggtgacacagcaagactccatctccaaaaaaaaaaaaaaaagag

SEQ ID NO: 10572 - DNA, 279 bp, Homo sapiens; identical to SEQ ID NO: 8074

SEQ ID NO: 10573 - DNA, 243 bp, Homo sapiens; identical to SEQ ID NO: 7716

SEQ ID NO: 10574 - DNA, 153 bp, Homo sapiens; identical to SEQ ID NO: 7724

SEQ ID NO: 10575 - DNA, 150 bp, Homo sapiens; identical to SEQ ID NO: 7399

SEQ ID NO: 10576 - DNA, 142 bp, Homo sapiens; identical to SEQ ID NO: 7400

SEQ ID NO: 10577 - DNA, 166 bp, Homo sapiens; identical to SEQ ID NO: 7759

SEQ ID NO: 10578 - DNA, 906 bp, Homo sapiens; identical to SEQ ID NO: 7771

SEQ ID NO: 10579 - DNA, 368 bp, Homo sapiens; identical to SEQ ID NO: 6222

SEQ ID NO: 10580 - DNA, 1548 bp, Homo sapiens; identical to SEQ ID NO: 7779

SEQ ID NO: 10581 - DNA, 4704 bp, Homo sapiens; identical to SEQ ID NO: 7404

SEQ ID NO: 10582 - DNA, 1773 bp, Homo sapiens
tattaacaattttctatatttaattttctctattcaaattactagtttgtgcagaatctagattttatagaaaaaaacaaacaaatgcctagtgatttgtttctatctccctcctgtgtggtttctatctccctcctgattggatcctgactgatacgttggggtatgctgctcatgagagatttctttcagagtggtgaataaactatgtcctagaaggcatattgtatcaggaagggtcacgtgttagagctgtggtttacattaatatatacagtgttaggaggagcataaagaggaaaacaccattgtggcaaagtaatcctgtggaaaccagagagagagagatttgataaagtcttggtgactgacctgagtacgaaaccagtggtggtggtagtgggaatctttagattaatgaatattgatttattcataagctacaaaattcaaagggcacccagtttctctttctagaggtaattactatgttcagattcctgggacctttccaggtatctgatgtataaatacctctctctctttccctctctttctaacacagatattagtattcctctgtgtcttactttatccccttaatagtatatcttggaaatcattgttttctttaaaaaaatgttttaattgaggtaagcattcattatacagtaaatgtcttgttccttttaactggctgcataccctgtcaacctatggctgtgccaacactggagagagtctgggttgagtatagtctttttgccattataaacagggttgcagtgaacattcatgtgtatacttctttgtacctatgtatgagtgtatcctggataaattcctaaaagtgacgccactggattggaggtcatttttttttaaactttttattttgaaataattatagattcataagaagttgcaaaaacaggacagagaggccccagttgcccttcacctagtttctcccaatgatagcatcttacataacatgatacagcatggtatatcatatcaaaaccagcacattggtacaatctacaaaccttattcagatttcaccagttttacatgcccttgtgtgcatgtgtgtctgtgtctttgtggttttatgtgcttttatcaggagtagatttgtataacctcaaacaagatgcagaactgttctgtcagcacaaagatcccttgtgctacctcatagtcacaccaaacctcctctcctccttttgtcatcacggcattcctaactgttgacaagcagctaatctgttctccatctctgtaactttgttattttgagaatataattgaaatcgtatagcatgtaaccattgagatgggttttttcactcaccgtaattcccttgaagatcatccaagttgttgcatgtgtcaatggttgttcctttttatttctgagtaatgttccatgatatgaatgtaccacagtttgtttaaccattcacccactgaaggacgtttggattgtttctaagttttgactgtggcaagtaaagatgctatgaacattcatgtacacatgaatttgtaggcatatgtttttattttgctgggagaaaagcccaagaatgcagttgctgggttgtatggtattgtatgattgtttttcttttaagaaactgccaaattattttccagaatgactgtaccactgtacattcttattagctatgtatgagagatgtagtttctccaaatcctcaccagcatttaatattgtcaggattaaaaaaatgttttttacttgtt

SEQ ID NO: 10583 - DNA, 1771 bp, Homo sapiens
tattaacaattttctatatttaattttctctattcaaattactagtttgtgcagaatctagattttataaaaaaaacaaacaaatgcctagtgatttgtttctatctccctcctgtgtggtttctatctccctcctgattggatcctgactgatacgttggggtatgctgctcatgagagatttctttcagagtggtgaataaactatgtcctagaaggcatattgtatcaggaagggtcacgtgttagagctgtggtttacattaatatatacagtgttaggaggagcataaagaggaaaacaccattgtggcaaagtaatcctgtggaaaccagagagagagagatttgataaagtcttggtgactgacctgagtacgaaaccagtggtggtggtagtgggaatctttagattaatgaatattgatttattcataagctacaaaattcaaagggcacccagtttctctttctagaggtaattactatgttcagattcctgggacctttccaggtatctgatgtataaatacctctctctctttccctctctttctaacacagatattagtattcctctgtgtcttactttatccccttaatagtatatcttggaaatcattgttttctttaaaaaaatgttttaattgaggtaagcattcattatacagtaaatgtcttgttccttttaactggctgcataccctgtcaacctatggctgtgccaacactggagagagtctgggttgagtatagtctttttgccattataaacagggttgcagtgaacattcatgtgtatacttctttgtacctatgtatgagtgtatcctggataaattcctaaaagtgacgccactggattggaggtcatttttttttaaactttttattttgaaataattatagattcataagaagttgcaaaaacaggacagagaggccccagttgcccttcacctagtttctcccaatgatagcatcttacataacatgatacagcatggtatatcatatcaaaaccagcacattggtacaatctacaaaccttattcagatttcaccagttttacatgcccttgtgtgcatgtgtgtctgtgtctttgtggttttatgtgcttttatcaggagtagatttgtataacctcaaacaagatgcagaactgttctgtcagcacaaagatcccttgtgctacctcatagtcacaccaaacctcctctcctccttttgtcatcacggcattcctaactgttgacaagcagctaatctgttctccatctctgtaactttgttattttgagaatataattgaaatcgtatagcatgtaaccattgagatgggttttttcactcaccgtaattcccttgaagatcatccaagttgttgcatgtgtcaatggttgttcctttttatttctgagtaatgttccatgatatgaatgtaccacagtttgtttaaccattcacccactgaaggacgtttggattgtttctaagttttgactgtggcaagtaaagatgctatgaacattcatgtacacatgaatttgtaggcatatgtttttattttgctgggagaaaagcccaagaatgcagttgctgggttgtatggtattgtatgattgtttttcttttaagaaactgccaaattattttccagaatgactggccactgtacattcttaatagctatctctgagagatgtagtttctccaagtcatcgccagcatgtataatattgtcaggattaaacaaatgttttttacttg

SEQ ID NO: 10584 - DNA, 475 bp, Homo sapiens
acctatagtactaagtaaaaatctttttatacagtatttgtcttgtgtgggtcatgagcattagcatccaatggtaggtgtgtgattaaaatgcagattccttggccccgtcccaaatttactaaataggcctttgtgggttatagccttgggatctacaaatttaacaagattgagaaaacctaaggcctaattatctttcagcctcatctaatccttccctcccaaagacgtgagcgccacatacattcttatgcagcctctcaacacaccattccttttcgcatctccatacctctgtaatgtttctttccctgcctggaatgtgttcttacccttcaagagtcagctcaaattcacatctgtgaaatctaccttagtttgtacatatcaaataacagatgtgtgtttttgtgattcttcacattatgaacagcataaggtatttgccattgttagtattatcccatatgag

SEQ ID NO: 10585 - DNA, 476 bp, Homo sapiens
acctatagtactaagtaaaaatctttttatacagtatttggcttgtgtgggtcatgagcattagcatccaatggtaggtgtgtgattaaaatgcagattccttggccccgtcccaaatttactaaataggcctttgtgggttatagccttgggatctacaaatttaacaagattgagaaaacctaaggcctaattatctttcagcctcatctaatccttccctcccaaagacgtgagcgccacatacattcttttgcagcctctcaacacaccattccttttcgcatctccatacctctgtaaatgtttctttccctgcctggaatgtgttcttacccttcaagagtcagctcaaattcacatctgtgaaatctaccttagtttgtacatatcaaataacagatgtgtgtttttgtgattcttcacattatgaacagcataaggtatttgccattgttagtattatcccatatgag

SEQ ID NO: 10586 - DNA, 640 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaattt

SEQ ID NO: 10587 - DNA, 606 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttmctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggyttttcgccctttgacgttggagtccacgttctttaatagtggactcttgttccaaactggaacaacactcaaccctatctcggtctattcttttgatttataagggattttgccgatttcggcctattggttaaaaaatgagctgatytaacaaaaatataac

SEQ ID NO: 10588 - DNA, 628 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttacaaaatttaacgcgaattttacaaatattacgctt

SEQ ID NO: 10589 - DNA, 640 bp, Homo sapiens; identical to SEQ ID NO: 10586

SEQ ID NO: 10590 - DNA, 513 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactc

SEQ ID NO: 10591 - DNA, 612 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaacaatgagctgattgtaacaaaaatttaacgcgaa

SEQ ID NO: 10592 - DNA, 640 bp, Homo sapiens; identical to SEQ ID NO: 10586

SEQ ID NO: 10593 - DNA, 640 bp, Homo sapiens; identical to SEQ ID NO: 10586

SEQ ID NO: 10594 - DNA, 654 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtatt

SEQ ID NO: 10595 - DNA, 647 bp, Homo sapiens
  misc_feature (619)..(619): n equals a,t,g, or c
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttacanaatattaacgcttacatttcctgatgcg

SEQ ID NO: 10596 - DNA, 640 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtarcggcgcattaagcgcggcgggtgtggtggttacgcgcagcgtgaccgctacacttgccagcgccctagcgcccgctcctttcgctttcttcccttsctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataasggattttgccgatttcggcctattggttaaaaaatgagctgatttaacaaaaatttaacgcgaattttaacaaaatattaacgcttacaattt

SEQ ID NO: 10597 - DNA, 640 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaatcttaacaaaatattaacgcttacaattt

SEQ ID NO: 10598 - DNA, 571 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctatt

SEQ ID NO: 10599 - DNA, 640 bp, Homo sapiens; identical to SEQ ID NO: 10586

SEQ ID NO: 10600 - DNA, 639 bp, Homo sapiens
  misc_feature (552)..(552): n equals a,t,g, or c
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggatnttgccgatttcggcctattggttaaaaaatgagctgatttaacaaaaatttaacgcgaattttaacaaaatattaacgcttacaatt

SEQ ID NO: 10601 - DNA, 648 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaattkcctgatgc

SEQ ID NO: 10602 - DNA, 624 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactmaaccctatctcggtctattcttttgatttataagggattttgccgatttccgcctattggttaaaaaatgagctggtttaacaaaaatttaacgcgaattttaacaaaata

SEQ ID NO: 10603 - DNA, 509 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaac

SEQ ID NO: 10604 - DNA, 654 bp, Homo sapiens
gccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcgtattt

SEQ ID NO: 10605 - DNA, 654 bp, Homo sapiens; identical to SEQ ID NO: 10594

SEQ ID NO: 10606 - DNA, 102 bp, Homo sapiens; identical to SEQ ID NO: 6331

SEQ ID NO: 10607 - DNA, 832 bp, Homo sapiens
aagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccaggtaagtaagatattatcaaaggatacgtgaccattctctaggtattcagtaatagtcagtcacgagtctgtgttacagacctggttgttgtttttctaaatgcgtaatgaagaacaagagcattgtagaaaatgaagggggttgaattaaaggattagaagctaaagattttttgctcctagaaatggaaggttgagaaaaccacccacttcaaactaaggactgaatagaattcaatcaataaaagtcaaatttatggatcattataattataatttttagttactaataccggagtttaaacacattgcgaaagaatatgcagaaaatggccgggcacagtggctcacgcctgtgatcccagcactttgggaggccacggcaggcaaatcatttgaggtcaggagtttgagaccagcttggccaacataatgcaacccatctctactaaaaatacaaaaattagcagggtgtggtggtgcaggcctgtaatcccagctacttggaggctgaggcaggaggatcgcttgaacccgggacgcagaggtagcagtgaactgagattgcaccactgcactccagcctaggtgacagagcaagactccgtctcaaaaaaaaaaaaaaaaaaaaaa

SEQ ID NO: 10608 - DNA, 1165 bp, Homo sapiens
aggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 10609 - DNA, 825 bp, Homo sapiens
gttgctagcaccctcaccgcgtccagactccctcttgagtgcctttctgaaatgctgctcctcggcgctttccccattttacagatgaggaaactgagcacagaggtctcagaggccggattcaagccttatagcttgagctgcatggcccatgatcttatcctctgtgctgtccagcctgcttgggatgcagacgttgcgtgtaaagtgcctccatagtgcccgggactcggttgggtattcagtgtatgctaactctttgtattaaagtatgcagaggtatctgcttgtgtcagtttgaggatgctaaaacctgaacatgtttaagacacattcagaaaccagctcatctcttcctttgatacattgcccagctgtcggccctggtgtgttgggtgtgtcagtgacccatgcagtgaatccagaattcacgatgttcaggctgtgtcatagtgcaatctgtgatgctaaaaagtgcacaggttccatagccaagttacaaagacgctcacctcaggattcgataaagagatagtcaggcgctcttttgttatcttcgcatctgccttcctcaacaatgcagttccaggccaatcataactataaatggaggaagttcccctgaagtagttgaggagaggaacactgcctcagaaaaggcaggaaggaaataacaccagaccggctaacacttgtttctggtggcaagaacacaggaaggtaattttttactttgcccagctgttctggtgtggggggattagcagtcacaggaggctgggttggcaggtttccccttgctcctgatttgcagccttgtcgtgc

SEQ ID NO: 10610 - DNA, 4054 bp, Homo sapiens
aggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagt

SEQ ID NO: 10611 - DNA, 120 bp, Homo sapiens
gcgcctgtagtcccagctactcaggaggctgaggcaggagaattccttgaacccaggaggcggaggttgcagtgagctgagatcacgccactgcactccatcctggcgacagagtgagac

SEQ ID NO: 10612 - DNA, 289 bp, Homo sapiens
ttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccac

SEQ ID NO: 10613 - DNA, 29053 bp, Homo sapiens
cccttccagaacccaacatcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacggtgaggggccgcttgcaggcgggagggtggggtcccctatgtccaggggactggagccatgagggacagattcccagtgacaaggcctttggcctctgtggacccttggcagtcacatgtttaattataataggaagcattttttaataattaagaaaattaacttcaggccaggtgcggtggctcacgcctgtaatcccagcactttgggaggccaaggtgggtggatcacttgaggtcaggagttcaagaccagcctggccaacatggaaaaaccccatctctactaaaaattcaaaaattagccaggtgtggtggagcatgcccatcatagtcccagctacttgggaggctgaggaaggagaatcgcttgaacccaggaggcagaggttgcactgagctgagattgcgccactgcactgtgcagcctgggtgacagagcaagactctgtcccccccccacaaaaaaaaaaagaaaagaaaagaaaaaagaaaaattaacttcaaagcatttaatttacttttgtaaaaattgcaaaatacatgcttgtaaagtcttcaaatagtatacaagtatataacataaaattaaatgaaaattcccttcccccaggcccactctccaggtgaaaccccattgtagccccccatgttgtcttaatgcctgtcttgcatgtggtgaatggggaccagagtcaccatgtgaggggctggcctcttgtggtggacagccccgtcctgggggggcctttcctgggagaccccctgagttccgagatagaactttgtggggacacagagcccatgggctgggtagctgagcagagattccaccgggctcagccctctgtgggtgacttggaggccctcttgcccagctggagtttggatgggattaggggtactagggagccccttcccagccctatgaggtgtgcagcaagacctctctctggttcctgggctgactcaacagcagaagaagccttaaagccactatggggtgccattgcctctcccacctgctgatccctgtgaacacccagcactctgggttttaggggatttctcctgagggtcgaggggcttggcagcctctggtgtccagatgccaagggcctggcccctgtccaccccctgcagaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtgagagctgttggagccgtgggggcgggggcagtgttcctggagggaggctggtgctgaggggccccggggcccagggtgagatactgccccctcccctacctagtgtagccttttggtgggggagggtctgcactcccgagggaccctggagggggcctgaaggagagggctgtcgtggtggcaggtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggtgagccggggcctgatgcctgctcgtgcctctggagggcccgggccctttccgcttgtgggttggggagagggcgatggggagcgggggaggctggggctggggatcccctgttcagtgtccctccttgctgtcaggcctcctcactgggtacagctccaccctgtggatcggcttgaatgacttggacacgagcggaggctggcagtggtcggacaactcgcccctcaagtacctcaactgggagagtggtgaggcacaaggttgggggcgcagggcagcataggggccccgcgggctcttggcctcccatggactcctctcctcatgtcctcctgcagaggggcagtgtgggtaggggaagcaccgacctccacccccctccccagactgcgcccccctagcccatgtagggcggcgctgccccaggccgaaggtcttggtgcatatggactgggtgccagcctccactcacctcttcagccacccctgtgggcagcgggcaccagcgcacccagcagcctggacggggaggccggggcggggctggtactggttactgggtagaaggttcaaggcgacgtgcacccaggttagaaagcgcggaggaccccgtggtctggggcggagctggagctgagcaccaggcttcccgaactggctcaggcttccgagggagcagagggaggtaggaggttctgagcagggccccgggagccacggtgtgagcttctctctccgggggtgctggcgccctgccctccccacagaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccaggtgagccagggactgtgccgcagggtggggaggggctcccagggccagggacacagccacagagccgtggcaggcccagcctctcctccggttaccaccacagcacaaggggactctggatcctctgactcttatttcattgttcagttaaagtctgagcaaattggaatatgtcattaattcatttggggaacatgtgctgagatctgtgttaaatgctggcaatacccactgttacctcgtagagaccacagtctgctggaggtgacagacatctcaatgcagttagactatcccaggtcatgagtgattatagaaatatggatcagtgttagaggagcatagagaagaaactgattcagcttctgagagttaaggaggggtttatggaaataacatttgatttgggcctttcaaattgagtctaagtttaaaagatataaagaggtgtgggggaagggcattcctggcagagggaagagcatatgcaaaggtgtggaggcctagaactacactgcagctttaaggggtggtgagtgatggccgggcaccgtggctcacacctataatcccagcactttgggaggccaaggcaggaggattgcttgagctcagtagttcaagaccagcctgggcaacatagcgagaccctgtctctgcaaaatatttttaaaaaattagctgagtgtggtgatgcacgcctgtctactagggaggtcgaggtgggaggattgcttgagcctgcaaggttgaggctgcagtgagcctcgcttgcaccactgcactccaacctgggcaacagagcgagacgagaccctgcctcaaaaaataaataaataaataaataaataaatttaaaaaaaaaaagaaaaaagaaagaaaaagaaaaaaatggatggtgcctgttgcagtttgggtggagtatagattctaaccacttcaagtatggtcatccaaccagcagcacagcatccccagagggcttgttagaaatgcacagtcaggcccgccccagagtaattgaatcagaacctgcatttaacaagatcctcagatgattcatgtgcagacacagtttgggaagccctggcttaaagggcatggtgaagaagaggcaggttgcagccagtctctgcagggtcttggctgctgggccaagtttgggtggggccaggtaggctgtggggagcctttgaagatgtttaagccagggagtgtctggttctcgtttgtgatcatagagacagctttaggggcctcgtggaggagttggggcaatggacagggtctgctttagggattctgccccttactgctgtgtggccctgggcaagcagcttagtctctggggtgcagagtcctcattgcaaatggagaatgaagccaccccccttgcaaggttgttgtgaggaaggctggagatctggcctggcacgaaggagtttttctgtagttggctgtggatgtttactgtggtgtaggttggaggggctgtgcagtttcctgcgaagctgtggggtggtgaggagacttttacaaagaaaatatggcaacacacacacacacacacacacacacacacacacacacacaacactaactacagacagtaaagagtttacagagcaaaacttctgctcctgaccatggaagtcttgccaatgatcgactcaggactggtttttttgtttgtttgtttgagacagggtctcactctgtcacccaggctggagtgtagtggtgcgatcttggctcaccacaacctctgcctcctaggctcaagagattctcgtgcctcagcctcctgagtagctgggattacaggcgggcatcactacttcccggctaacttttgtatttttagtagagacggggtttcaccatgttggccaggctggtcttgaactcctgacctcaggtgatctgcccacctcggcctcccaaagtgctgggattacaggcgtgagccaccgcaccccgcctttttatttttatttttatttatttattttttgaaacagagtctcgctctgtcgcccaggctggagtgcagtggcacaatctccactcactgcaacctccgcctcccaggttcaagcgattctcatctccaggttcaagcgattctcatgctccagcctcccgagtagctgggattataggcatgagtgtgccaccacgcccggctaatttttttgtatttttagagatggggtttcaccatgttgcccaggctggtctcgaactcctgtcttcaagtgattcacccgcctcggcctcccaaagtgctggaattacaggcgtgagccacggctctggcctgattcaggactgctgaccactgctttatctcccattccgtaaggggccaggagcagaagcttgaaacgtcagcaacccgatctagggcacctccacctctagctggagggagccttgggccctagtccagtcctcccacaagcacctttctgaaggaaggggcccgctgggaggcccgggtgtgggcatgcctagcctatctgtggccccttaccaagtcctctgtcctctgggtcttcccggacctgcagacagatgtaaggcctcggatttccgcccctctgcccagcccatatctctctgcacgaggcatattctaggcaggttctgctttcccggtctcatcacttaagtcctgtcatttcgaaggcaggcgccccgtcgtgtccccaaagcatccacatttcccaagctcccttccggtccttgaggcccctcgggtctcagcagccactaaaatccgcttgtctggggcggcagcctcaggtcttagctcattggctaacaagagatgattgacaggtcctgagccagagagcgagcccaccgggctctcagtccgcccagctttgccgggtctccaggagcaggtgtggctggaccactggaatcccagtctgaggccgtgttctagtgggcgcgcagtttcctgcccgactaggcagaatcctgcccgagcatgacactgtgggtggtttggtgaagtcctgttttctcttgccaagaccaagtaagggcttgtttgcctcagctgccctcggatcccaacccctagaaggtgaacctgaaaggcatggaaatcggggcaagggagggcctgggacgggtggatttctcagccctggggttcagggttaggagttaggagcggggaaggagtcccagctgggggatggggccgatctgtagtgactttgagcacctcctaatgttctcggttgcccgtccaccaagacctcagattcctggtgggcttgcctgggccccattagtggctcaaggtcccgtttcccagttttctccctcctgggcttcccagacctgcacagagtgggtgctcaataaatgttatttgagagaataacagtgattccatttactaggcagggggccataagccaagcttgaatctcatagcaggaaaccccatttacagagggagaaactgaggttcatggggctggtttgtcctttctacccatcgtttattgactgattgattgatgcattgattgagataaggtcttgctgtgtcgcccaggctggagtttagtggtgcaatcatggctcactgcagccttgacctccccgggtcaagtgatcctcccacctcagcctcctgagtagcgggaccacaggcgcacatcaccatgcctggctaattttttattttttatagagatggggtctcccctttgttgcccagtctgttcttgaactactgggctcaagcaatcctccagccttagccttccaaagtgctgggattacaggcctgagccaccatgcctggcccacccatcgtattctgagagccacagccagaggaagtgttctgtcctgggtggaatctgccaccacgacttgggtctctgtcccggggctccagcagccctgtaaagttttgtgtttttttagcatttccaagacctgtggtggggaccgggattgatctgggagagtttggagaggaggtgactgggaggccttgcctgtgttgacgtcaacccagtgggttggttcccagactgggcggctcagtccctgagcagcagcctcatgggtctctgcagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaaggtgaggagctgcccgcccacgtgtctgggtggagggcagggcctcccactgccccacccatcctgtccaggagcctcagagaatgttccttcctccctactggtggctgaggctgacctctcaatgttttctctcccctcctctcctgctgcacccccagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggtgagatctccctctccctatcacagggccacaaaatacacccccaacctccaggtgccaccccagctgaaggacatcctagttactatcagaacctgcctggaacctcttacctctcagcagtccccctcctccccaccaatgccttcccttccatgtgagagactgccggggcttgaatcctacctccacctccacctccaagtagccaagtcaccttgggcaagttactagagggtcactggggagatcagaggagttaattctcgtgaaaccttaggcacagtgcctggcgcattcttggtctcctcccagctgcccttccctgccagaaggtggcatcagaacccacattatgtgcagatactttgcaagcagggctgcactctgccagccctcgcccccagtgctctacccagtccagggtcctgtcatctcaagagattgttgggttttatgacaatttgccatggtttgggcttagatgtggtgtaagtgaaggaattgatggagggcttcaagcagagatgaaagacccttaaaaaagggacaaagccagctgagtgtggtggctcatgcctataatcccagcacattgggaggctgaggcaggcggatcacttgaggtgaggagttcgagaccagcctggccaacatggtgaaaccccatctctactaaaaatacaaaaattagccaggcgtggtggcagatgcctgtaatcccagctactccagaggctgaggcaagagaatcgcttgaacctggaaggcagaggctgcagtgagctgagattgcaccactgcactccagcctgggtgacagagcaagaccctgtctcaaaaaaaaaaaaaataaaataaaaaggagaaagccgtagggacacagaccacccttcctagggacagacaggatgttctgctgtcacatactgcaaacagtgctgtggactgtagtggcagtcatttgccttaggggatgctatttaagaattttaaaacaattatgtattgagtatctaccatgtgccagtcatttttctgggtgctaggatacacaaacacgcctgccctcagaatggagcttagagacagacatactgctggctgggggcctgtggatactggggagggcgaagacagaagcaggggccgaggactaaattcctcctcagcttcatcagctgagattctggtctgggcacactggcctctgcacactctggccctgcaggcactagctagacgccttgggaatccaagctgtctatcctgccatcagttactctaacaatcttagccagtttgtttttgatatttataaaacgagttatcaataatgtaaaaggacgcctttcctttttttttttttttttgagatggagtttcaccctgtcgcccaggctggagtgcaatggcacgatcttggctcactggaacctctgcctcccaggttcaagcgattcttctgcctgagcctcccaaatagctgggattacaggcatgcaccaccacaaccggctaactttttgtattttcagtagagatggggtttcaccatgttggccaggctggtcttgaactcttgacctcaagtgatccgcccacctcggcctcccaaaatgctgggattacaggcatgagccaccgcgccgggccaggatgcctttcccatttagacaatgcttgttaagtttcaaggcgtttgcacatgaactgcttgtgctctcatccaccctgtgaggcttatgggttcatcccgccttccccattgcacagctgggacacagacatgtcagaatcacacagtaagtcagagacagggccagctctaggaaccagattccaagaaggatttgggagatttatggggaggtgggggttgagattcttcctcaccctgtgtccgtaggaaggccgctggaacgacagtccctgtaaccagtccttgccatccatctgcaagaaggcaggccagctgagccagggggccgccgaggaggaccatggctgccggaaggtgagggtgtttctggagctgccctgagtggggccacctgtcagaggggctaccaggggagggagaggtggatgaactcctgctgcctcgcatggcatcgccctctcgtcggcacccccttccctgagctctccaaactgctcctttattgaaggagtgatactggatgggatgggacgggtgggcgctgttgggaggaagcagagctccccacccccagcccagtcctgagtccctccccatgggggaagccacttcctcgagacagcagagaacagggaggtgggggctggtctacccccgagtgccccctcagagtccagcctagtcatgtcaagcagtggctgccgaagtgaagtgtggcccctgtgcaccgccagtcctgacttccccctcctctgccgtctgacacagggcgtgtgctggtctgtctcccctggaggagtgaggccactcagggtggggctgcaccttccccctccttgtgttcccagccccagtgggcttctagaggatgtttagggaggttgagggggggggtgtcaaggaatgaaagctgtgtaagtgagtggggggtgagtgactgagggtgtgagggggtgacagaccctctcctcctccagggagtggagcaggggtgcaaatgctgtgatgggtgcggggagcttgcttctaaaagacactgcttggcccttggccccccccagcagccccttgcagccaggctggctcctcactctgttttcctttggattaagcccctaccacacccacctggaccccaaagcctcccccagaaaatgagcaggaaacactaacaggcatggccccatgggcgaggaagcagaggggagagcagagcccagctgcggagtctgtggactggcaaggacagtgcctggcccaggggctgtgtcatggctgcgaagaggtgaagggaggagtagagaggaattaccaacttctctggcaccaaggccagcctggaatttgtgtggggagtgttgagggtccatggttaacagcccaggatcaccaggggtcttggcacagcccctgccagcagatgaggcccccaccacacataccacatctgcttctcttctgccttggctcctgccagcctcgcctgccagggtctcgtctctgagcccctcctgccatccccgggccaggagcatcctgcgccgactccagctttgccaggccctcgaggactgcccatcccctctccatcctggcagctctccccagcctttagctgtggtttcccagccaacagtaatttccccactgtgtctcttggtttaaatgcccaagagaggagcctgaagggccattcatcttcccgagccgggtcactggccggtcgctggtggcctgccaatcagccacgctggggctgggcctccaccccagcttccacagctgtgggtgatggtggagggggaatgtggagaaacgaggtgcagaacacagcccagtactcaaaccagtcccctccgtcctgagcacgttcagtgatgtccctgatggcatctcccaccacaggatttatgggtgagggtggagagtcatcttccctacagacacccctcttctgtccactcttgagccagggttggacgtggcacagcccatcctgctactggctgggagaagaccaagtgacctacagtgaggcccggcgcctgtgcactgaccatggctctcagctggtcaccatcaccaacaggtacagcaggggcgggtgccctgactagcccttgcccatgtctgggcctattgtggtcccttcagcaaacagggtagcatctgccatcatgcccagagggacctggagtcctgtgaacctcagtgggctccagggcattttaaaatcttgtcagaagaatgactctcacttgttaagtgaccccagtgtagggcagggcccgggcaggcacaggtgtgggctggatacttgagaaagagaggccttggttgtgtctgattttctctactttcttctcagcaaagcaaggggtgcagagaatagaaggggcagctgggggttccataaatcagctgcagggctcccaggcgtccctgctttcttgagcaagttattggtcgggtgcagcacccgagctcccacggtagggcgtctggcctgtgactgggggattgggaagcagggagatccctgccctgaccagcctgtctcctgaaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccggtgagccccttatttgacttgccttggtgaagcgaggagggaggccagggtggactggccctgccagcaccgagccccagggcttccccataaacagatcattggtgcactgtggtgtagtgtctatgagcacaagctctgaaaccaaactgcctggctccgatcatgactctgccatcttttagctgtgcatcctctgagcctcagttttctcatctgtccagtgggaataatgatcctttcctcatagggatgacatgagtcttaaatatgtgtaaagtgctaatatgtgtaaagagttaatgtgtgtaaagtgtctagattacttctctatctgggctcacaaaaaagaaacaaataatctcttctctatctggactcatttaaaaaatgtgttcagaatactgagcgcaatacaagtgcttgttattactattattaccatttcacattcattatctttctaaccccttcaataacctgatgaggtagatgatgaagcaggctcggtgaggttaagcagcttgcctgagccctcacagtgggtgaacccagagccagggctctgcctccattcccttcctccctcctggctccaaccccagagagcatgtctctgaagaggtggccaagctggttcccagtgtgagggccgtgctagtgccctgccgggatgtgagggaggaccagactatgaatccttctcagagcctgggtctcccttccctctccttcagggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtagggcagcctgttggccgggtagggggcagggggaggacaggagcaaagagacagtttggatggaggtcccagtgggaccagccacaatccagagacacaccaggctgcagacgggtgatttctggtgagacttgtccatggaatctggaggcctggtgctcagtaatcatttgaggaattgagggaaccacagatcattgatttcagaggttcccaaatgttggggccagcctagctgttcttcagaattgcttggggaacctgataaaaataaaatcttggccgggcgcagtggctcacacctgtaatcccagcactttgggaggtcaaggcgggtggatcacgaggtcaggagatcgagaccatcctggctaacatggtgaaaccccatctctactaaaatacaaaaaattagccaggtgtggtggcaggcgcctgttgtcccagctactcgggaggctgaggcaggagaatggcatgaacccaggaggcggagcttgcagtgagccgagatcgtgccactgcacgccagcctgggtgacagagcgagactccgtctcaaaaataaataaataaataaataaagataaaaatctaggctgtcacaatggagatttagattcattaggtctggattgggcctggtaatctgtatttttaatcacgctaggtttgggagccactggcagagtccgaggtcttttattatgcacagaaactgaagtctagggagaagaagggacttacccacgttaagctgtggctctgctgggattagagcccagatctccctgctggtcaggggatggggctcaggggccctctccagaaggtgactgtgccagctcccctccccagacctctgcagatgaacaggattgtccttagctagccttagccccctgtccagtaaggctccaggcccctcctctgccatggtgggaaaggcagtaggtgccccctgaggggtgggccagtggggacagcttagacagctggactctgcccctgcaggtgttcagctcagagcggctgcaggacaagaagagctgggtccaggcccagggggcctgccaggagctgggggcccagctgctgagcctggccagctacgaggaggagcactttgtggccaacatgctcaacaagatcttcgggtactgagccgggctgaggcgtgttaggagggcacccgcacacgtgtaggagcaggcatggccgacagacccttggttttgttgggcgagcagggggatggcagaatgtgggtgaccccagggaggcctgcatctgctgctggtgccaggaccatcttgtcctcactcaagtagccatggtgccctggcatcttgggagaacaggctggtgtgatccatgcactcataggagactgtgttttgctcaccatcatccccccagcaatgctccaacagacccacaaacttacatatgtaccccccaccccattgcaaaatctcccacatgctggtcctggcaagtgtttcccctcaccttacaccatcctacaatgacccacactcctcaatccacagtttttcctgagagataggaggagaaaggccgcagctatgaggatttgcccatgggcctccctctgagacaccacctctgtcctgggctctgagcattagcacgtggaatcccctagcactgggaaaatcgagatggatctgggcttcctgatagcttaattgaagggatctctcctctcagcaaacattgaaattacattatttgtctcataattacaatagctcatggtcatcacttctcaccacgtaccaggcactgtgctaaacatatagtcctcactcaagcctcccgacaaccctatggagcagacgttaacccctgacccttgtgggttgatagagaggttatttgcccaagttcatgggtgaacggatacttgaatccaggtttatttaactccagagccgtagatccctgccacctcctcatctgaacttcctaaactccgtaaagtaaaagcctgcagaatcttgctggacagggcacccccacccaaaaggaacccaaacaaaggggaggggccactgccccttgagtggatggcttggtccagctctccccagctctgtcttgtggggagaactttaccgaagtgacctcaacgctgtatcgatgggtcaatgtgaagcccagatggagaggccccaggccctgggggctgccccggtcacagctgcaagggacagggggcacgtttgggttcctgcccctctcacttcccatctcttccgtccccactcctgggttgtgctgaagtgaatcagaacccgagatccacgagcagcactggttctggatcggcctgaaccgtcgggatcccagagggggtcagagttggcgctggagcgacggcgtaggggtgagggggcctggggtacttgggactgcgaggccgggagcttggtgggcggggcctgtttggggcggggcctggaggtgggcgggttttcttgagggccgggcccccagtcggagccggcttcaggaaagcaggtccgagaggggtcacccggcccccggtgagaattcgcagctcaggccaggcctcttgttcacctgttccgggcatgggggcggcctgcaccttgcgcctcacgttcctcttccctccacccgcctcctccagttctcttaccacaatttcgaccggagccggcacgacgacgacgacatccgaggctgtgcggtgctggacctggcctccctgcagtgggtggccatgcagtgcgacacacagctggactggatctgcaagatccccagaggttggccggagtggcgctgggggacgcgggatggagcgaagggtggcggggccaggaattccagggagggtctcctttcctcacaacgtctttgtccttgttcccctaggtacggacgtgcgggagcccgacgacagccctcaaggtgagcaccccccagcccatcccgctacccatcgcgtgggagagggcgtcaactctggggtaagtcccgagaggcctgaatgaaatggaggggatgaggagttccggtcgagagaagggggacggggttggctcggacggaggcagccacagccctgtttgcttccgtgtgggaggcgaggcaagcctggggcctggggcctggcacggtgcctgcctgggtccggtgtgcctgcaggctcgcctgctgccgcctggctctgccccggccctgccgcgcccgcctccggggcctggcgtgcagcctctgcctggccgccgctcccacgcccgcgctgctcctgcaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaaggtgggcattggattgagcagggggctgcaggctgggggagggcaggcccgggatgagggcagggggctgcctacccacacctgcccgcctggcttctccagttctcccgggcccaggagcagcactggtggatcggcctgcacacctctgagagcgatgggcgcttcaggtaggaacccaggcaggcagcagatgtggaagggggctggctgtccacacacggagcacagaggcagacttgcatttgaatccagccctgccccttccttgctggctgtgtggccttgagcaagatacttaacctttctgggccttggttttctcatctgaaaatgggaatatgaggcctgcctggtaagatttttgtgaagattagaaataacatatgcgaagtgcttacgcagcatccagcacattagttactaaataatggcagctcctgttacgtctggtgtcattcatcatgactaaggccctctcggggaagtgggcagaacatatgatgatccgggggcctctttgtatttggtgcctacttaccatgtactggggggcttgaggcaggaaggaccaggagcacctgggactcagaatttgagcttgtctttttgcccttgggcttcctgccctggagtcctcaggcttcttttctggagcagcaagtgtccagggacagctggggccttatctagaggcaccaggtccttgggtctttgactgccctgagctcagtagctccacccctcagcctacagccactaaaccccagaacctgggcccttccctgcccccattcctgcggccttcattgctgcatccggtggaggcccagctgggggccggtgctggagttacctctgctccatgccattgcagatggacagatggttccattataaacttcatctcctgggcaccaggcaaacctcggcctgtcggcaaggacaagaagtgcgtgtacatgacagccagccgaggtgagggcaaggtgggggcagagtgcgcagtcagctgtgcagagggttgatgctgggcgagcctgggcagaagtcatcagtctgttctcattctctttgttcccacaacccaataaaggctagactcagcgaggggtggacctgtctccatggtccagaagacttgaattcggagctggacacaggccctgagcctctgcccagactcctctcagggcatgaggctgagtgtgctgccagccatgccctgccctgctctgccctgggggtgactgccctcccctcccctttccgcagaggactggggggaccagaggtgcctgacagccttgccctacatctgcaagcgcagcaacgtcaccaaagaaacgcagcccccagacctgccaactacagccctggggggctgcccctctgactggatccagttcctcaacaaggtaggaggtggcaatggggcacccaagggagtcaggggagaggacgtgaacagggaaaggctgagcctcaggagtcctggccttttggcagcaccaaactcatggcctcttgcctgtacccaccaacttctctttcacctggctccagtaccagggccagactccttggaaaatgactcactgtagtagcaccttccaatcctccgggaagcacggttgtccaaataatttggtgagtgttctagatcagtgattgccaaagattttttttttttttttttgagaaggagtttcactcttgtcacccaggctggagtgcagtggcgcgatctcggctcactgcaacctctgcttcctgggttcaaccaattctcttgcctcagcctcccgagtagctgggattacaggcacctgccaccacccctggctaatttttgtatttttagtagagatggggtttcaccatgttggccaggctagtctcgaacccctgaactcaggtgatcacctgccttggcctcccaaagtgctgggattacagatgtgagccaccgcgcccggcctgattgccggcctgattatcaaagattttgataatgaactcctattagtaaaacaaaatattgagcttacatgaccaaactatgtgtgtgtacatttaacttatatatgtatatgtgtgtgtaaataaaacctacttccatactaatatgactaatattatatatagtaaaatatgtataagaacaaaagagtataaaacattagctaaagatttttaaatacttttaagtttaaaacatttttttggctgcgcgtggtgggtcatgcctgtaatcccagccctttgggaggctgaggcgggtgaatcacctgagattaggagttcgagaccagcctgaccaacatggagaaaccccatctctactaaaaatacaaaattagctgagtgtggtggcacatgcctgtaatcccagctactcgggaggatgaggcaggagaattgcttgaatcctggaggcggaagttgcggtgagtcaagatcgtgccattgcactccagcctgggcaacaaaagcgaaactccgtctcaaaaaaataaacaaagaaaaaaaaaacaacaaaaaaaacaccttttttttttttttttttttttactagtggtatgaaaacatttttttgtgctcactcaaaagtgattaattggctgggagaggtggctcacacctgtaatcccagcactttgggaggctgaggcaggaggatgacttgagcccaggagttcgagaccagtctggacaacatggagagaccatgtctctacaaaaaataggaaaattaaccaggtgtgatggtgcacacttgtagttccagctacccaggaggtgggaagtgggaggatctcctgaacccaggaggtagaggcttcaatgagccatggtcatgccactgtataccaccctgggtaatggagtgagaccctttctccaaaaaaaaaaaagatcaattataataattattgtttaatatgctcactttggcagcacatgtacaaaaagtgaaacaatacagagaagattagcatggccctgcacaaggatgctatgcaaattcctgaagggtccatattttgcgtagttcatgaaagttgaaggttgttcaacaaaaaaattgtctaaataattttaataagagcaatgtgattacatgtacttcacgtttttaaaaaattttagtctgacactttatgactcatgactcacaggtctaacgtgttgaaaatcaaagttatttcaaaacatgcatttcatggtggctatagattaaatatgcctcacaaagacaaatagattgaagtgaaaaaagttcatccatcatttctaaataattctccccatttttagtccttctaccaattaaacaaacatttttgtttaaaaattggctagtaggctgggacgctgagcactgggaggatcacttgaagccaggagttcgagaccagcctgggcaatgtagcaagaccctatctagaaaattctttttccaagtgttttgagtgtgcaggtaggaaagtttggggcactgacattaatcactatggatgcatttctcaacacgtttttacaacaccccctccatagtgtgagtttcttccccacagtcgttatttttccatgcacaggctgatttattagacctgattagtccttcattgtttttacctggcgattgacaacgagttcataccaggaagagaaggttgtcattttccttgttatgtgccagggtaattggcattaatctcaagccatggcttctttgcaggacattttaagaacacttagccctgttgtgaagattagattagttaacactgaataatataatccacaaatccttgtcatacacaggaaggcagccagcctcttagtgtcatggatctcctgccctcctcagaatattcaaaagaacattacacggccaggcgctgtggctcatgcctataatcccagcactttgggaggccgaggcgggtggatcacctgagatcaggagtttgagaccaaccagggcaacatcgcaaaaccctgtctctactaaaaatacaaaaaattatctgggcatggtggtggacgcctgtaatctcacctactcgggaggctgaggcagcagaatcgcttgaacctgggaggcagaggttgcagtgagctgagatcgagccactgcactccagcctgggcgagagattgagactctctctcaaaacaaaacaaaacaaaaaccacaaaaaaaaaaattacacctcttctaccttaaaaaattaaggcatgtatattattaaaactttggaaaatacagaagagaaaccaaaactcacccaacactctctagagatcacagctatcaatatttgttattctccttcctgcctttttccatggaattgagctcatactaaataatataatttcctacccaactcttctttctctgtatcatattttgagcatctctcatgttataaagtttttccaaaaacttgttctttttccatccactttttaaacagaatgtattttatatatgtaataggtcccattcttaatcatcattgtcaagataccagttactctcctgccctgtggaaagttctgtttgtttttgtttttgagacagggtcttgctctgtctcaaaaactgctggagtatggtggtaccatcatggcttacttactgcagcctcgacctcctaggcttaagtgatcctcctgcctcagcctcctgagtagctggcactacaggcttatgccaccatgcccagctaatttttctattttttttgtagaaatggggttttgccatgttgtccaggctggttttgaacttctgggctcaagcgatcctcctgccttggccttccaaagggcagggattacaggtgtgcgccactgtgcctggcctgtggaaagctctggaagtatgctagggtgttcactccttcactgcctgccctcacacatcttgctttactagttctgtgcccttctttgtgtccctatagcatttggatgtaggtaaagcatttatggcagctgtccccaacctttttggcaccagggactggtttcttggaagacaatttttccatgtactaggggaggggagggatggttttgggatgaaactgttccacctcagatcatcaggcattagattctcataaggagcacgcaacctagatcccttgcatgtgcaattcacggtagggttcgcactcctatgagaatcttggctgggcgcggtggctcagcctataatcccagcactttgggaggcctaggtgggcagattacctgaggtcaggagtttgaaaccagcctggccaacatggtgaaaccctgtctctactaaaaatacaaaaattagccaggtgtggtggtgggcgcctgtaatcccagctactcgggaggctgaggcaggagaatagcttgaacctgggaggcggaggttgcagtgagctgagattgcgccattgcactccagcctgggcaacaaagcaagactccatctcaacaacaacaacaacaacaacaacaacaaagaatctaatgccctgctgatccaacaggaggtggagctcaggctgtaatgccccttcgcccctctgctcacctcctaagaggccggggacccctggtttgtgggacagcctcttccactagctttaagctcctggagggcagggccactagcacctgccataccccttaatacacttgcacgtggcagggatgccctcagtgtcggctggactgagctgaataccctccccctttagctgtcacttcttgctggtactggtgtgaccttgctgcttccaagtttatgatgaattctactcatgatttaagttgggcctcagcatggctctgaaactacttctgtgaaaccaaatccttgaactttgtgacagacctccaaaaatctgcattatttctgggcttacaattttttaccccaaatctgccatctgcatcagtaaggatggtgctggagctaattattaatagtcacagctctcactggttaagtgcctactgtgtcatgtactgttatctttaatccttaaaatgatccccaaagacaggctttgtattaccactttacagaagagtaaattgaggccataaggttgtcagagctggaatctgacatctcccccttacctgaatcccacccctgtctttatgactccaaagcttccctacaccctttctttttttttcttttgagacagagtttcgctcttgttgcccaggctggagtgtaatggcgtgatctcagctcactgcaacctccgcctcctgggttcaagcgattctcctgcctcagcctcccaagtagctgggattacaggcatgtgccaccacgcctggctaattttatatttttagtagagatggggtttctccatgttggtcaggctggtctcgaactccagacctcaggtgatccacccgccttggcctcccaaagtgctgggattacaggtgtgagccaccgtgcctggccaacaccctttattttccatcacactgcctctgagcagaaaatcattagatattcattttcctaagaaagagtcttcacttgatgagagatttcctacccagggcttttgtttgtttgtttgtttggaaaccttatagagctaatgaaagtgggaaaagagaaatggaaaattacagagttagaagctgctgctaatagatcattcaacaatagagataaaagtgtcctagggctgggcgcggtgaaaccccgtctctactaaaaatacaaaaaattagctgggcatggtggtgggcgcctgcagtcccagctactggggaggctgaggcaggagaatggtgtgaacccaggaggtggagcttgcagtgagccgagatggcgccactgcactccagcctgggagacagagcgagactctgtcttgaaaaaaaaaaaagtgtcctagagatgatcatgtaagttcaaagggcaagataatggatgtcagacaacattcggaagggtgtttagcagaaagcaagatagatccttgtccccatcttcctagtgcttggcctaggcactgttgtcatagcctttgacggcccaaagaaatcctcccatttgaagatcccctggagtgtgggcaggtgtgtgtgaatctgcagtgccaagctgggaggtgctggaggctgccaagcagacccagctgtcctggttctcagatactgttctctcccggccctcaaaggccccccaggacctgctgctgaggggcgcacagtggcctttctgggtttgtggatggggtggtggggctggccattacatccccacctctgccccacagtgttttcaggtccagggccaggaaccccagagccgggtgaagtggtcagaggcacagttctcctgtgaacagcaagaggcccagctggtcaccatcacaaaccccttagagcaaggtagggccagcctatggggagcccccagtatcctctgacactgtccccccaaatagctatagcagagtcactcacaactgtcttctggggaccatagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccggtgaggatgccctccctgttcccctccgcaccgcgctgccctaagcctgtggggctgcctttgccccagcatctcttgccccagggtctcccttcttccagcctctttgctcacattgcagccttctggggacagtagcacagggaggcagctgctggggctcccctgagcagctccctccccccagaccagctgtgcggtggtcctgcacagcccctcagcccacttcactggccgctgggacgatcggagctgcacggaggagacccatggcttcatctgccagaagggcacgggtatgtgtcaccagtcacctgggaaaccccagtggggccctggcaccgggctggatgctgggaccatgccaggaggaaggaatcatggtccctggcagagcagggctctgcttgggaagcagatgggcagaaaggcaaggtgccaataagatggaaaagcagtagcacccacaggtctcaggaggaagatttgggggtatggagggctcgttgggtcggggggagagctagacgctgggctgcatgaagtgctggcacgtgtggcgtcaaggaccctgaggttccaggtccaagacacctccagctccatgcgtaggtggcctctgcgccgggttccttgggtaggaggaggtcaaggccctcacctccctgtccatttgttagcaaacatgtattattaataacaacaggactgacacctaccaagccttggtctgggccaagcgccgagtctggtggagacctggtctttgcctggtgtgtggccttctcctggccttgtgcctgggaacggggtgagggaagcagagcccagcctgaaccctgaccccttccctgtagacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggaggtgggctcccgacacttttgccctgggcctcagccttgcccgggttcccctccctgccccttcctgcccccgccttatccgcaccctatcctgactattcccttcctcccaccccatggccccccatgcccagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtggtgagtgcccacctgccagggcgggggcatgggcaaggtgtcggtggccccggggagggtgctgagccacttcttaatcctgtacccccacagggccccctcctccccgaagaataagctaccatggcagctgtccccagggactggcagactccgcgtggattcccttccgggagcactgctattctttccacatggagctgctgctgggccacaaggaggcgcgacagcgctgccagagaggtgggtgaccaggccagagcccacacatggcgggcaggtggcacctcctctcgtgggcactcagacccatgagtacatccccacactgctctctacccataggcagcacttacacaagatgccctcgtgctctcacatgtggagaccatacatgacactatatgtgcatatgctgcccccccacacacttgcacatgtgcacacacacacacatgaatccacagactccacaccatcctctactcaggctgcagagaagagggctggagcagctctgggggactctgcccccccggagacccatccgccctgacgtgggccttctttgcatccagcgggtggggccgtcctgtctatcctggatgagatggagaatgtgtttgtctgggagcacctgcagagctatgagggccagagtcggggcgcctggctgggcatgaacttcaaccccaaaggtgggtgccctgtgtgtggggtggagaggtcaagcctcaggctgtaaggggctgccctccactttgccctgagccttgtcctggggcttgtcgggggacagggagtcggttctagaacacgcctgctctcctccacctactcctgccccaccttgtccctgctccctcagtgccttctttcctgcaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtggtgagcgccgggcaggcccacgctcagcctccttccaccccgtgccgctggtcctgggctggggctgggggctgcttcacaactgcagggggcacagccgatgggaaggcctgaacagaacggactgcgggcagctgggacccccgggataaattagtcagtgggatggactggacctgaaacttatcatccaaactagaccacaaggctcgggggtcagcaaccccctgtcactttgtagtggtcaagggcatggacagagttcaagtcctggccatgtcacttatcagtggtgtgaccttgggcagagtctgtggcctcagtttcctcgtatgtaaaatgggaataatagtagtcccagactgatgtggtggctcatgcctgtaatcccagcactttgggaggctgaggtgggcggatcacttgaggtcaggggttcaagaccagcctggccaacatggtgaaaccccgtctctaccaaaaagtacaaaaattagctgggcgtggtagcacatgcctgtagtcccagctacttaggaggctgaggcatgtgaattgcttcaaccgtggaggtggaggctgcagtgagccgagatcgcaccactgcattccagcctgggcaacacagcaagaccctgtctccaaaaaaaaaaaaaaaaaaaaaaagtcccgacctcctagagtgctagtgaagctagtaaagatgaggtgagttagggaaggggctgacacccaggcctcccacgagggctgggctgagacctagctgagtgcagcatggcgttttccctttctgggggaacctgaagtcttgtctcttgggcctgtgcccccacagtaaccagaggtaggatgggagggggaactagagcctctttctccccagacctcccggcccaggcctgtgtgctttgtatgtttacttaagtgattattacgatgatcactgctattattaactggccccctcctcttgcccacagctgagcagagcagcttctccccatcaggtgagtgaaaggcaatgcccccaggtgggcaggcaggaagcactgctgggcctaacgcccacttggcctttcacgcccactcgccttggcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 10614 - DNA, 333 bp, Homo sapiens
ccgggtggagttgggtttgctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgggtttgctttt

SEQ ID NO: 10615 - DNA, 5506 bp, Homo sapiens
gcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtacaaagattagtttcaatgtagtctgtagcctcctttgtaaaccaattaaaaagttttttaataaaaaa

SEQ ID NO: 10616 - DNA, 252 bp, Homo sapiens
ctctgtcgcccaggctggagtgcagtggcgcgatctcggctcactgcaagctccgcctcccgggtccacgccattctcctgcctcagcctctccgagtagctgggactacaggcgcccgccaccacgcccggctaattttttgtatttttagtagagacagggtttcaccgtggtcttgatctcctgacctcgtgatctgcccgccttggcctcccaaagtgctgggattacaagcgtgagccaccacgccc

SEQ ID NO: 10617 - DNA, 1112 bp, Homo sapiens
aggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctga

SEQ ID NO: 10618 - DNA, 2302 bp, Homo sapiens
gtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccgagtgcctgccacttgcctggccctgtacccagggcccatctgggagccattcctgctatagctgggaccacttgtgaaacggctagttgtgcctaacagacatgctcagattcacaaaatgaattcagaacacttacctgtcccacccgtgaaagtgaccttggaggtgtcattgccccccaccaccccagtttctagtccaagccaacagctggtgctagatagatgcttgatgaatgagcagatttgactgttagttactctgtacctaaaactcctatctttacatcaaagccctgacagatttgcccttgacagactgaaatccggggctgctgcagggttcacctccaggaggcaccattcacgacactgtcccataaatggtaatgggctcccagggatactgtttacatagactgcactgagaacggtgacccttaggtttgtacaatgaggtaccctgttgaatgaccctaaaccagcctccaaaatgtgcaggatcccacattggtcagcgccaaccctgagcacaggatctaaaactatagatgatatggccaccctggccacagctggaaccaagctggtggcccaagagagagcctcttcttggaattgcatgtcagtttctcatacgcagtttcttcctatttttcccatttcccgttttaaagctagtggcatacctcacagtcaaataaccaagtggtcagtgtctcgacaatgtgcagtaacgaggtgggggctgcaagggtgaggggctcagtcaccttaacaaggcaggagacctcccacaaaaggctgatgtgtcgtccccagggccagctggacaagggcatgcagcgcaggggtagggggatggaaatattttctctcccgtaaactctgacttcatgtgagcaggcatggggtctccctgagagctgataaccgggaaaaccaaaaccaataatattcctaataataatactagaatgtaagaataatcatgtgtttttcactgaccgctgttgctctgcttttgtctttatatacagtagtttttataacaatgtccctaggttttaataaaggagtgtcatgtcaactgttccctagat

SEQ ID NO: 10619 - DNA, 2586 bp, Homo sapiens
tctgaacgttgtgttcaatttttctgtaaacctaaaattcctcaaaaatgtaaagtttataaattttttaaaaagctacagaaaatgaagagaggctctttggacatgttcatgtcctccatagaaaataacataatcaaagaggaaaaaccagcattggtgaattcatcccttcctttcaacttggcctctctcacccactttacttttagtgcagagttcagtgatggctagcagctgtcccctgatatttgttattccaagtatccattcataggtctggggagagattgtggcaagctttccctaaataaatcacacccttatcttctaagcttgagcagtggagggagacttttcattcgaggtgggtggctgaacatcatcattcctgttctggacttcttgtaatcatgttggattcagagggcaccactctctcttgtacagatctgacctaacatagacatagactatagcagagatgaatccaggctataacatttaacaagaccttattaaaagcttcaagatgttagcctttatctgttccatatctagcttacttggttgtttttgggggatcacatgtctgtcctccaaactggaaacgtctaactctccaggagatgcagtagcattatttgttggacagtggcacctactggtagtttgtaatgtttatagcctagtgtgaaaggcattgtaaatgtatacctagcaaaaaggggagtagagcaaaatttccagagttttacaaatgaaatgaaaggatgatatgggggagagtcctttggggccaaggagagagagcacagactagaaagtaatacaagcagaaagaaggatgtcagcccatgtctgtgtggtagaggtcatctttccatctcactgggattgtccctgaaagtgtctcactgcttaggtctccttgcctgtctaaggcttggagaccttccagtatctcatgccttattctagatctgcttttttccccgaggtgaaaaaacctgttcaaatggtcactcacaacttttgtggccttactttttgtctccgaaaggacaaacatatcagaactaacatccacccagaagaagggctgatcagttcctttcaacacagcatggatgaaaacccaggttagcgttagtgcttcttgaattggaagtattctaacctctatgtacctaccaatgtaagaactgagggcccttttaagggaacttacattcctaaagttcaagtcaagttgtcatgaagagtacttaatgaggcatacttttaatctttgaatcgtagtgttgtagggctaaaagaaacctcaggccaggctgcatggtggctcacgcctgtaatcccagtactttgggagaccaaggcaggctgatcacctaaggccagtaatttgagaccagcccaaccaacctggtgaaaccctgtctccactaaaaatacaaaattagcctggtgtggtgatgcatgcgtgtaatcctaactactcgggaggctaaggcagaagaattgtttgaacccgggaggcggaggtttcagtgagctgagatcatgccattgtactccagcctgggtgacaggagccaaactccgtctcaaaaaaaaaaaaaaaaaaaaaaaaaattagccaggcgtggtggtaggcgcctgttgtcccagctgctggggaggctgaggcaggataattgcttgaacctgggaggcagaggttgcagtgagccgtgattgtgccactgcactccagcttgggtgacagagccagactgtctcaaaagaaaaaaagcaaaaaagaaaaaacagaaaagaaacctcagagatctgtcattttccacctattacattcattttatgatacagaaatggtcattcagttgcagatagtacatgactgttgggatcaggcccccaaatctggccataaactggcccccaaactggccataaacaaaatccctgcagcaccgtgacctgtttgtgatggccatgacacccatgctgaagtttgtgggtttaccggaatgagggcaaggaacacctggcccacccagggtggaaaaccgcttaaaggcgttcctgaaccacagacaatagcatgagcgatctgtgccttaagggcttgctcctgctgctgataactagccagacccatccctttatttcggcccatccctttgtttcccgtaaggaatacttttagttaatctatcatctatagaaagaatgcttatcactggcttgctgtcagtaaatatgtgggtgaatgtctgtttgaggctctcagctctgaaggccgtgagacccctgatttcccactccacactatatttctgtgtgtgtctttaattcctctagtgctgctgtgttaaggtctccgtgaccgagctggtcttagcacgtgacttttctcgggtgatagctttaatagtatcagcagagcagggaacagaatctagtttaatgtgtcctaatccagtggttttttttaaccacaaaatactgcctttgagaaaaggccaggccagcagagtcagaagttgagcctgggatttgcatagtcacaaggtctttctt

SEQ ID NO: 10620 - DNA, 323 bp, Homo sapiens
ttttgaaaatacttttgttggctgggcacagtggctcacgcctgtaatcctagcactttgggaggctgaggtgggtggatcacctgaggtcaggagttcaggaccatcctggccaacctggtgaaaccccgtctctactagtaatacaaaaattagctgggcatggtggcgtgtgcctgtagtcccagctactggggagcctgaggcaggagagtcgcttgaacccaggaggcggaggttgcggtgagcctagatcgcaccactgcattccagcctggtgacagagtgagactcttgtctcaaaaaaaaaaaaaaaaggaaaa

SEQ ID NO: 10621 - DNA, 406 bp, Homo sapiens
atgacatggaagttccatacagcccagagtaatttatcattagagactagctttacatttttaatttaatttctgataaattttatttaatttctgataaagtggggacagatacatgagttttaaaaagctacagacagattattagggcagtaaaactattctgtctgctactgtaatggtggacacatgatattatgcatttgtccaaacctgtagaactgtacagtctaaagagtgaacccttagcttgtgaagacaaaatggtattaataaatgaatacataaatatataaaataaagagtgaaccctaatgtaaactatggactttacttaataatgtatcaatattggtttatcagttgtaataaatgtgccacactaaggtaagatgttagtaatggg

SEQ ID NO: 10622 - DNA, 1231 bp, Homo sapiens
gtcactccaaaaagaaaccctgtacccactagcagtcacccatttcctccatccttccccatccccagccctaggcaaccatctgttttctgtctctacagatttgcctattcaagacatttcatataaatggaatcatacgatatgtggtcctttgtgactggtgtctctcacttaacatagcgtttttaagatccatccatgttgtagcatgtatcagtactacattccacttcattgtttaataataataataataatagttcattgtatgggaataccacgtttgtgactggcttctctcacttagcatagtgtttttaagatccatccatattgtagcattatcagtatacattccacttcattgtttgaataataataatacttcattgtgtgggtataccacatttatccatttatcagttgatggatatttgagctgtttccactttttagcaattatgaataatgcctcatctaacactttgattatactttttattatcatatgtgtggcttcaggtttttgtttggttggttggttttgcctgtgtctgtttttatcacttgattataaacttctggaaaaagatcattattttcactctgaaatttccatacagcaagtattcaataagtgtttggcagatggatgaatgggcagatattataggttcttaccatgttgattatgaagaagtacaaagtattcagaataaaaacactaagcacagtaataaaccaagggtgtgccagtaaatttacccagtaaattataactttcaaaaactgacggttcttaaataaactttaatctctgcactatttccgggaatttcacacatggttattacagttgattatttcagggaggcagttcctctgctaataatagttgtgaactggctggacagaggcctggaagacaccagactttctcttctgaattaactccacagtgttttgttgttgctcttggcctgaccgatgttactcttctagcctagagtagtggttctcagctctgactgagcatccaaatcccccatggagatttttcaaggcataattatctaaatcccactgcccagattatgattctgtcggctgagtaggggtctatgtgctcacatgttctaaaaactctagagacatttctgatgcatagccaggttcaagaataactatttcaaaagtcacccacaggttaaaaaaaaaaaaaaaaaaa

SEQ ID NO: 10623 - DNA, 1935 bp, Homo sapiens
gttcatttacactatattttcagcttcttgaaaaagggaggcagaaaacaaatgtggtttttccttgttgtcattttgcttcgaaagagtcacataatttaaaggaccatgttcattttctgtattcttgaaatcaaggaaaatgtcatggtgtttttaagacagggcagaaataaggtacaatatcctggtatagtgcttgttttccacatcttttaggtgggagctttaaaatcttaggtgaaacttaatcatcttggcatatttttctttctttcaaacttcctaaaaaacaaaagaaaaaaacaagcaaataaacaaacatggagaaacattcaacattttattcacaaatctccatgacttcagtcgtaaaggacagtctgttgtgtagtaaatttgggattttaaaatgttccattttggccaggcacggtggctcacgcctgcaatcccagcactttgggaggctgaggcaggtggatcacttgaggtcaggagtttgagaccagcccggccaacatggtgaaaccctgtctctacaaaaaatacaaaacaactagccatgcgtggtggtgggcgcctgtaatcccaactacttgggaggctgaggcaagagaatttcttgaaccagggaagcagaggttgcagtgagccgagatcgcaccactgcactccaacctgggcaacaagagcaaaactccatctcaaataaataaataaataaatataaataaaaatacaaaaattaggtgtggtggcatacgcctgtaatcccagctacttgggcggctgaggcaggagaattgcttgaaccagtgagccaagatcatgccactgcactccagcctgggcaacagagtgagaccctgtctcaaaagaaaaaaaaaaagatttcactcctatgtagttattttttctggaacaacactgagctaaggtgaggggcatgttattgatgggcatcctgagtacactctccagaatctacactcgttctttccatttgtcgccatgtagaagtcaggaatcctactttcaaatctcacatatgtcagttattagctacatgatcgtaggcaagtctcaacctctaagtgcatcaattttttaatccattaaaggaggaataatatgtatctcattagagtgacgcgaaggttagaaaagctgatgtgtggaaaaatacctgtagactaagcacatattagcactaggtacagcacatgttagaataatgagtgaatacgagaagtcagagataagtccaacccccattgcccttgggctgaaatccatgtattcatggattcatccatgtattttggctgggcattcagcatcctgggaaacccgctcctttctactctcctgccctttccccacaacggccctgctgtagtcagatattctccaaaacatcttaaatttgcccaccttcatgtctgtcattcccactagccacacttccatttgccaaaattctacccatccctcatgggccctgaatccaactctctccaggaatcctagggaactctcaccctctcctcctctgaaccctggtccttgctgtctgagcactctaggaggcataattcatgaaccgcttattgtctcagagactgcaggctcttgcaaggtagaggccacatagacaatatccatctctgtgcaccaccaccacacagactttggtgccttgccaagaatagatgcatgattgaatgaatgaacaatttctcaccctgcccctggctttgctcttggacaaaccactttgcctgtttcagtctcagttgcctcagctgtgaacagaggataaatgcacagatgtactccccaggtgtgctgtgaagaataaaccaatgactgaaaagcaatttgaaaatgtaaaaacaaatgctatatataaatgttacataatcaaaatca

SEQ ID NO: 10624 - DNA, 1129 bp, Homo sapiens
agggaagctatctgagcaagaggtaaatacttagtcattcggaatagtccataaatgacgactgcttcatcttcaacaaggggaggtctgattggaaagtgctcacagaatgattggattgcatttctgtcttcaatccacctttgattcacaatatacattcctttgttaaaaaattgaagaatgtctgtaatcaaacccttgttaacagatgtaaagagctacaatttgcttgctggacattatttcaacaaaagttttttcattcaaaataatttgtcaaaaaaggacccatgcccttacgtggtttcagatagtgtgctgtccaatttgtatgcttttccacctactcccccagggccatcagggggtacgtgagtttaatgattctacttcttaaccatttcttaaatctgcctccttggtcgggcgcagtggctcacacctgtaatcctaacactttgggaggcgggaggattgctttgaggtgggaggattgaggtgggaggattgcttgagcccaggagttcaagaccaccctgggcaacatagtgccctgactctactaaaaaaaaaaaatctgtctccttgtttcagtcctcacggcttttgcagtagtcgaaggcttcttcatctctcacctacacattgcaatgcctttgcctcctaaatggcctcccttactcactgctctcctatgccatcttctatctacctcatcaccacttctaattatccttccaaatcacaggtctgatcatccactcacagacctatcgtggctttccattgcctacaaaaatgaaaaccaaaccacagaacttagcatgacagtaaaagccctgcatctagcctccatctactgtatccttcatgcatcttaaactcttgtctattccagataacttgcccttgcatgaaagcaccctcactttgagtgtctctttgagcataccttccctcctttcatccacaccatcttacaaaaatcatcctttttgagtcagctcaaatatcatttcctccaggaaatttcccacgactttcttccaatccaaattaattaatctctctttcctccaagttcatacagctctatctatctatctatctatctatctatctatct

SEQ ID NO: 10625 - DNA, 16301 bp, Homo sapiens; identical to SEQ ID NO: 6450

SEQ ID NO: 10626 - DNA, 13862 bp, Homo sapiens; identical to SEQ ID NO: 9647

SEQ ID NO: 10627 - DNA, 13186 bp, Homo sapiens; identical to SEQ ID NO: 9648

SEQ ID NO: 10628 - DNA, 187 bp, Homo sapiens; identical to SEQ ID NO: 9649

SEQ ID NO: 10629 - DNA, 5172 bp, Homo sapiens
gaaaacgaattcccactgcctattttgagatctcactaacacttaaagggaaatctgatgaagtttgtaagaagctgtggtgtttctttctgtcaggttctgaagaaagtctccaaatacattcaagagcagaatgagaagatctatgctccacaaggcctcctcctgacagaccctattgagcgaggactgcgagttgtatctttttagttcggatcagaaagtctaaatatttataacaagaaaatgttgatattgtttggcattggctagagagaatttaactctcatcctgtatttgccctaggtagtttctgtgtgaattgcatacctactgtaaaccccgtgtctccaacatttttttttaaagcatgtccctccttccattgcatggtgcaggtctctgtggtttgtttactattcttgtcaccatctttcctggtggttctgagggcatcttgtagtaataatgggggtggtttgagtaatgcatttcagctgcagaaaccctgaacctgaagcccctttgaaatggataaactcataatgtgtggtgagacttgtcatccaaatgaattgcagtttcatgggtttatctgactagttgaaatcagttacagctgccagatgtgtaatttcattacctttgacatactgtgcatatttttagaggcagtaagctttgaaaatcactaagtgaatttggtaaataaaattgcaaaaaactaatttagcttgataactggagtaatgggtaaataaatttttttaaaaacctaggtcacataatcccaggccttccagctgataataatttcagcagttttgttatactctgcaacaatagttcttaaactttcaggggtcatgaaccctttcccaagaaaaaagttttcatataatttcagggtatttttaaatccctgaattcattacctccatggattctcagttaagaactccctagttcaacaaataaagcatcgttttcagaatttatttgttttgttttcaaaacataagttatcagtgtttgggaaggaactacatgtggactactataattacatttcttaaaattttcagcaaattggagaaagcaaacttaagtaggaaaaatgtttaataattgaaaaataaagcaaactgaaagcaaagtctgcagatcacaccctccaccttgccaagtccccctttgtgtgttgtgtcctgtagtgtgttttcttaacagccatgctgtttagattgaaattaccatttatgaagacagaggcatgagcagtggaagataaaccgaagaattaaaggtaaatatgaaatgatatggcttgtatgcagcttttgcaagtttagaggatgcatgaatattcttccccgcatggtaaataaatcattaaatcacgcagttaaataacagtatatttgctgtgttagcttaagctagtcactgtattagcttgatatttaaaatgtgtattcggcccaagttctatttggtgatagagaatttaattctgattttttttcctgctgtattgtgttcagactggttttgttgttactttggtgggggaatgggggatggcagttacttggcttgttttaatatttcaaaactatcctagacatataaatacttgggttttgcatataagaatgagttcagagatgtctacctatatgacaaatggctttaataagcaaaggaacatttcagaggggagtggggagattctgaatatttcatttattatgtttaagtggcttcagacccctgtggaagaaaccttacctactgagtagaaacataaatttcattcctttgtttaaagtattaatgtccttaaatatccagatgctgccctttaatgagtaagaaacaaattaatactactaagaatctctaggcagagtcacgttgaagccctaagtactttagcatagccttctaagtgacaggaagtagcacttcactatttctgccaattttagttacgtggtcttcctacagaaagtgttctgctgctgcgcttttctagttgactgtgcttataggtatctgtcactaattaatagacagcacagacacagaatgtaccaaagcagacacatgtcttcctagggcaacatcaataacagctaccattttgagggcacgtactatgtgcctggtattgtacaaatggtacttctgaatctcacaagaaccctacaaagtatttccccattttatagatgagcaaacttggatacaaatagattaaatgatgttctcacagtcacacagttaacgagtattgggatatgaacccaagtctgattgatcataaaacccctgtcttttacaccgtacttcctctcagtacttgcagcagcaggaacatggagaaagggaagagttcatcagataattctagaggtttatccccttctcttctttttcaatactttaaaaaagaatacattttgtctgctcctgtatgatttattcaatcctgtaagccatgcaacattccagagctgccttctttagcactagtgaatgtgtcacctgaattcctgaaagccaaagatctaaatcatgatatctatcctctgccatatgttgtatttccttaaaaaggctttgttttggaatacttagtgttacttgtccatacgctttctcatgtacaattttcaaactgatacttctcaaacaaccagcaaccttctgtgtggcttttgttccatgccatggtttgtatatcagttgcagctgcgatgacttggcacagcccatttgtcatgactcattttgcagctattgtgtaatcatgtgtttttctgatgtgtgaggtttgagcaattacacaccagaggctaatctatcaatattcaaataactagaattttgaaatgggaaagatttacattaataacttctggataccctctttcatgaatgcagatatttttgttcaacacaatttcgttttgggatttgggtgttcccaaggtccaggatgcaatgtgagctgagatcttagagaaggggaggaaactctaagcataatttattcaattcttccatttttcttcagtctgcaaggtgtctgcaatttgaagcaatatgtgggaattagtgacttaacaaaagactacacaaacatgaggatggcctttatttttaaaaggagctttaaacaaaaatgcctttctttaagcttaatttttataatatcttgcatatatctttattatcacattgttattgttacatgcactggtgttttctctctggattaagattgccatctttatataaaatggaatacatgattattccatcacaactagtgataataaaaacagctaatgtttgttggcacatctgtgccagcactattctaaatgcttaattttaatcatcacaacaaccctatgaggtagatattgttatccctgtttttcagatgaggaagccgaggcagagagaacttaagttgctggcccaaggacaaacagctagtagacagcagtcaaggcagcgtggctccatggtgatgtgcttggtcagagatctgaatatataggacttagatttgtagactattgagctgtagactcatttagacaaatggtaccaagatattttagtagataaaattctaggttagtagaacatagaccacatgttataagctgatatcagttgatggaagaaaaatggttttacaagttattttcaggatctctatcaaacctttacttctccctctaattacagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaagttgtc

SEQ ID NO: 10630 - DNA, 295 bp, Homo sapiens
gatacatgcattgcttcaggtaattagatgaaaaaaacaaatcttttatttagaaataatactcctaatttattacgtaagaaccatgcagattgctctttgaataatcttacgctcttttgaagaagcataaaacatgagatttttttatccccaaaaaatatttgaataaagtgtttaaattacttttcttcaattagaaaattctttatatgaaacaggtagagttttaaattctaaatcagtttataccaaagcatctaaattgtgacatcctaatttgttaagtttggtc

SEQ ID NO: 10631 - DNA, 1368 bp, Homo sapiens
ctctcttccccggacagcatgagcttcaccactccctccaccttctccaccaactaccagtccctgggctctgtccagccgcccagctatggcacctggccggtcagcagcgcagccagcatctatgcaggcactggggggcttgggatcccagatctccatgtcctgttctaccagtttctggggcggcttggggtctgggggcctggccacagagatggctgggggtctggcagaaatggggggcatccagaatgagaaggagaccatgcaaagcctgaacgaccacctggactacctggacagagtgaggaacctggagaccgagaactggaggctggagagcaaaatccaggagtatctggagaagagaccccatgtcagagactggggccattacttcaagaccatcaaggaactgagggctcagatcttcgcaaatactgtggacaatgtccacatcattctgcagatcgacaatgcccgtcttgctgctgatgacttcagagtcaagtatgagacaagagctggccatgcgccagtctgtggagagcaacatccatgggctctgcaaggtcattgatgacaccaatgtcactctgctgcagctggagacagagatgggcgctctcaaggaggagctgctcctcatgaagaagaaccatgaagaggaagtaaaaggcttgcaagtccagattgccaactctgggttggccgtggaggtagatgcccccaaatctcaagtcctcgccaaggtcatggcagacatcagggcccaataggatgagctgtctcagaagaactcagagaagctaggcaagtactggtctcagcagactgaggagagcaccacagtggtcaccacacactctgccaaggtcagagctgctgagatgacacggagctgagacgtacagtccagtgcttggagattgacctggactcaatgagaaatctgaagaccagcttgtagaacagcctgagggaggtggaggcccgctacgccctgcagatggagcagctcaacagaatcctgctgtacttggagtcaaagctggcacagaactgggcagagggccagcgcaaggtccaggagtacaaggacttgctgaacatcagggtcaagctggaggctgagatcgccacctaccgccgcctgctggaagacagcgagggcctcaatcttggtgatgccctggacagcagcaactccatgcaaaccatccaaaagaccaccacccgccagatagtggatagcaaagtggtgtctgagatcagtgacaccaaagttctgagacattaagccagcagaagcagggtaccctgtggggagtaagaggccaataaaaagttcagaggtcaaaaaaa

SEQ ID NO: 10632 - DNA, 12961 bp, Homo sapiens
ccctgagcagcctccacccaatgggaggtaagtgtttcactgctgcagaggagcagcagcacccaggccagcagacccagctaacaacagtcttgggagtttggcatcgtttctgtgaaaacatttttttgcttattatgtaaacctgacctaggataaacatcccaggactcaattttcttgtctctatacagtggctctatggctagttgatgccacattgctctgacgttatctggtgcctcctaaccttttaggtcactgttgaagaagaatatggaaaagggctgtttagctcctatagactgaggctgttctctgataaggggaaaaaattgcaagaactctttatttccattataaagtgacttttccagtgactgcagaaaagccaaagatggcttccatgcaaatgccctaccttgaagcttctagaacccaggcatttggtttacctgtgtatcttcttgtttcttaggtgaattcctattttgttgttgctattatcgtacacagaaaacttaaatggagtgccacaacaaacctgagctagggcccatcaggagtcggttgggggtagggcattggacagctcaaaagctgcctgtgcctacaccctctgcattggatttaggctaggccacatgtgcatctgagaaaggcatagttttcagtgaactgcattttgctctttgaaaattttcgatagtcattcactttgtctcaggaaattatagttggctatatttttggaaagttgctagattgtaatctgtattgtattttaattctcgtttactctttccactccccccacccctcaccccatccatctttccattgtctagtaaatggtttgcagcagcgacagcacagtttagattccttcttcccctttcaactgtgttgtctgggctctacttggaagtctttcactcagtgatttttcctctctcctctttctggtgatgaatctgctattcaagtgacagtgtctttattctttgtgtcattgctgctctgctgtgttctcccttgtttgctcctgggccttctgcatctgccatgttttctgcgtgttcccctctattacagagagcgaatcccctgtaaagtgtgagtgaggggcctggatgcagtcccattctgtgctgtaggttttggcattgttctcctgtgctcctggccctatggtaggcagtttttcttggtttcctaattgcccacacctttattaatgtacacttggcatggtatgctattggattagccatctcttctctgaggaaatgatttcaagtttcttaatgagtgatacatgaatcatttttggagccctgtaatgttgtttgtaaggcttatctagaacagttcctctttgtcagggaccagccctctgccagtgtgtgcttgtcattgctggaatggatatgaagcacccttatctgctggctaatctcttgctttggatgttgtagggttgaatgcaatgcagttacagaatttggctgcactagctgctgcagctagtgcagctcagaacacaccaagtggtaccaatgctctcactacatccagcagtcccctcagcgtgctcactagttcaggtaagcatgaggatgacccagtgtgccattatgtgccttggacagatgctttgtgtttaaaggcagagtccagagagggaaaatagttaacacctgtttccagagaggtcagattatgagcaacaaattttcaaatgtcatcttttgtacttaagagaaatcttcctgattttcaatgtgctgtggccattatttgtctctgtcctgcaaggacagttgttagaattagtaactgaaaacctctttacaaatagcatacttggatagtgacactttttcttgtatttggcgagaatgccagtgatgggttgaattttaactccttgctttctaatagcagggtcctcacctagctctagcagcagtaattctgtcaaccccatagcctcacttggagccctgcagacattagctggagcaacggctggcctcaatgttggctctttggcaggtaaggggcagcacctggctgtcatcagactattctttgtgcaggtagcacatcttaaccctggtaggggcaccactggaatgattgcagtggcccagtgaagttaaaaataatcatgagggccaggtgtggtggctcacacctctaatcccagcactttgggaggtcaaggtgggcgaatcacgaggtcaggagatcgagaccattctggctaacacggtgaaaccccgtctcccctaaaaatacaaaaaaattagctgggcctggtggcgggcgcctgtagtcctagctacttgggaggctgaggcaggagaatggcatgaaccggggaggcagaagttgcagtgagccaagattgcgccactgcactccagcctgggtgacagagcgagagtccgtctcaaaaaagcatgggatttttaaatcagacctgagttaaatcccacctgtgtccgttagctagctataacttcggaccacctttctaaggacattttctcatctttgaagtgggaataatagaatactttgaaggattgttaaaaattaaatgaggccaggtacagtggctcatacctatagtcccagcagtttgggaggccaaagcaggggatcaccctaggtcacaagttccagaccagcctgagcaacatagtgagaactccatctctacaaaaattatctgggtgtagtggtgcatgcctgtagtcccagctacttgggaggctgaggccgggaggattgcttgagcctgggagcttgaggctgcagtgagctatgattgtaccactgaactccaacctaggtgacagagtgagactctgtctccaaaaaaaaaaaaaaaaattagaacataggtaaagtgctgctgagcacattgcatagtacagtagatgacacatagaatgtacttagtacctgttagttgctgttttaatggtagggttcacccacatcttgtcagaaatcacatgtacccctttgagtttgcagtcttgggcctcttcttttatgacattctagctcattatgagaaagtggcagaatagccagatagaaaatggaggctctcattccacagattggatgaaggtaatggggagcacaacacccgcgtatggcatttcttaatgtccccattagcaaggcctggtgaatgtcctgaaatctagccagtcagatagtttcttctcagggagaaactaagagggagataaaggggagaactttggagttttccctcttctagatgtcccaagtagacttgtctttggcatcagtttagtctttctagtatattaatccttctcttcctccaaccaaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtgagtgcaaagggagatcggggtcaggtatggggggcggttttcctcctataccagaacggaaaggcagagcaaaggctgagggaaccagttaggtcgtcagaccattgtttttctttgacagtgtcaagtgtagactgagaaaccctgtgaagtgtgatctgctttttaaatgttttctggatgtggctcaaatcagaacctctgtgtgccctcttgggatggggctgcagtttttagatgaagcaacagacactgaccttatcgggtctgacacatttgacaagaatgtttctgttaggaggtcttctctacagattacaaatctatcagaggatcttctgtctggatgtcttctgtttcagtgtcccttttagctatatcatttggcattttcctcactttctgattgatgtttgtcctgattgaagacaaactgaggggtgatgggacagagtttggcccatgagttgatggagtgggaagtatgtcgtttgacacaaatggtattcaatttaggagaaaaataggagagactctttagccagaaagaggcctgaaggtgacttacatgaatagaaggtcctgctgacacctctgtgctcagatttgactgggtttttataaccaggagctggtataagcactaatgtaggaaaaagatgagtgtcctcttgtcacagcagaaagtcctggttcatctctcctcacctgctgtgaatcacttatatcccctagggatgtggtagtaggagaatgtagcgtgaaccaatattttagtggagactgtggagacagacaataaataaatgaaagcatgaggtgtttcagatgatcctctggagaatgacaagccgggaagagagatagggagtgtcagaggcactgcattttatgcagaatgctcagagaatgtctctctagattgacatttaagcagagaactgaaggaagtaggaagcaagtcatgcctgaatctagagaaagaagagtaacaggggcataggaaaagcaagtacagaggccctgaggcagcaatgttccctgatgtgtttgaaaaaaacagggaggccagggtggctggagaatggctggactgcaattgtaataaagctttttggttagaaaatcattgagtaggctgggcgcagtggctcgcgcctgtaatcccagcactttgagaggccaaggcaggcagatcatgagatcaggagttcgagaccagcctgaccaacatggtgaaaccccatcgctactaaaaatacgccaggcatggtggcgcctgcctgtaatcccagctactcgggaggctgaggcaggagaattgcttgaacccgggaggcggaggttgcagtgacctgagttcacgccactgcactccaacctgggcaacagagtgagcctctatctcaaaaaaaaagaaagaaaaaaaaagaaaatcattgagtgtaaatagtcagatgaagaatgtatattctgtttttaagctcagtgttaatcatgggtgcatttttaaaactaatttcttattttcccatttacatatgatgaaactcactgattttggcatacagctatatgagtattgacaaacagtcctagtcctgcaaccatcaccacagattaggaacatttccatcacccctagaaattccctcgtgcccctttgtagtcattccctgcatctggcaactaccaatctgtttgctgtccctgtggtttctaggcattatttggaaacctgttttgtttataaccccttttcacctcctcttctgtgttcctctctgagcctacagtctctgttttcctgctccacacacaagtcggcctgctttattatcccaacactcctcctcctgcgggtagaatttctcacatcctcaatgagatggagcttggctgaatgtgagggaaggaatctgttttaatgtttgcctttggttccttgctttgtatttagagaatctgtttagttccccagatgaatctctgtttttagggattgtgacagttttaacataggtggaaatgaaagatcactggtgcagggcgacgagcatgtttgacactgatacttttccaattcctgggtattttgaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggtatgttggcttctctctggtgtcaggatgggattagtattttaccactgagaaagaaggagctcactgcagaaagatctgaatatgagtttgtggtgttgttttaacttggccatgggcaggtcattatgacctctttttgagccccagtttctcattgctgtagtggaggtaaggatttctacccacactgttgctccagagagaaaaataatatatggaaaatggtttgcaaaaaaacctttaaacagtccaggtttgtgcctgtaagtcccagtacttggggaggccaaggcaggaggatcgcttgagcctaggagttcgagaccagcctgagcaacagagtgagacctcatggctacaaaaaattagtcagacgtggtggcgtgtacctgtgttcccagctacttgaggctgaggtgagaggatcacctgagcccaggaggccaaggttgcagtgaaccatggtcacaccactgtactccaccctgggtgacagagcaagaccctgtctcaagaaaaagaaaaaaacctttaaattaccatgtagctgttaagtggtactattaagaacctaatttatttcgtatgacataatgtccagatttcttgtccctgctgaataaaattgggatttgagatgaagcacataaggtatcttgcataaggaggactgagaatctccttgcctcattatgtccctcacctaggtttctgcttggacacacaggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggcaactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcgcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagacccactgtctcctggggtcccttgagtgagcaggctggatggagctagagcttgatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctcgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaa

SEQ ID NO: 10633 - DNA, 4135 bp, Homo sapiens
caggggtgcagttgggaaaacgaaggtcggaggggcccatggacatatgatgaaacgcactgattttggcatacagctatatgagtagtgacaaacagtccgagtcctgcaaccatcaccacagattaggaacattgccatcacccctagaaattccctcgtgcccctttgtagtcattccctgcatctggcaactaccaatctgtttgctgtccctgtggtttctaggcattatttggaaacctgttttgtttataaccccttttcacctcctcttctgtgttcctctctgagcctacagtctctgttttcctgctccacacacaagtcggcctgctttattatcccaacactcctcctcctgcgggtagaatttctcacatcctcaatgagatggagcttggctgaatgtgagggaaggaatctgttttaatgtttgcctttggttccttgctttgtatttagagaatctgtttagttccccagatgaatctctgtttttagggattgtgacagttttaacataggtggaaatgaaagatcactggtgcagggcgacgagcatgtttgacactgatacttttccaattcctgggtattttgaaggtccagagggagccaacctgttcatctaccacctgccccaggagtttggtgatcaggacctgctgcagatgtttatgcctttgggaatgtcgtgtctgccaaggttttcatagacaagcagacaaacctgagcaagtgttttggtatgttggcttctctctggtgtcaggatgggattagtattttaccactgagaaagaaggagctcactgcagaaagatctgaatatgagtttgtggtgttgttttaacttggccatgggcaggtcattatgacctctttttgagccccagtttctcattgctgtagtggaggtaaggatttctacccacactgttgctccagagagaaaaataatatatggaaaatggtttgcaaaaaaacctttaaacagtccaggtttgtgcctgtaagtcccagtacttggggaggccaaggcaggaggatcgcttgagcctaggagttcgagaccagcctgagcaacagagtgagacctcatggctacaaaaaattagtcagacgtggtggcgtgtacctgtgttcccagctacttgaggctgaggtgagaggatcacctgagcccaggaggccaaggttgcagtgaaccatggtcacaccactgtactccaccctgggtgacagagcaagaccctgtctcaagaaaaagaaaaaaacctttaaattaccatgtagctgttaagtggtactattaagaacctaatttatttcgtatgacataatgtccagatttcttgtccctgctgaataaaattgggatttgagatgaagcacataaggtatcttgcataaggaggactgagaatctccttgcctcattatgtccctcacctaggtttctgcttggacacacaggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaagggaaggtgttaatgctgtgaattggcagaggagagagctgtgctcatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgct

SEQ ID NO: 10634 - DNA, 766 bp, Homo sapiens
aagtgtagacgtgggtgctagtggactgtgtgatagtacatcatcattaattatgaggttctttctggactatgtggacttgagttagccaggctctactgtcctggaggagttggtttttatctttttatcctttgagaagcggggggaaagggtgtataggtgcattttttcccccattctgttcctggaggtttgtagacctcctgaaacttatccatggtctctagcctggaaggatttgcggcgacagagaaaccaggtcagatgtttataggaatgggaaacaggttgaataaaaggatcctgtacaagaataccaattttccataaacaatactaattgggtttagttggagcaaaagttttcagcaagctggttagatgaaggttgtggtttgccaatatacaaagtaaactaatgccacaaactcagggacaggccctcttactttatttgtcatgggaccatcattgaaggagaacgtactctgaacctggtatagactaatccatcagtcatttggtcatctgcaacagggaagaccagtttggaggggaggaagtaaataaggttggatagatgtgtagctggagtgattattagtcatgtggtccattgtgaccaataaagggtaactccaagaaatactatgaaatgtttagatttgatatttaaaatagttgtgtgaagtagaaattgagtatccagatggaaacaatctgcagagtgagatgtgtggacctaactaaggagaacttggga

SEQ ID NO: 10635 - DNA, 1639 bp, Homo sapiens
gttgatcaatgttaggaagcttgctaatgacactctcatccagaacttttggagagtagggagaaactaacaaaataacagagagccgaggaattccacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctacagccacctataacttaagattctcccccacacagcccagacatacacacaacgctaagatctgaatgcctgtgcccccaaaaattcataagttgaaatcctaacccccaaggtgatgtgaaaaatgtaccaaaccctgtccagaatttttgggaatcgcctcccagatactttatctagagactctttgttctacttccccacaagtttttcattccagtatttaatcattgagtgtttctgcttgtgatacttgttgcaaagtcaatgatagtcaaagaagttcaaaaattggttactttggacttaacaagcaaatgcacttctaggtggcttttgaaaaccaaaagtacacctaagtagagggcttctgttttttatagtgattatatgaagagtaatgggtgaaaagcatcaaagctggaattggagctctggggtctacaccgtttccaatgaatcattcctaatgtgatgctttcatccatgctcttggctctgtctgggatgtctcctctccgccaggccctgatttcagtcatccaggccgagtttaattatgtataactgtcttcgtttatttggggcactaaaacaaaaataacaaaaatactatagactgggtgtcttaaacaccaaaagtttattactcacagttctgcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctccactctcacagcctaatgacctcccaaagggcccagctccaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagtttccactaatccttctactgatgtcttctatattcgtgattcagatgtgccttgtagacaagcacagatcttcactgctcacttctgccataaatgcttcacaaatttaaaaaaaaaaat

SEQ ID NO: 10636 - DNA, 1637 bp, Homo sapiens
gttgatcaatgttaggaagcttgctaatgacactctcatccagaacttttggagagtagggagaaactaacaaaataacagagagccgaggaattccacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctacagccacctataacttaagattctcccccacacagcccagacatacacacaacgctaagatctgaatgcctgtgcccccaaaaattcataagttgaaatcctaacccccaaggtgatgtgaaaaatgtaccaaaccctgtccagaattttggaatcgcctcccagatactttatctagagactctttgttctacttccccacaagtttttcattccagtatttaatcattgagtgtttctgcttgtgatacttgttgcaaagtcaatgatagtcaaagaagttcaaaaattggttactttggacttaacaagcaaatgcacttctaggtggcttttgaaaaccaaaagtacacctaagtagagagcttctgttttttatagtgattatatgaagagtaatgggtgaaaagcatcaaagctggaattggagctctggggtctacaccgtttccaatgaatcattcctaatgtgatgctttcatccatgctcttggctctgtctgggatgtctcctctccgccaggccctgatttcagtcatccaggccgagtttaattatgtataactgtcttcgtttatttggggcactaaaacaaaaataacaaaaatactatagactgggtgtcctaaacaccaaaagtttattactcacagttctgcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctccactctcacagcctaatgacctcccaaagggcccagctccaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagcctccactaatccttctactgatgtcttctatattcgtgattcagatgtgccttgtagacaagcacagatcttcactgctcacttctgccataaatgcttcacaaattaaaaaaaaaaaaa

SEQ ID NO: 10637 - DNA, 1547 bp, Homo sapiens
gaattccacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctacagccacctataacttaagattctcccccacacagcccagacatacacacaacgctaagatctgaatgcctgtgcccccaaaaattcataagttgaaatcctaacccccaaggtgatgtgaaaaatgtaccaaaccctgtccagaattttggaatcgcctcccagatactttatctagagactctttgttctacttccccacaagtttttcattccagtatttaatcattgagtgtttctgcttgtgatacttgttgcaaagtcaatgatagtcaaagaagttcaaaaattggttactttggacttaacaagcaaatgcacttctaggtggcttttgaaaaccaaaagtacacctaagtagagagcttctgttttttatagtgattatatgaagagtaatgggtgaaaagcatcaaagctggaattggagctctggggtctacaccgtttccaatgaatcattcctaatttgatgctttcatccatgctcttggctctgtctgggatgtctcctctccgccaggccctgatttcagtcatccaggccgagtttaattatgtataactgtcttcgtttatttggggcactaaaacaaaaataacaaaaatactatagactgggtgtcctaaacaccaaaagtttattactcacagttctgcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctccactctcacagcctaatgacctcccaaagggcccagctccaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagcctccactaatccttctactgatgtcttctatattcgtgattcagatgtgccttgtagacaagcacagatcttcactgctcacttctgccataaatgcttcacaaattaaaaaaaaaaaaa

SEQ ID NO: 10638 - DNA, 425 bp, Homo sapiens
ctcagcttattctcccccaaagctatgcagagccttctgacctttcagaaggtttgcaccctttccctgtaatttctcccaccactctgactgatctcctgcaatgtttaactggtgttatattctaagcttaatcgattgcacacttaaaatgttcagaaaacactcaggatagtggacaagaatcatttcaagtccctgaaacctcaaagtctttagcatatactaaccttcaggtctacatactgatgtgtaattttcaatgcactgtcaataactatcaataacatcatacacacgcacacacacacacacacggccattttggatttgatttttacattgcagttacatatataaaagtgaagttatagattttaaacatttgcatatttcttaaactttctttttaaggatatatagat

SEQ ID NO: 10639 - DNA, 371 bp, Homo sapiens
aaatgggaccgccttcacctttcccaagtgaaaagtcaaatttcaacccacccctattattcactccatccagccttcactgagtacttacattgtgctggggactagggacacaagaactgataagacaggaccctgctcattgtcctctgctcattcccctccaaaaaagtctaggatctgaatgcatgccagtctccacctcatccagtgtataaatctattccaaccctgtggttatgtcactgtgctgagagtgcattgtgctatgtcttgaagacgtctgtcttgtacgttttaaaacatgtcaaggttattataaaataaatgcatcaaagcaatacttttgccagctttcaacttatgaatat

SEQ ID NO: 10640 - DNA, 372 bp, Homo sapiens
aaatgggaccgccttcacctttcccaagtgaaaagtcaaatttcaaccccacccctattattcactccatccagccttcactgagtacttacattgtgctggggactagggacacaagaactgataagacaggaccctgctcattgtcctctgctcattcccctccaaaaaagtctaggatctgaatgcatgccagtctccacctcatccagtgtataaatctattccaaccctgtggttatgtcactgtgctgagagtgcattgtgctatgtcttgaagacgtctgtcttgtacgttttaaaacatgtcaaggttattataaaataaatgcatcaaagcaatacttttgccagctttcaacttatgaatat

SEQ ID NO: 10641 - DNA, 1577 bp, Homo sapiens
ctcccaaagtgctaggattacaggcgtgagccactgcgcccagcctttaggttttattttcaatgagagtttttattttccattacacataactgtctttttaaaaaatatttacaagtgctaggtaatttcatcttccactattcccccaaaatacttcaaaatataggattttagtctcaattctttttttctcatctacaaactgttataattttacctgcttgttcattccaaaggtttgttatcagagtccagttacataacatactctctgaaaaccacaaagtactttccgaatgtgagatagtagcagtgctatcataattttggttctgactatagcacaaatagcttttaaagatagatttacttgagccatatatgtgggtcctctacaaataagactattattattctggtgtctttttccatcgtttttaagttacaggataattcctcccagtaaaactagcctccaaaggttttaatggcaaaatccaagtattcaaatctataatcagccttttaagcaggaacttaaaatgacatgacagttttaattatcttgttcttcgtccaagagtcaagtagtaggcatgagtacactttttacatggcttatggttttacgttatcttctaccaaacagctgttttgtacttaataggcctagtttctgtaacccatttggaacttcccccatcagctgtcgaaaggcttcaagttgagaaacactgcactgtggcttcttcaaatggcttttcttttttgagatagggtctcaatgtcacccaggctggagtgcagtggcgccatcatggctcactgcagcctcgacttcctgggctcaagccatccccctatctctcagcctcccaagtagctgggactacaggctcgcgccactgcacctagctaatttttatattttttggagagacggggttttgccatgttgctcaggctgatctttaactcttgggctcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattctttaaaaaaaagaaaaaaatttctgaaatgatcggggaaaagctgctataaattttatgaagttgagagtagaaattgaatgtttaccatttggggccacatttcaagaacactgaagaatggaaagtgggcattaactgaagcagacacctcttgaggtaagatttgtggaagaagaggttaaagtgtgccagaaatttgggttaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtg

SEQ ID NO: 10642 - DNA, 962 bp, Homo sapiens
atcagagtccagttacataacatactctctgaaaaaccacaaagtcactttccgaatgtgagatagtagcagtgctatcataattttggttctgactatagcacaaatagcttttaaagatagatttacttgagccatatatgtgggtcctctacaaataagactattattattctggtgtctttttccatcgtttttaagttacaggataattcctcccagtaaaactagcctccaaaggttgtaatggcaaaatccaagtattcaaatctataatcagccttttaagcaggaacttaaaatgacatgacagttttaattatcttgttcttcgtccaagagtcaagtagtaggcatgagtacactttttacatggcttatggttttacgttatcttctaccaaacagctgttttgtacttaataggcctagtttctgtaacccatttggaacttcccccatcagctgtcgaaaggcttcaagttgagaaacactgcactgtggcttcttcaaatggcttttctttttttgagatagggtctcaatgtcacccaggctggagtgcagtggcgccatcatggctcactgcagcctcgacttcctgggctcaagccatccccctatctctcagcctcccaagtagctgggactacaggctcgcgccactgcacctagctaatttttatattttttggagagacggggttttgccatgttgctcaggctgatctttaactcttgggctcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattctttaaaaaaagaa

SEQ ID NO: 10643 - DNA, 759 bp, Homo sapiens
gtgcggtggaatcggatgtgagaggaataactggggttgatctatttggaactacagatgcagtggtgaagcatgtactagaggtacttatctttatagccaggggctgaatatgggctgtcatcttgggaaagtcacagtatgttgttcatttattcattccttcaacaaatatttacagagtgcttattaagtgccaggcactgtttgaggtactagaaatcaaattgtgcgtgaaccaacagagaaatgaagcttatgtgccacctgagggagagtcttattaccttataaacccagtgggaaagggagaaagccaggcgtagacctcatcaccatcccaaagcagagcccattctcaagctttctgtaaggcagggcagcaggaaatttaatcggagttatcgagaaccagccatgtgtaacttttgtgcaggtgggaaaacagaaaagcataagggaaagaaactagtttttgttctaaaaaattatctaatcttcatagctacccactgaagtagatattattatccctatttagcagacaaaaaaaaaaaagagatttagagaaattaagtggtctaccaaaatctacatatatctagtaaataaatgtaagaaataagatttgaatttcgatctgactccaaaacccaggtgcttttcgctgcatcatgatacatctcaataatactgctaattcaaaactgccttatccaggattctgtcacaatataccatataactgtataaataggg

SEQ ID NO: 10644 - DNA, 23556 bp, Homo sapiens
aagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttccaaagattggtagatagatgcctttttaaaaatctcatttttctttaaatctggtttacatggaaaacgttaggagagctcatataatgaacggcaatagcaaccccctatcttgaaacgcgctctatcatcccactgaaattctaccacgtggaataatgcttggagggtcagagttgtggaactgcccaataaccaatcgttactgagggttagtttgtgaaggaggggacagactgcttctaaaattctgtttaatgacagtcaattaagatttctgagtctggcttgagggcctttgcttccatcacagcccagtcgtccttggcaagagagtctgtatatgggccacagctcacaaaagcattgtttgaaaaaatttattgaaagaacattgtttgtaaaatgagtcccaatacataggacagactttcctaaggtgagatgtgttacttacccagagctgtgaaaggctttacggatggaaactagagactgaattttccagaattttaagaagtctccccaaccaatggccccccactttctttttttaaaccaaaggtaagaactggtagttaaaatgacagttcaaagcttgtccttttgggttacggcagcttcctctatgaaaagatttgggagtgattcagtcacttgaggaaggttggtgccagagagagaaatggctttggtgctttctggtctagtgatgcgggtatgctaggccagagcgagtgccctgggccctccgaggcgggggagagggtggggtctgctgctgccagctcaggtgtgacctgtaatctggattaggtgggcccagggcaacctcttatcacgtccctcctggaaagcctgactgctgtatacatttctagggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaatgtaactatggcttttctctgcaccatgtgtgaaataagctgccgctggcgttggggcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaatttttgcttttggttgcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggtgaggaagcctcagggagaggttcaagtgacgtcacaaggtctggttagagaaaagcctttgccagagttcagagttttcaaaccaaggtctaatttgggtgggcgcagtggctcacacctgtaatcacagcactttaggaggctgatgtgggaggatcacttgaggccgagagttcaagaccagactgggcaacatagcgagatcctgtctctaaaatgtatatctgggtgtggtggcatatgtctgtagttccaggtactcaaggggctgaggcaggaagatcgcttaagcccaggagttccaggctgccgcgagctatgatggcaccactgcactcctgcctgggtgacagagcaagaccctgtctctaaagaaaaaaaaattgaactcatccccttttaaatccataaacgcacaactgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtcttggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatctggcgtgtaaggtccaggccctgtctcagttgctttccgtgtagcatctgaattctcttacaaccagtacaggtagtgttttgttagctgcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccctctccttccagtcttgggctaaaactggagctgttcactgtggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatctcttgaattacggagtcacttttgtggtcgcttgtattctgatgaggagatcgaaggctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttccccatgcgtggagagacgtgatggagggtttgttctgtgccaggcctggcccacggcttgttttctgctcacatgatcctgtgtggtagatgctgttcccaccctcattctatagaggcactgagaggagaagtgacttgttgaggtctcacagctcttgtatgacggagccagcattcagatgcaagatggcccaactgtgaacccttggtcctaactccagaatagctgatcaacagagatttcttgccattacacctagattcagacagaggaaccaggaattagggcagcccagctctgcagaccagctgggctatcgaatgccttgtgggtcatcagagtcctgtgtgggcatctctaaggctccagatgtccaggtttcacctctgggagattcggagcccaaggtcaaggtcaagctagacttccacgtttgccagtgtggacactacacgtagtctgagtcctagcccaggttataagccattgccatgtgtgcttattctcttgcatttgggggccagagatggggaggggagagtgagtgtgggagaggggtgaaaggggctgagttgttgggggccagaatcagacctgagaccacaaacaaggtgtggagggggtcaaggctgtaggagcccatgacagtgctggactcccagccacagatgactgtcccctgacaccagagaacaaaaatgacaaaagatcacaccttaaccccagagtggaccataaataggtcaaaggtagcttaagatgcattttggtcctgcacgtctctgcctgaccgatgtttgcagtggggctgtgcgtttcagtaattctgttaaatctgcaatttgaggttgctgatcttcttgagaatctgatgcccattactgaccacgccaaggaatatggggacaagggaacgctttgcactcactttcgaggggtcccttggtgcccccacacgttccagattctttctgatcaaggaccccaggtcagggagcctcagcaccaagaagttttgtgatgccactgcctgcctcctcacccttagtgccattgtggatttctctcttgtttgattgcagatcttttttttttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcgggggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggcctgtctctgtgacgttggccggatagatctttggctgttggatgaagtcaacctcggtcaggtagagccatcttagggattttccggttatgtagacacttgtttctttcaactgttcaaagaaaacctttcaacaatttaggagttaagaaagaaatttatgagtttggtttcttccgtaataagtggatggtaaaaggggccacttataccagaaaatccctcattgtctgcaggcatcatcctgaggccggcctcatggtatagatcacagaagagaaattgaaaaaacattgagctcattttgtaccgaccctgagtacactgatgaggccctgatagcaactcatttaatttttaaaaagtactttaccttcttgacatgacgacaaggggggaaaatctagttaagtgaggattatgattcatggttattccaggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctcgagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgtttgggatgtgggttaactcagtggttctcaggtgggggaggtatcatgatttaccctccagggaatacttggccatgtttggagaccttttttggttgtcacagctaggggaggggtgctattggcatctggtgggtcaaggctagggatgccgctgaatattctacaatccacaggaccaccccgccacaaagaagggtcccagctgatatgtcaggcttgccacggtggggaaaccctgatttaaagtaataaaaatttgaaactacagttgatttagtacatggtttgctggtttatttctttaaaaataaacaacagcaacaaaacccaaattaatgcccggtcagtgatgcagtcaatgaagagagcattaaagaccgtgtgctttaagaaatagttttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgcggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaataaaaaataaaaaaagccagctaccgagacccaacctcccttccccagtgagaatcttgaggggcaaggcccaggaatctgcattttcacaagcttcccaggggcagggggttggtatatgcattaagcctgagaacacttgctgtggtggggaaactgttgggttggaagtgggtacagctggcatttaatcccagactgggtggccttgggaaagttacttacctcttggaattgcattttcctgaagtgggtacagctggcatttaatcccagactgggtggccttgggaaagttacttacctcttggaattgcattttcctgaagtgggtacagctggcatttaatcccagactgggtgaccttgcgaaagttacttacctcttggaattgcattttcctgaatgggatcgggatgtccctacagatctcctatcattttaggctggaggacactgtctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctggggggaaaagtctagaataaatgcaaaaatgcaaaacaaaatttctattaaaagtaacagggcgatggatgaccattttgactttttgcaaatgttcccttttcatgctaaattttaggggttgatctgaaaaagcaacaacttgttctttgttttgaacgctctggtgaaaccatatgcaacttcctctttgtgctgtgtaaacctcaggtgtctccagctcttcagccaggcaagggcttggctaaaaggtgcactccagggttggaggagccttcagcctgggttcgacttctgactcagctgtatgaacctgggggaccccctccctggcttgggtctttccacatctggtccccagatgtgaaaagactcaagacatctgattggagtctctttgggtcctgaaattgaatgagagttgatggccaacaaagactcatgggaagggaaggatgtgtggggtcctggtcatggtgacggatatttgtgattggagtcggccatgaatttaatgtgcttctgtttctttcttcaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcgtgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcagagccctgtgctgtgccgctgccatgaattgtagctgatttacgagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatgaaggaggcagcatgatggtaaagatggtggacagagaatccgaggtgctggtgaatgtggcccatgaacgagaaagctgagccaaagccgatgcccgacccggacagtacaattgcggtttggggcgtttgtagcctaatcgtctgcaattagcacctaactctactgagcgtgaaccctagtcaatactaaatagtaaggccaacaaactgaccttcccttggagaatcgggtgccctttaggaggaaacctctatataatagtctggggtgaccctgaaaggctaagcagtcatctttttgcctcatttcccagttttggacaattttttttatcaccaaaaagtaaagtgtgatttgaaggaatagagaagtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctattgaaatggaatcaaaattcagccgggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatctgtgagtgttttcaaatgccctggcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagtatgggaaaaaaattctgtgcctttcccaaaccaatgaagacactcactaacttaatgtttccttaaactcagcatttacagagtagattatggcttcagcaaaggctgtgatgcctccgtgccatgtgtcatggtgtttgtctggttttctgtaggcaaactaggcgtggcaactgctggctgcgtgaatgaagttacagagatggagtgcggtcgctctgaaatcgacgagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaagtgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaacacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagattgaacatctgcatgtggctcgttgagcgagattcttgaaagcatggcagcctttggccagcatcactgttcactggtgtctcagagcttgtctgcgtgtccagggcgttgagggcaattggataacctggaacactgggtctgcaacaggcaggtcgtggaaagggccaagaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcctgtcggagtcagctccttccagactggtgggcgcagcagcccagcacaggtgagggtgggtggcctagaattgtcaccaggcatggcctgaagggtttacggcattccaccagccagggacggagtgggggtggttgttgctatcatgatccatgtctcattaaaggtagctcagccctgagaggtgaagaacgatggccctggtttcccaacatgagggcagagcccagctgtgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctagatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagccggtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggtaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacggggtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggcctggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttgacaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtggtggagcctctcagagcctcatctcaggctcccctgcccaccacctctaggtggatgcagctgttcccatttcgcgggctcaggtagcttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggacagttttgtgggtagcagaggtcggtgctcacccaggcaggaaaactatccagatggcaatgccctgtccatgaagctcttgtctatttcctggcagccctttgagctggggggttgttttcactccggcttcacagatgaggagactgaggctgggaggttcaggatctcatccaggtcgcgcaggcctctggctggagcctgttcttgaggcctccttgtgcccggcagccgccatgctcacaggatctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacagtttggggagagcatgtccttgaattagtccagcagggtcatagccactgcctcatgcacagaacatccttctagaagctgtgagctttggtacctctgtccagccccgcccccacctctatgtaaatccatgcctcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcggctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgtctctgaagcacttagctgttccgggtgaagctgccagttcacatgactgagaggtgctggtaccaagataaggccccggaaatgacagggcaaagggccaaaggggtgacggagttgcctgaagcgtttcattcatttggaacaaagttcgaaagttgcttcagggtaaagggaggggagtgtgtggagtccgcaggcagtgcagaagttgcagacttggcgtggggggaagatgatgagtgaggaagagcgagaccagcggggaagatggtgagcagggaagagcgagaccagtgctgccatttccttctgggtgaccctatctaggattcagtttcctgaagtgtcaaatcaatgaggtggaccagagcttctgcagctctagcttcctaccctgcatgattctagaacctgcgtaactccagcatggctggaaatggagcccgtgaatggtgggttgtcaaataataaggcagggagcagagcccaatgggagggtccaaggagttctgagtgcccagcagtgtcagcagggaatgcagatggactcagggcctccccagatgtggtcagccttgcacaactctagggggcgccgtggagttaggcacctcacaacttgtgtggctccacaaggcagcctcgaaccggtctggggtacttagaaggagctgcaaactcactaagctcattgctagcgtatgtaattcttttggtttaaggcaattaaaatgcagatacctccctgcatttacatgttatctgcattcctaccttagattagtgttttccaaactttggtcacttgaggtccagtgtcacaattggttttcacagcctggactgttactaacatcatgtttttcctcaaatcttaatcttaaaataaaacttaagtttattttaaatgagaacccactatcattggctgtaaaggaagacctgtggcacctggtataagtaggtaatactgtctggctagaattgattaagattgtatttgtctttcattgaatttgtcttgacctctgacaatgccctgaatttggagccctaagttcagtgccattattcaaaagggaggttgacaggtgttaggtgttagagagctatcagcaccaaactgaggcttgctttttgaggtaatcagaggttggaagaatattgaagatggaataatcttgtgattacatgtatcacccctcccccattattctgtgtgtgccacttttggggaacccctgctttagtttgagtgtttttcagactctttcctgagaacagatttggatgaagggttttgcagagattcttaatctgaaatccaggaaataccaagggcgctgtgaatttgttgagaaaaagattatgtctttattttctttaacttcaggtttaaattgagcatttccttttgttatgaatgtaggcagcagaccgcagtgcccttggcagtgcctatgagacggagtattgtcataagaaatgagttgtcgaaacatcgtttgccctcagcttgacgtgtaaattacaacagttaccagaccttctctagaccttgtatttaaagagtcagtgaagaagtacagagaacactgttgtagttaatatgttcagtcattggtttccttagtcattctgtgtatttattcatgcatataaaaacattacttctacaagcagtacatggatttccccagaatatcaaagtggttcaagacacacaaagagttacccgtgtaggtgtgagacagactgtgcacttgggcaggagggaccctgtatgtctccccgcagcaccgtcatcgtgtccctcttgtccacagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgaggtctgtaccgtcgtcaccttgctgcccccacatcttagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagaggcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagcttttttttttttttttttttttttgagatggagtcttgctctgttgcccaggctggtgtgcaatggcgtgaccttggctcactgcaacctccgcctcccgggttcaagtgattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggcaggcctgggcaagaccttcaatatgcgggaagcggattcttgccatctccgagccatcttctggtgtctgggacgcgcacagtctgtgtgtgtgtgttttcttttttcttttttggtttttaaatctaagcctcttctccagaaagattctacctgttcagttgcccgaaggtctaagtgacagattagggcattgccagcccttatttcatgtagtcaagggaatgaatctctaatggtgggatcctgggtgctggctgtcccagctgggacagtactggggagtatggaacagttttggcaggagtactgcttgcccttccttggcattctggctcattcacttgggactcacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatctgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 10645 - DNA, 1606 bp, Homo sapiens
cacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 10646 - DNA, 57649 bp, Homo sapiens; identical to SEQ ID NO: 9151

SEQ ID NO: 10647 - DNA, 5541 bp, Homo sapiens; identical to SEQ ID NO: 9152

SEQ ID NO: 10648 - DNA, 887 bp, Homo sapiens
tacaaatataatgttctttgtctacattataagtatttgacacttcagaatgtaggtaattaatatactagtttcttagcaaatataaaaaagccttgtgatcagtcattttatactaactctgcttttactatatccaaaaccagaatgtgtttatataacaccaaaaccagtgaatttttcaaataatactattttctgtacatgaaataaatgatttttcactaattggtttgtttgaattatctagatactctttcataataattctatattgcttatgacttgagtctttgaacaagaatggtaagtggcctcataaaacatagcaattggctgtgtttcaccttagcactagtacatgccaaatgcagcatctctttttctttgttacattgtagctttgccatgctgttatgcagtggcttggatgtaatcttttagtcatagtggagtggtttggattaatttgttgcattttactaatggacacaaaagcatagtatcctgttaattaactggtcacaaacttataaagggacttcctttagagttaaagatttagagttaaaggttaaaggtttaggttgggtgccctggctcatgcctacagtcccagcactttgggaggccaaggcaggcagatcacttgaggccatgagttcgagaccagcctggccaacatggtgaaatcccgtctttacaaaaaatacaaaaaattagctggtgtggtggtgggtgcttgtaatcccagctacttgggaggctgaggcacaagaattgcttgaacccaggaggcggaggttgcagttgagatcatgccactgcactccagcctgagtgacagagcaagactctatctcaaaaaaaaaaaaaaaaaaaaaaag

SEQ ID NO: 10649 - DNA, 887 bp, Homo sapiens; identical to SEQ ID NO: 10648

SEQ ID NO: 10650 - DNA, 887 bp, Homo sapiens; identical to SEQ ID NO: 10648

SEQ ID NO: 10651 - DNA, 441 bp, Homo sapiens
tatctcttaaatgtgagatgggaatgaagaataacctgggtctataaagctaattagtttgtggaagaaaataggaggtaatgggggccaggggagtattgataaaatactgttattttgccctttcaattgatcttgtgagtttttttttttaaagaaaatcttcataagcattcaaataaatttgaatattatgccatgaaatggaaaggatgtgaatgacgggagttcgtaacgccattctttttattcaccacaggaagtttctatcctgcagcccacttcagaatgtaaaggacattaagtaaatgtcagaattggtgccccatgtcccttttttggagatagacacctatgggagacaatcactaactgatttcaggattagataaatagataaataaaaacagcaacattgagatcccatctctactttttaaa

SEQ ID NO: 10652 - DNA, 3916 bp, Homo sapiens
gcggccgccgcgactcttgcctcccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaaggggggcagcgacggggcaggtggcgaccccgtgcgggccgcgccggactcacctgtctccccgggaggcagtgcgccctgcgcccgcagcgaggggaactctactcctccgccgaagcaacagccggagacacctccaaaaccctgcaaactttggtggaacgctggcaacatgaatttaagctagacagcacagcggcacggtgcgcgtaagggacttgcacctccttgccctttggggctaaaccagcacagaacaaattaggatttagttcctttatttcacaatactaaatcactttactgttgcttccatgcatctgccagggctccacgaggcatcacactacagtaccatttgaagtacagtaccgtatttacctaatatgactcggaattaaacagtatcttactggttactcagttaagggaagaatcaactttcagaggaatgtaggagggtaaaacataccttgagtgccaatttggggcatttaatgagtcattccttatcctgacaaaatgtcaaacaaggcttattagatgaatctcacactgtgcctgcatctagttcaatgtttgtctgtcgaaggataattttcaaagagcagttagctttcacattcggccacgtgtagtttaggactgtacctaaattagtgaactttttttctaatttaatgttgataatgagaaggaattggtatctgtgaagcaagagcaattcatatctgttatattgctctgcttagaactcaccagcaatctagcaatacctatcggtaagaagtgatttgtggtgtctgaaagttaagaaagatgatataccttaatgtgtttaagctgtctcctaacagcttgttaggagagttggtatgctgaagagagatgggcatcgtgggggttactgctagatagcctctgagtctgactcaactgtaaagttctcacataatcccattgctggttggcacttttgagagagtgaagtaagacatgagattcggaagagaggaaaggaggaaataggagtgaaaaaaggttgaaaagagaataaaaagattttagtgaagaaatgtgattgaggatagaaaagataacataaaaggactacaaaatgagagcacaaatggaagagcaaaagaaaagttacaggtacataacagtaaaactcaaccaacgtcttgtgaagttttcttttttgtcttttgtttgatctcagcactgtctcagaaattgttaggtgtgcggtgttttgtttccttttttgtcagagtattgcattcagagaaaggaaaatctaagaaggaatgatagtagtgtatcatcagaacatttacacatttggagtctaaaagccaggcttcctgcagtagtgtttgatcttccgaatattgatgtcctgaatgaagcacgtgaatatttattctgattttctcttatgatgtgtccataacatccactgttctcattttagatgtaaccctctagagccctactgtaagtaataggaaaactcagtaaactggtagtgggactgtgttctgtttaacaaatgctgttgctcttcagtacattttttttctttctacttaacactttttcagtttcctgttcttttatcagaaaaaaataagtcagcaccactggtaaacgtaggtgtattgatcggaagctggtgttttctcccatgacattacccacctcatatctaatgagacaagagggtgctctcaggccagtgctctcaacaccgcttgaatgcctcatctgatctttactgagtgttacgtggactctctggttttgtgtttgtagttacagtctctaaacactctccaccccctctgctaagtacttaagatatttaatccttcatactaggtttctcagtgtcacgctattgacattttggactggataattccttgttgattgtgggatatcctgtgcattataggatgtttggcagcatccctggcactactcagtgggtactactagtagctgccctcaccccccacccccagtcatgacaataaacatgcctccaggtattaccaaaatttcccaggagcgggcagggtagttgaaacagaatcattccaattaagaaccattgacatatactgaaatatcaagggattatcctgcttttatttactaagatgaggcctgagaatgaaacagtttgataataggactctgttggagccaacatctttctgtttctacaaacatataagacttgctttctttatacaccattttgaaagttgtcaaattttatagtcatatacacttattgtaaatactataccataagcatgacatcatgagtgtatataaacatagagagagagggactgttatgaactttactactgcctgccatatagaatttttactcatgaagagtttattcatattagcagaggtgtgttccaactatggttggaacttgacaatggctaatatttcataattgtacactgtaaatgtaacaattaaaattggattttatttcttttggaaagaagtcagtagaactcaactcttcagcattatagcagcagcacacttaagagcagtgtgggaacctgacacactgagttaaaattctcactccaccacttactactattgtgaccttgagcaagccatgaaacactgagcctcagtttcctcatctttaaaatagggatgatagtacctattttacagagttgtagcggcacatagtaggctcttcattcaggctgtcactcactgaaaagacatataccaatatgagtattaataaaatatggatattttaaaaatgcttctctccttttaaaccattctgcatttaacagcgttgtgtgatagtgtacttattttgagggttttctgctaaactctttaaaaatgtatatatagtagttttttttctccttcgaatatcaaagtttaaaggtttcacatttattctgcattgtggtagaatgttctgaaaatacattgtgcatgtttcaaaggtttggctggctatgaaaggataagcatgaaaagtaataaagattataattttgcccatagcaaagctcaatatatttttaattaaaaagcagtctttgctgtatgcatatttgttcatatcctatttcctaagagcctaacatagctgccttctcatggtaaggagaacaccagttctttaagcaccttttatgtaagggagactttggaaaatgttacagatacagcagggagcaagacacagtccctgccttttaaaggaagtctagcatatttgggtcactcgtgtcaagttttaagaattaatattagattcttgagctacattatggcaagtttctgcaaatgttaatggctgaactatctcaagataggcagtgaagctggatggattcaattatgttttataagaccacatttgtatacttctgtgctctccactgtgttgacttttcaggatatcaggttgaaaagcaggccttgtgggatgtaattataaaagctttttttttgtcactttcaaattactttttttccctttttgtctctttcaatttactctttgagactggttcatcctctttcatgggttaacttaatttttctggttgcttttagataatacaaatcatccttc

SEQ ID NO: 10653 - DNA, 3916 bp, Homo sapiens; identical to SEQ ID NO: 10652

SEQ ID NO: 10654 - DNA, 441 bp, Homo sapiens; identical to SEQ ID NO: 10651

SEQ ID NO: 10655 - DNA, 408 bp, Homo sapiens
gggagcaagacacagtccctgccttttaaaggaagtctagcatatttgggtcactcgtgtcaagttttaagaattaatattagattcttgagctacattatggcaagtttctgcaaatgttaatggctgaactatctcaagataggcagtgaagctggatggattcaattatgttttataagaccacatttgtatacttctgtgctctccactgtgttgacttttcaggatatcaggttgaaaagcaggccttgtgggatgtaattataaaagctttttttttgtcactttcaaattactttttttccctttttgtctctttcaatttactctttgagactggttcatcctctttcatgggttaacttaatttttctggttgcttttagataatacaaatcatccttc

SEQ ID NO: 10656 - DNA, 1275 bp, Homo sapiens
tcttttttttggcctgtcttacctacagttgtattttcctctttaatcataaggatttacatcaggaaaaataacctgagaatagatgtgttttgtttgaatgtcgtagttgtgccctttgtaaaattaccccagggcatgataagaaaaggagtaagcaattaaaatgcacagggctacggcaagggcaggcagatctgagtggaggctgctgtcctgtgaagtagacctggcaggggatggctgctccgggctggcctgggcctcgctctgcctctgttgttgctctgacctttgacaaatcattcccttgcctgtgtctcggttgccccatctgagcgagaggctggactaaaaggtcactaaggtcacttgtagcctgaccttccatggctctataattctctttgttatctttggccacttacatgtttgccatgatcattgccaatcaaactaggaatgtttagcagattttagacactcagactggaaaatacagacgaggccatagaagttagtgttgtcctagggatggctcctggttcacgcaggctcctcatagggtccctgccgctacacaccacgagcccaccgagactgctgcagcctcgctcatccagaacagaggcaccatggccaggaggcccttcctttgttgggtaggagctgcccccgtccatgttccagctcctcccaggcccccatggataaaatagggccacaggtgacaagtgagttctgtgaccctgaccggcagcagctgccagcgaaggaggaaggaaacacagacaggaggtctcagagcacagcacgccagacctctagtccacacagtcctgcacacattgccgtctttgtttaaagagaggcggaggcagaccccaggcattcaaatgatagaatgcttctgctgtgcctgcatccttccctcctccactaggagcctctggttccagcccagatgaacccactgggctgggaacgccacacaaaagcactctccaagccagccagaggtccctgagggccaagacagggctgaccagaggcagtgtctggacatcctactgggagctcgggaggaggcagtgacagctcaggccagtaatgggtattcttgagagcaatcccaggtcatcaagggaagagaaggttatgcttcgtatactgtgttcaggggccagataagttttaatacgttccagaagtgtgctcaagcaaaaaaaattattagaatttttaaaaattaatatttgtgcttaaagagacaaa

SEQ ID NO: 10657 - DNA, 1274 bp, Homo sapiens
tcttttttttggcctgtcttacctacagttgtattttcctctttaatcataaggatttacatcaggaaaaataacctgagaatagatgtgttttgtttgaatgtcgtagttgtgccctttgtaaaattaccccagggcatgataagaaaaggagtaagcaattaaaatgcacagggctacggcaagggcaggcagatctgagtggaggctgctgtcctgtgaagtagacctggcaggggatggctgctccgggctggcctgggcctcgctctgcctctgttgttgctctgacctttgacaaatcattcccttgcctgtgtctcggttgccccatctgagcgagaggctggactaaaaggtcactaaggtcacttgtagcctgatcttccatggctctataattctctttgttatctttggccacttacatgtttgccatgatcattgccaatcaaactaggaatgtttagcagattttagacactcagactggaaaatacagacgaggccatagaagttagtgttgtcctagggatggctcctggttcacgcaggctcctcatagggtccctgccgctacacaccacgagcccaccgagactgctgcagcctcgctcatccagaacagaggcaccatggccaggaggcccttcctttgttgggtaggagctgcccccgtccatgttccagctcctcccaggcccccatggataaaatagggccacaggtgacaagtgagttctgtgaccctgaccggcagcagctgccagcgaaggaggaaggaaacacagacaggaggtctcagagcacagcacgccaggcctctagtccacacagtcctgcacacattgccgtctttgtttaaagagaggcggaggcagaccccaggcattcaaatgatagaatgcttctgctgtgcctgcatccttccctcctccactaggagcctctggttccagcccagatgaacccactgggctgggaacgccacacaaaagcactctccaagccagccagagtccctgagggccaagacagggctgaccagaggcagtgtctggacatcctactgggagctcgggaggaggcagtgacagctcaggccagtaatgggtattcttgagagcaatcccaggtcatcaagggaagagaaggttatgcttcgtatactgtgttcaggggccagataagttttaatacgttccagaagtgtgctcaagcaaaaaaaattattagaatttttaaaaattaatatttgtgcttaaagagacaaa

SEQ ID NO: 10658 - DNA, 579 bp, Homo sapiens
gcatgtgctcagaggctctccccggctggggccctgatggacactttgctcagaggcctctccagctctctgcaccgctccttcccttcctgcaggggcatcatggctgcaggtgtgccgcttctcccctctgttcctgcccatctttttgtccacatgtggcttcatccctctgcctcttaaggtggactctggttaggttgtctgggtggccacaggcatggctgccccatccctgcatcccaacagcctctcaaagcccccacccaggtcccttgccagggcttccttgtccaggagggaagtcctcccaagtacccctggagagccacctacagaaagttccagagaacagatggaagctcctactagactgactttggtgactggaaggaacatgctcaaaaggcacccccataccagtgtcacgtggaagagaggccagagaatggtggggatttgaacttgcatgtgctctgggtttacatcagaagtgtcctcccagcccttcccctacagggtgggttcagaggacacctgacccagttcaggagcaaccaaagggcgttgggggtctct

SEQ ID NO: 10659 - DNA, 579 bp, Homo sapiens
gcatgtgctcagaggctctccccggctggggccctgatggacactttgctcagaggcctctccagctctctgcaccgctccttcccttcctgcaggggcagcatggctgcaggtgtgccgcttctcccctctgttcctgcccatctttttgtccacatgtggcttcatccctctgcctcttaaggtggactctggttaggttgtctgggtggccacaggcatggctgccccatccctgcatcccaacagcctctcaaagcccccacccaggtcccttgccagggcttccttgtccaggagggaagtcctcccaagtacccctggagagccacctacagaaagttccagagaacagatggaagctcctactagactgactttggtgactggaaggaacatgctcaaaaggcacccccataccagtgtcacgtggaagagaggccagagaatggtggggatttgaacttgcatgtgctctgggtttacatcagaagtgtcctcccagcccttcccctacagggtgggttcagaggacacctgacccagttcaggagcaaccaaagggcgttgggggtctct

SEQ ID NO: 10660 - DNA, 924 bp, Homo sapiens
ccagctcgaaaaaatccatgcttttgagaccgagaatctgggaggagttttgagtcatgggcgtgaatgcaaaaggagagtaagagaatgggacgagacggggcagagccgagaatattacaaagaagggctaagctatgggcttcctttctgtctggttcttgcttgcatcttgccatgctatcatttgctacttttcttgcctcggtggtttgtaaaaaataagagccccgggtgcatgtgtcccctcattcactctgtgtgggcaaaggaaaatgaagcccttatggtcacctggtgtttctaactttaaaacagcctcatatctcttatttaattcacacagaaatcctgtgtgcagagccaaggatattcccattttatagacaaggaaatggagaaaaaggttgagaaaactgatcttccagtcacatttacctcttcctgcctcccacaagtgcttcctgggtcctatcccagggtttttttgtactttactgattttaacaaatacagcctttgatcactctcagctacctgccacactggtgccatcactaggtgagttataaagactcatcatcatgatactctccatgattgggagcattctatgtgccaggaatttttctgggggcttttcacatcgtatttccttctgatccccacaactctcctttgagatacacagtgttatgatgcccattgtacagatgaggtgaggtgctttaggccacacagccccagccaacacatgcagacatcacatagctaggaaatgcgaatccagcatctgaatgtgttagcacagagggtcccctccctggataaaaccttctggaactcccggtcatgtaagacaatgtccaaattcctcagtgtggtgtgcatgcacccctgcagccactgccctgcccctcgagt

SEQ ID NO: 10661 - DNA, 23386 bp, Homo sapiens
ctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacagggtggcttatacaacaaaagtttattttctcacagttctggagactggaagtccaaaatcagggtttagcttctcctgaggcctttctccatggcttgcagatggccacctcctcaccgctcccccatgcggccttccttccacacacaagcatctctgctgtctcttccccttcttcataagggcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagcgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccacggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacaacagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccctgttcctttgtacaaggaactccacattgtggacaggatcgtcactgaaccccactcagaaccagcacccttttctaagaaagaggagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttatcaatgtgggtggaggggttcccagcagcaagagagggcaagacccgacatctaacacctttcggtctctcctgacgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgacgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacatcgccaccacagaggctctcagcatggcccaggaggtggaccccgagggagacaggaccatcggtgagagtgggggagccccactgtgctcagtgagaatgggggagcccgcctgtgctcggtgagaatgggggagcccacctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgataaatgcagcatttcaaatcaaatagtggactatatcagcttgagtatctattagtggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattggtaagatttaaaatgatgagactatgtagagttgtaaacattcttacattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcaccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactcacaaaaaggcacagaaactcatgcttcactgctgcctttatcctaaaatgtcctataaaatgtgggaaaccctgtaataactcactctgtgagcacaaatttggatcgagtgagaagatacttgacttccttcctccaggcagcccatggtttaagtttttatcttggacaagatatcttgtgtctcttctcctcagtgttctgctacccatttatctcaatatgcttcaatgtatttgtatgaagatatgtctgtatccattatgatcacctacacatattacacatagaagggggtatgtgttataaaaacatatctatacatgtctgtgtatttttgtgatgaccaagtctatagtcagacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcagggggaatgctgatagactatatctactgggccaaaataaaaattaaaatcttatgcacaagctactaactcttcctttctcattgacaaccactattataatgtcttagtcattctaatgaacatattttttaacttctaaaagctttgtaaaagctctctgtggttctttttaaaagtctgcctgaatatagtgtcttcctttttcaaattttcttttcttttcttttctttcttttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcaaggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaagggggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcactcccccaaggctgatccaaagacatctggcccgtagcactcaaagggtggacagggctgagggaggcagggcagggagtgcagatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaagttaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaaccgaatacctgagactgggtcatttataaacagtagaaacttattgctcattgttctggaggtgagaaatctattcttaaggaatcaggaaatttggtgtctggtgagagcttgttctctgcttcaaagatggcaccttctagctgtgtcctctcatgggataagggacgaacaagcttcctcggacctcttttttacaggggtaccacaggcatacctcagagatattgtgggttcagttccagacaaaaagaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctggtacagaaacaaaaagtgagcatgtgctactggaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaattgataaaccaactggcttgtgtctgtgtgtagcggttggctttggctgtcataacaaagtaccacagacttgggggggcttaaacagtagaaatttattttcttacagttctggaggctggaagtccaagatcaagatgttggtggagctggttccttctaaggcctctctccttgccttgcagatggcctcttctcgttgggtcctcatgtggttgtccctcagtgtgtgtgtcctcatctcctcccacaaggacactaggcagatgggatgagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagttatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgttgggattacgggcgtgagccactgtgcctggcctgaaccatatatttttaacagagtgaatgttatactatgtaaatgacatctcaattagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtaggggcctgaacacagaagcttctgtccccacggggttgggggcaccatcctcatggcacagagatgtggtcatcaaccagggagctcttggaacctcaccgcggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgaccttttagccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccccgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagttatctccccctgagtccctcccacaacaggtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccggtcataggtgggttcagagattttctggttgacgattgcttgaaagagttaaactttgtctacaaacttgacatcaatagaaagaaatgcctgagttaaggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttggttgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacagaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcctggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtccgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgggttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcaggaagagcaggccagaaattgcagcaggagctaaggctgagtccacaggcggaatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccatctccaggaccctatcaccttcccacactgaaactctgtccccattaaacacattccccattccccgcccctgaatccctgacagctaccatcctactgtctgtctctgtgaattcaactaacctaagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacact

SEQ ID NO: 10662 - DNA, 33042 bp, Homo sapiens
cttcgcggcgcggggcggggctgggcgcggggtgaaagaggcgaagcgagagcggaggccgcactcccgcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttccccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaacccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcagtttcccaaaaggtttcagggtgacccagcaggcaatgagtgattctcaaattcaggatttattgtgagagattcacacacacaattgagcagacattcacagtacaatgattaaagggagtgattagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgccagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgacaagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggaataagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcggattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcgttggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagccttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatctttagtagagatggggtttcactatgttggccaagctcgcttcgaactcctgacctcaggtgatccactcaccttggtctcccaaagtgctgggtgggatacaggcgtgagctactgcgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcccgagtagttgggattacaggtgcccgccaccatgcctggctaatttttttgtatttttagtagagacaagttttaccatcttggccaggatggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctatgctctggggacatcaccgtgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccataatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctaagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccactgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcatgatctggcagttccacttctggggatagactgtggttctcaaagtgtggcccccagcccagcccattagcatcacctgggaagttgattgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccactttaggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatcttgctatttgttttctatttgtcccgtctgttcttcgttccccctttcgtctttttctgccttctcttggattattttttatgattccatcatgtctcctttgttgtcttattaagtataactcttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggtggcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacagggtggcttatacaacaaaagtttattttctcacagttctggagactggaagtccaaaatcagggtttagcttctcctgaggcctttctccatggcttgcagatggccacctcctcaccgctcccccatgcggccttccttccacacacaagcatctctgctgtctcttccccttcttcataagggcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagcgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccacggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacaacagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccctgttcctttgtacaaggaactccacattgtggacaggatcgtcactgaaccccactcagaaccagcacccttttctaagaaagaggagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttatcaatgtgggtggaggggttcccagcagcaagagagggcaagacccgacatctaacacctttcggtctctcctgacgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgacgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacatcgccaccacagaggctctcagcatggcccaggaggtggaccccgagggagacaggaccatcggtgagagtgggggagccccactgtgctcagtgagaatgggggagcccgcctgtgctcggtgagaatgggggagcccacctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgataaatgcagcatttcaaatcaaatagtggactatatcagcttgagtatctattagtggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattggtaagatttaaaatgatgagactatgtagagttgtaaacattcttacattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcaccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactcacaaaaaggcacagaaactcatgcttcactgctgcctttatcctaaaatgtcctataaaatgtgggaaaccctgtaataactcactctgtgagcacaaatttggatcgagtgagaagatacttgacttccttcctccaggcagcccatggtttaagtttttatcttggacaagatatcttgtgtctcttctcctcagtgttctgctacccatttatctcaatatgcttcaatgtatttgtatgaagatatgtctgtatccattatgatcacctacacatattacacatagaagggggtatgtgttataaaaacatatctatacatgtctgtgtatttttgtgatgaccaagtctatagtcagacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcagggggaatgctgatagactatatctactgggccaaaataaaaattaaaatcttatgcacaagctactaactcttcctttctcattgacaaccactattataatgtcttagtcattctaatgaacatattttttaacttctaaaagctttgtaaaagctctctgtggttctttttaaaagtctgcctgaatatagtgtcttcctttttcaaattttcttttcttttcttttctttcttttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcaaggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaagggggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcactcccccaaggctgatccaaagacatctggcccgtagcactcaaagggtggacagggctgagggaggcagggcagggagtgcagatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaagttaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaaccgaatacctgagactgggtcatttataaacagtagaaacttattgctcattgttctggaggtgagaaatctattcttaaggaatcaggaaatttggtgtctggtgagagcttgttctctgcttcaaagatggcaccttctagctgtgtcctctcatgggataagggacgaacaagcttcctcggacctcttttttacaggggtaccacaggcatacctcagagatattgtgggttcagttccagacaaaaagaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctggtacagaaacaaaaagtgagcatgtgctactggaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaattgataaaccaactggcttgtgtctgtgtgtagcggttggctttggctgtcataacaaagtaccacagacttgggggggcttaaacagtagaaatttattttcttacagttctggaggctggaagtccaagatcaagatgttggtggagctggttccttctaaggcctctctccttgccttgcagatggcctcttctcattgggtcctcatgtggttgtccctcagtgtgtgtgtcctcatctcctcccacaaggacactaggcagatgggatgagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagttatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgttgggattacgggcgtgagccactgtgcctggcctgaaccatatatttttaacagagtgaatgttatactatgtaaatgacatctcaattagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtaggggcctgaacacagaagcttctgtccccacggggttgggggcaccatcctcatggcacagagatgtggtcatcaaccagggagctcttggaacctcaccgcggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgaccttttagccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccccgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagttatctccccctgagtccctcccacaacaggtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccggtcataggtgggttcagagattttctggttgacgattgcttgaaagagttaaactttgtctacaaacttgacatcaatagaaagaaatgcctgagttaagggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttggttgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacagaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcctggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtccgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgggttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcaggaagagcaggccagaaattgcagcaggagctaaggctgagtccacaggcggaatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccatctccaggaccctatcaccttcccacactgaaactctgtccccattaaacacattccccattccccgcccctgaatccctgacagctaccatcctactgtctgtctctgtgaattcaactaacctaagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacact

SEQ ID NO: 10663 - DNA, 33068 bp, Homo sapiens
cttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgaccagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggagtaagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcagattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatatttagtagagatggggtttcactatgttggccaagctcgcttcgaactcctgacctcaggtgatccactcaccttggtctcccaaagtgctgggtgggatacaggcgtgagctactgtgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcctgagtagttgggattacaggtgcccgccaccatgcctggctaatttttttgtatttttagtagagacaagttttaccatcttggccagggtggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccagaatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctgagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccaccgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcgtgatctggcagttccacttctggggatagactgtggttctcaaagtgtggcccccagcccagcccattagcatcacctgggaagttgactgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccacattcggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatctttctatttgttttctatttgtcccatctgttcttcgttccccctttcgtctttttctgccttcttttggattattttttatgattccatcatgtctcctttgttgtcttattaagtataacttttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggcagcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacggggtggcttatacaacaaaagtttattttctcacagttgtggagactggaagtccaacatcagggtttagcttctcctgaggcctttctccatggcctgcagatggccacctcctcaccgctcccccatgcggccttccttccacacacaagcatctctgctgtctcttccccttcttcataagagcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagtgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccccggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacagcagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccccgttcctttgtacaaggaactccacattgtggacaggatcgtcactgaaccccactcagaaccagcacccttttctaagaaaggagagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttctcaatgtgggtggaggggttcccagcagcaagagagggcaagacccgacatctaacacctttcggtctctcctgatgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttttaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgatgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacattgccaccacagaggctctcagcatggcccaggaggtggaccccgagggagacaggaccatcggtgagagtgggggagccccactgtgctcagtgagaatgggggagcccgcctgtgctcgatgagaatgggggagcccgcctgtgctcggtgagaatgggggagcccgcctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgatgaatgcagcatttcaaatcaaatagtggactatatcagcttgagtatctattagcggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattgataagatttaaaatgatgagactatgtagagttgtaaacattcttgcattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcgccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactctcacaaaaaggcacagaaactcatgcttcactgctgcctttatcctaaaatgtcctataaaatgtgggaaaccctgtaataactcactctgtgagcacaaatttggatcgagtgagaagatgcttgacttccttcctccaggcagcccatggtttaagtttttatcttggacaagatatcttgtgtctcttctccccagtgttctgctacccatttatctcaatatgcttcaatgtatttgtatgaagatatgtctgtatccattatgattacctacacatattacacatagaagggggtatgtgttataaaaacatatctatacatgtctgtgtatttttgtgatgaccaagtctatagtcaaacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcaggggggatgctgatagactatatctactgggccaaaataaaaattaaaatcttatacacaagctactaactcttcctttctcattgacaaccactattataatgtcttattcattctaatgaacatattttttaacttctaaaagctttgtaaaagctctctgtggttctttttaaaagtctgcctgaatgtagtgtcttcctttttcaaattttcttttcttttcttttctttcttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcagggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaaggaggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcgctcccccaaggctgatccaaagacatctgacccgtagcactcaaagggtggacagggctgagggaggcagggcagggagtgcggatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaaattaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaactgaatacctgagactgggtcatttatgaacagtagaaacttattgctcattgttctggaggtgagaaatctattcttaaggaatcaggaaatttggtgtctggtgagagcttgttctctgcttcaaagatggcaccttctagctgtgtcctctcatgggataagggatgaacaagcttcctcggacctcttttttacaggggtaccacaggcatacctcagagatattgtgggttcagttccagacaaaacaaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctgatacagaaacaaaaagtgagcatgtgctactggaaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaaatgataaaccaactggcgtgtgtctgtgtgtcgcagttggctttggctgtcataacaaagtaccacagacttgggggagcttaaacagtagaaatttattttcttacagttctggaggctggaagtccaagatcaagatgttggtggagctggttccttctaaggcctctctccttgccttgcagatggcctcttctcattgggtcctcatgtggttgtccctcagtgtgtgtgtcctcatctcctcccacaaggacactaggcagatgggataagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagatatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgctgggattacgggcgtgagccactgtgcctggcctgaaccatatatttttaacagagtgaatgttatactatgtaaatgacatctcagttagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgaacctggctctgcactccccttcctgagatgactaaggaaaattatcttcagatctggttttgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtgggggcctgaacacagaagcttctgtccccacggggttgggggcaccaccctcatggcacagagatgtggtcatcaaccagggagcccttggaacctcaccacggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgacctttttgccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccctgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggtacgtcttcgcgtggttcaggatgccagcttccattctttccttttcttctgaacgcctctctctttagtcttgctttctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagacttactcactaccatgagaacagtattggagaaactgcccccatgattcagttatctccccctgagtccctcccacaacatgtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccagtcataggtgggttcagagattttctggttgacgattgcttgaaagagttaaactttgtctacaaacttgacatcaatagaaagaaatgcctgagttaagggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttgattgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacggaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcccggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtctgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgcgttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcagggagagcaggccagaaattgcagcaggagctaaggctgagtccacaggcagcatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccacctccaggaccctatcaccttcccacactgaaactctgtccccattaaacacattccccattccccgcccctgaatccctgacagctaccatcctactgtctgtctctgtgaattcaactaacctgagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacact

SEQ ID NO: 10664 - DNA, 33072 bp, Homo sapiens
cttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgaccagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggagtaagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcagattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatatttagtagagatggggtttcactatgttggccaagctcgcttcgaactcctgacctcaggtgatccactcaccttggtctcccaaagtgctgggtgggatacaggcgtgagctactgtgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcctgagtagttgggattacaggtgcccgccaccatgcctggctaatttttttgtatttttagtagagacaagttttaccatcttggccagggtggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccagaatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctgagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccaccgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcgtgatctggcagttccacttctggggatagactgtggttctcaaagtgtggcccccagcccagcccattagcatcacctgggaagttgactgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccacattcggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatctttctatttgttttctatttgtcccatctgttcttcgttccccctttcgtctttttctgccttcttttggattattttttatgattccatcatgtctcctttgttgtcttattaagtataacttttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggcagcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacggggtggcttatacaacaaaagtttattttctcacagttgtggagactggaagtccaacatcagggtttagcttctcctgaggcctttctccatggcctgcagatggccacctcctcaccgctcccccatgcggccttccttccacacacaagcatctctgctgtctcttccccttcttcataagagcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagtgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccccggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacagcagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccccgttcctttgtacaaggaactccacattgtggacaggatcgtcactgaaccccactcagaaccagcacccttttctaagaaaggagagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttctcaatgtgggtggaggggttcccagcagcaagagagggcaagacccgacatctaacacctttcggtctctcctgatgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgatgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacattgccaccacagaggctctcagcatggcccaggaggtggaccccgagggagacaggaccatcggtgagagtgggggagccccactgtgctcagtgagaatgggggagcccgcctgtgctcgatgagaatgggggagcccgcctgtgctcggtgagaatgggggagcccgcctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgatgaatgcagcatttcaaatcaaatagtggactatatcagcttgagtatctattagcggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattgataagatttaaaatgatgagactatgtagagttgtaaacattcttgcattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcgccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactctcacaaaaaggcacagaaactcatgcttcactgctgcctttatcctaaaatgtcctataaaatgtgggaaaccctgtaataactcactctgtgagcacaaatttggatcgagtgagaagatgcttgacttccttcctccaggcagcccatggtttaagtttttatcttggacaagatatcttgtgtctcttctccccagtgttctgctacccatttatctcaatatgcttcaatgtatttgtatgaagatatgtctgtatccattatgattacctacacatattacacatagaagggggtatgtgttataaaaacatatctatacatgtctgtgtatttttgtgatgaccaagtctatagtcaaacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcaggggggatgctgatagactatatctactgggccaaaataaaaattaaaatcttatacacaagctactaactcttcctttctcattgacaaccactattataatgtcttattcattctaatgaacatattttttaacttctaaaagctttgtaaaagctctctgtggttctttttaaaagtctgcctgaatgtagtgtcttcctttttcaaattttcttttcttttcttttctttcttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcagggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaaggaggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcgctcccccaaggctgatccaaagacatctgacccgtagcactcaaagggtggacagggctgagggaggcagggcagggagtgcggatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaaattaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaactgaatacctgagactgggtcatttatgaacagtagaaacttattgctcattgttctggaggtgagaaatctattcttaaggaatcaggaaatttggtgtctggtgagagcttgttctctgcttcaaagatggcaccttctagctgtgtcctctcatgggataagggatgaacaagcttcctcggacctcttttttacaggggtaccacaggcatacctcagagatattgtgggttcagttccagacaaaacaaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctgatacagaaacaaaaagtgagcatgtgctactggaaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaaatgataaaccaactggcgtgtgtctgtgtgtcgcagttggctttggctgtcataacaaagtaccacagacttgggggagcttaaacagtagaaatttattttcttacagttctggaggctggaagtccaagatcaagatgttggtggagctggttccttctaaggcctctctccttgccttgcagatggcctcttctcattgggtcctcatgtggttgtccctcagtgtgtgtgtcctcatctcctcccacaaggacactaggcagatgggataagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagatatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgctgggattacgggcgtgagccactgtgcctggcctgaaccatatatttttaacagagtgaatgttatactatgtaaatgacatctcagttagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtgggggcctgaacacagaagcttctgtccccacggggttgggggcaccaccctcatggcacagagatgtggtcatcaaccagggagctcttggaacctcaccacggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgacctttttgccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccctgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggtacgtcttcgcgtggttcaggatgccagcttccattctttccttttcttctgaacgcctctctctttagtcttgctttctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagacttactcactaccatgagaacagtattggagaaactgcccccatgattcagttatctccccctgagtccctcccacaacatgtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccagtcataggtgggttcagagattttctggttgacgattgcttgaaagagttaaactttgtctacaaacttgacatcaatagaaagaaatgcctgagttaagggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttgattgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacggaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcccggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtctgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgcgttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcagggagagcaggccagaaattgcagcaggagctaaggctgagtccacaggcagcatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccacctccaggaccctatcaccttcccacactgaaactctgtccccattaaacacattccccattccccgcccctgaatccctgacagctaccatcctactgtctgtctctgtgaattcaactaacctgagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacact

SEQ ID NO: 10665 - DNA, 401 bp, Homo sapiens
tttgtgtgagcaacatggctgtgtatttcacctgggtgcaggcgggctgagtccgaaaagagagtcagcgaagggagataggggtggggccgttttataggatttgggaaggtaatggaaaattacagtcaaagggggttgttctctggtgggcaggggtgaatctcacaaagtacattctcaagggtggggagaattacaaataaccttcttaagggtggggaagattacaaagtacattgatcagttagggtggggcaggaacaaatcacaatggtggaatgtcatcagttaaggctgtttttacttcttttgtggatcttcagttactttaggccatctggatgtatacctgcaagtcacaggggatgcgatggcctggcctgggatgcgatggcctg

SEQ ID NO: 10666 - DNA, 401 bp, Homo sapiens; identical to SEQ ID NO: 10665

SEQ ID NO: 10667 - DNA, 401 bp, Homo sapiens; identical to SEQ ID NO: 10665

SEQ ID NO: 10668 - DNA, 597 bp, Homo sapiens
tatgctagtactttaaaaggaaataagggaaaagccggtcttaactatatagatttttttttaacataaatggctgctatttggcactttgctttttgcacttacctagatgtcctggacatctctccacgtccacttatagacaactgcccaggtgttttcctggctgcagagatgatgtggactgaattcatttggccaatccccaggcaatggccacttaggttatttcccaagttttgacaccacaaacaaagctgcagcgagtgaatcagcttgtctgggctcgtgtgtctgtgaaaactatgtggcaacactgaaacagattgcacacccaaagcctgacttctggctcctcttgggaatcagaagctctgcctccctggcccacacgccatacttttagaagccccactgccccagagccctatttgtccatgaattcctgactcattgtctggagcctgcttgagggaggctgggcagggtgtgagccaccaggattaaaggttgtttgtagcctctgcctccaaatagttacctgcaaaaggggacaagtgaagccacaaagattctactttaaaaaaagaaaaagaa

SEQ ID NO: 10669 - DNA, 597 bp, Homo sapiens; identical to SEQ ID NO: 10668

SEQ ID NO: 10670 - DNA, 110 bp, Homo sapiens
gctactcgggaggctgaggcaggagaatcgattgaacctgggaggtggaggttgcagtgagccgagatggcaccactgcactccagcctgggtgatagagtgagactctg

SEQ ID NO: 10671 - DNA, 110 bp, Homo sapiens; identical to SEQ ID NO: 10670

SEQ ID NO: 10672 - DNA, 583 bp, Homo sapiens
  misc_feature (136)..(136): n equals a,t,g, or c
  misc_feature (356)..(356): n equals a,t,g, or c
  misc_feature (511)..(511): n equals a,t,g, or c
  misc_feature (571)..(571): n equals a,t,g, or c
tggtggatgcctgtagtcccagctactagggaggccaaggcaggagaatcgcttgaatctgggaggtggaggttgcagtgagccgagatcacaccactgcaccccagcctgggcaacgagtgaaacttcctctcanaaaaaaaaacactgcactgagaggcagaagacctaatctcctgaacctctgtgtatctcagtgtcatcatggacatgatgagactggataagcctcagagcctctggggaaggctgtttgcaaacatgaccacagtttctcccatccctataagttgcctctttgcagcttgacattgctgcttctcttgtcaagaagtggagatttttttcccctctcncttgaatctgggctagctctgtaacttgctttgaccaatagacagaagtgacctgatgtgacttttgagtctaagccttaattgcctccactgtcaccgtcttggagcgatagtgtagccctgtgaagaagcctgggctggcttccttgaggatnaaaagaccaggtgccacagaaaggcagtcatgtgagtcagccccaggcaaaaccagcagnaaaaaaaaaaaa

SEQ ID NO: 10673 - DNA, 531 bp, Homo sapiens
  misc_feature (41)..(41): n equals a,t,g, or c
  misc_feature (124)..(124): n equals a,t,g, or c
  misc_feature (134)..(134): n equals a,t,g, or c
  misc_feature (181)..(181): n equals a,t,g, or c
  misc_feature (194)..(194): n equals a,t,g, or c
  misc_feature (294)..(294): n equals a,t,g, or c
  misc_feature (474)..(474): n equals a,t,g, or c
cccccaaaaaaacctcataaacaaaaattagatgtaaatgngacaaaatgagggaatatctctagcaactatacagctcttaaaatcaacttttaaaaatatgcatagcggccaggcacagtgngctcacaccntataatcccagcactttggaaggctgaggcaggaggattacttgagncccacgagttagnagaccacccggggcaacatggctaaactctgtgtctacaaaaatacaaaaattagctgagcgtggtggtgcgcgcttgtggtctcagctacccgggagtnctgaggtgggacagcggctcgggcccaggaggtcgaggccgccgtgagctgagatcaccccattgcaacagagtgagaccctgtctaaaaaatagcaagataaaaataaaaacatgcataatgatgaaaatctaaagccgggttgtggtactgtttgcccaatcttacaaatttcccccncaaaaaagcactgaatcgtacacttaagtgaattttacggtagatggattctatctc

SEQ ID NO: 10674 - DNA, 225 bp, Homo sapiens
  misc_feature (26)..(26): n equals a,t,g, or c
ggtgaaaccccgtctctactaaaaantacaaaaaaaaaaaaaaaattagcctggtgtggtggtgggcgcctgtagtcccagctacttgggaggctgaggcaggagactggcgtgaacctgggaggcggaggttgcagtgagccaagatcacaccactgtactccagcctgggtgacagagcaaaactccatctcaaaaaaaaaaaaaaaaaaaaaaaaaaaaaaa

SEQ ID NO: 10675 - DNA, 21710 bp, Homo sapiens
gatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcaggtgggtgtctggaagggcagacactgcccctgggcccgggcaagatcgggcaggtgggagggaggtcgggagagggaaaagcttgttgcgggggcaggagggggttcctgcccttcccaggagctttggttcctgggaagcggcagaggcttttccaaacccaggccccctgcctctgcctcagcgtggtctgtgacttcaggattctgttgtatacaggcagtgtttgttgagcacgtaatcagtgccaggaacgtccatgctgttttccaaataaccctgcccgtttatgtgagctccgtgtgcacgtgtgtgatgtatgcacgtgtgtgtgtatgtgcgtgcacatgtgtgttgctgtgcgtgtatgagtgtatgtgcatgtgttgtatgtgtggggggtgtgtgtgtgcatgtgtgatgtgtgttgcgtgtgtatgagtgctggtgtgtgcatgaatggtgtgtgtggtgtgtttatgtgtggtgtgtgttgctgtgtgagtgctggtgtgtgcatgagtggcgtgtgtgtggtgtgtgttgctgtgtgtgtatgagtgctgatgtgtgcatgagtggtgtgtgtgtggtatgtgttgctgtgtatgtttgctggtgtgtgcatgagtggtgtgtgtggtgtacgtgtggtatgtgttgctgtgtgtgtgtgtttgctggtgtgtgcatgagtggtgtgtgtgtgtggtgtgcatgtgtggtgtgtgcatgtgtggtgtgtgttgttgtgtgtgagtactggtgtgtgcatgagcagcatgtgttgctgtgtgtatgagtgctggtgtgtgcatgagtggtgtgtgtgtgtgttgtgtgtgttgctgtgtgtgtatgagtgctagtgtgtgcatgagtggtgtgtgtgtggtgtgtgtgcatgtgtgttgctgcaccctttacagggagcacttctacatgtgttatttcactcaatgctgagaatgatccttttgaggctgcaaggccggaagtgatttcccagctccagatccttggatgggcctgacatcaggctcctgtccccacggcagcggtcccagcctctgcgcctgccacctccagtccccgagcccacagcgccacccaggttgtcttttctcatgtgtcagcgctcattcttcacttctggctctggaaggctgtcgccttcacccaggcaagctctcccacatcagcacttgggccacacctcatttctttcactgtgtgctctctgaggcctgtaaccactgcccctcaacccaaattcttccatcttcaccagcatgagatagctccccttttttcccttcgtctctgagcttttaaaaaagtctaactggtttgccttgcttaatcctcttttccctcttaacccatggagacagagtttttgcccccatcctgacattgttttctaaggactgctggatggggtgttgccgtccctccttgaagtgcatctgccccatccagaggtctccctccctcccgctgctccccagactgctgccacctctcggcatccccttcatggcctctccagcgttccgacctgctcagccctctccgggtcagacaccagcatctgcctcttctctctgtctttagggattttcttctgacttccaggcctgccatccaggtgggcacgggtgcccgcagagcccaccgggggctcaagcatcacccttatttccgaggacagcagggcaccctgacctctgctgccctcagtcccttcccctcctgtggacttcctgctgtcccttagactggccacgcccactcctgctcttgctcctctgcaggggtccttccctctccagcccagcatggtctccatccagcctctgcccacattccctccccagggaggcctggccctcttggctagcaccaccctcccatttgtcagctaaaccatcactactagacatgtcacatctttgttgatctcctgtgctcctcactgggttgggagtccccagagggcagggacctggtcttgtgcacagtgatcccagcacccgaccccacacatgaaaaaggcccagtaaacatctggtgatggaaccagtgggggcagtcagtccccatggcccccgaccccattggtcccaactagctagtgtgtcctgtttcttgtctttgctctgcccagtgccgtgccttgaggtgctctcctgggctgtggcagcagtctcctggtcaccctgccacagatggcctccttccagctcctgcgtcactcgccttccaaaggcacatctgggtgtgtgcaaggtggcatcttctgagtgctgtcagctgtcaggccctgcgctgaggcaggagtgtgcacacagcacgtgctggtgcactgaattctcactacagccctgtgagatacatcctgttgtccccacgacattgagtggctcaccggggccacggcagcaaggggcagagccaggtgttaagctgcagctgccaccactcagccctcttgggtcctgagcacaccatcatctgacacccacgtggcctgtactcagcttctcccttttcttccctgcgggaaccttccagtccccacccaggaccctgtcccctctgcatcctgtggcctcatcctcttctgtagcagggactgggactgtgtactgtgagtctctgctgagcttgactcccttggacgtctctgaattctcagagtcttgcacgatgcctggcacatgtggacagaatgagtggtcctcctctcatggtaagggacacccttccccagtgcagcatggctgtgtgttggtggagggcacccgcagccctgccctccctcccacaggagcgctcttgcgtcagagccccgagctcgccgtggtctggggtcttccaggtgacacctggcctccttggaggcaagtcacacagcattgacgcacttctcagacagtccttgtcgagtccccacatgccctcacagacagagaacccgctgacaggcggcagggacggctcaggcacattcatatcagagctgtcaaggtccaggtttctacctttgaggctttggggtttaattacctcggcagggcgggggaggtggccaggctgcagtatcgacccggcgcctgctgccctgacattatgagactagaggcagggatgataaacttgctgctgtcctgcacccccgcaaaacagcgctgctcttctcttaatattgtctttctggtgagcaagggaggccgtgcaagcagccagctgtctgaagcttctgtgcctggggatgcacagtggggaacagggtggggaaggggtgcccgcagattcagctgagagagagtgaagctcccagggcagatgtgagacacacatgagaaggcaaagaatggcccaagccagggctgaaggacacatttttgggacccacgtgatgtgtgctttggtgcatgtgcccctctctgccctgccttcgagtgtgggctctgaagccctgccaggccagcagggcccatgttttcagttcctgggtggacacgtcagttccatgaggcgagacctccctctgtgtccttcccctccgtgcccagaaccgtgctgtgtcaagtgacagcactagggcagccagacccccatctgtcttgcagggtttatgagggacttgcgtgggactcatgaggaaagcaacggcccagagggaaggcgtctgggagggccagcaggttcaagcactcaggatgtagagtgcttctgcttggtggggaggatctggaaaagctactggtagatacggcctatgagaagtgcctcgaaggatgactgggatcttggtgggagggaaaggactgtgggatctgcagaggtgaggcgtgggaagctcagggcatactcaggggctggcatgagggccacctaccttcagttgtagctggaatcaggggagaaacaggacacagggcttggaaaagatccagatacagaagggcaggaccccaggctggggactcctgtatatttgtggaggcgcagggtggtggctgtgctgaaggttctttctacaggtggccggtggccctgggttgctgggggtggggcaggcagcgagagccatggtccccctctcccctctctttgctgccctgtcagtagccctgtgggtgatgtttgcctctgctgccttttgttcctgggggatggacaaggggagaacatctgcctcccacctggtccccagtgatggcctttttctccctagtgcttagcgaatgccacagacggcgtgcggctagcagcccgcatcgtggacacaccctgcaatgagatgaacaccgacaccttcctcgaggtttgtggcgtcatcaggccgggggtgggaccaggctggggtgggtgtcatagactcccaggagagccagaggaaacctggggctgtccacaccctgacgtggccagggaacctcagggctgccctcggcggagcgctgctgtctgccgggctccaggaagcctcaggaaagggtgtgtggggaggacagagcctcctcttcaaggccccttggcaggaccacagccagagctacaggaaatgagagtgtgtggagggtgagccccctcttctgggtttcatcacacgcgaagctggctcccaagcccggctccccgacgcggcacaggcagcggttcatccctggccccagcctcggcctctcctgtttccagccatcttcatgtgttgttgtgctgttgttttttccatgaacatgtccaggagattaacaaagttggaaaggagctggggatcatcccaaccatcatccgggatgaggaactgaagacgagaggatttggaggtgggtgggggctgcatccctgcagctcttggcctcgggcagtggccaggggcacttgggtggcagggggtcggcgggccacatggcacattgtcccaaacttcatcctgcttgtgacctgaaaggaatcagcctgtgtccaagcccagtgccggaccctgggaagcagccgtccctgggggagaaggggaggcaatccagattctgatttggattctggaagctgctagatccaagtccttccctgcctgcagcctctccagcgtcctcgcgtgctgcacacccttactcctgggactggctcagcagggcctttctgttccttgaatacacaagttcccatcacggcaggcagggcctgtgtgcggatggctctccctatctggaatactttcccccaagatatatttttggtggaggccatctcaaccaatgccccctcctcagagaggccttccccaagtccccagacccacctttccccactgcccaggaaccagaggggcagataagtatgactcagctgccccgtggtgcttgtagactggcaagaggaaggcggctgtctgtgttatgtgtggctacaaaacaaatcactcggaagatagcagctgaatgcagcaacacttatcccctccccgtgctgtgggttggggatcttcccctggtgcagcgtctctgcctgctgttgtcaggttgttggctggggctgcagtcatctgagggcttgcctggggctggcgatgtgcttccgggcaggctcacaacaggctgctggcaggtctcagggcctcacaggccattagctggaggcagcaggtccttgctgtttgagccaccctccgagcaaggtctctgagcgagagatagggataaagagcgagcaaacaagatggaaactcccatctttttctgtgacctaatcccaggagtgatatctcatcacttctacctttttcttttggttagaggtgagacatcaggacctgctcacatgagggggagggactgcacaaggacatgaatacccagacgtgggggccacaggggccatcctggtggtgtctacctagacaggagccatttacaagtggagggagaggccgcttgtgtcaggaaaagcttcacagaggaggtggcatttgctgtggatcttacaggatgagttggagtttgtcaggcagccatgattagctctcgtcattgttgctatgattgtttgactcaattattgcaggactttgagccatagactctgcacacgcacaggccacagctttcttgagaagatgtgtcatgtaaaccaaagaggcagtggtgcagggactgtgggagcgagtgtgaaagggcggtgcagtccctgagtgctcaaaggattcaggaagtggggacgagcatgggctggggcagccttgaggtgttatccaaacatcgtttcattctgcaatcctgttcttttctttctggaaaggatacaatatttttttcccttagtgggttttcttgcttaacaaacaacactttgcatagaatttgtttgcaatctcagacattggagctaatttgcattccccaatcccacactggccaggggcaggagaaggggcagggagcaccaggctcaggcaggcggctctccaggagaaacaccagccggccagagtttccaggggcctctgggagttccccgctcagctcagcccgagcctaacccagttctccccacgctttccataggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaaggtgaggtgcgggctggctctcagggtgccctgggggaggggaggggaaggtgaggtgcagggcccggctctcccgggtgccctggggtggggtggggtggggtggggaggggaaggtgaggtgtgggcccggctctccagggtgccctggggttggggtggggtggggtggggaggggaaggtgaggtgccggcaggctctccagggtgccctgggggggggggaggggcccagtttgggtccagccagccctctgagaggtgtcatggggtggggggcggcgaggtttctgggggttctgggttggggtgggttcggggagagtgcgcagggcgggttcccatgtgctgaggcgacagcttcacgtggctccctgggtttcatgcccacccttcagaagggtctggaaacaaaagcctggccagggcccaagagcagccccggaaatgacggaagaaatggcaagcagggccagggaggcagggcttgctgcttgggggctttgtcccgagaagagaagggcaaggggacgcctgtgtctctgagtctgcccatggtccccactgagaaaacgctcagagtggccacacaagaccctccaaaggcacgtgacccccaagagcgaggggaatctgggcacggcacagaagcgagtcacccgggaacatcccggtgcggtggccctagaagcctgtcccgtggtacggctttctgtcctgccatcccaggaggacaggtgcttgtggagcccccgtcgtggccgagtctgcccgccccagcaagccctgccctcctccgcaccatctccatccattcatcctacacaccgtgtgagcagcctctgtgctcaggcctgggctgggaaggacagggagggagcagactgggaagtacatacctcaggaggtctggaaggagcagggagtgcatccgcagcagacactgcaaactagcagcctgcaaggctcacggaggcctggcatttttaaaatttgaattagctaccaatatttgaaaccaggaaggattctcatcaaagcctggatttccggccttttgtgcactcagaaggtctgccagtgctggcgttctgttcccgcctggcagcattcccctgcagccagtgggcctgcccctggtgtcacccattctccagtttggtttgcggtaggccccaccacttgctgctgccttcctgacactgagccctagtgtcagctgctgttcagggtggcgctggtgcagctcgccgcgctctctagcacgcctagtttatttcatacctggagaggatgagcagttcccatccctcctctaaaccacaaaactgtttagaactaagcagaaaatgacactaatcataaaaagggttttttgtttttttttaatagaaaaaacatgcctccctatgggtctcttggggtaatagatggtggaatgaatgtttgtttctggctttgggtcttagcatctacacgtttgacaatggtttcatttaaattgatcttctttactaatgtatgttcagtaggcagagttgccagctgtcttcactcatagttggtccaagaatactatctgttaactttgattttgaagagctccaatctcgtgaggcaacagatacacagatacttaggaaaagtctttaatacggtatcatttggcagagattcttaaaaatcccatttcacagtaaattccagcaatcacaacacccactgtgtgttcagttcttcagggtggattcttgtggctttcagatgtctgcagaacaaaagcattttggacacagtaactccaagtgttcacatggaatgagggaagtgaaggaacgcaggttccgcgtcttcgttttgaccatcccgcactctcgtgttttattttgggtcctctgtttcgacaccgggaggtaggaaatcatgggccctggaggccccgactgtgcccagagccagcccacaggatctgactgtcagagcgattctcagaaggaatgtgggtagtagattttgtgtcgggtcattgctaacgtccatgtaatgttactttcaggataagtaacaacgatatgcgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttctgaaaatgcgactatagcccctgcctattcccggggtccacctggtctgcagaccccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaagtaagaggctcagtttgttccttttctgggaaatatctgccagatacctaaatccaattaaatgccatttgtctgtcagtttttctttcaagtaaagatggtgtcgtggccagagtggctcatggagctcagaactcccccagcaatcacagctgagcttctgctctgaccgaccactgcccgtcagcaacagcaggagtacattatgagtcacacggaatatggaaaatgtattgtacccaagggttgagagttttaaaaattaattttactgcttcagcaaggaaattctaacgtgaaattggcattggttcattttcccagagggcacggaaacgaatacagtggctcccggacctctttgggactgtggcctgatactccagcacagggggtgtaagtgtcagccccgtgaaaaaggcagagaccgtcttaaatcactgcgaaaatggtttcttctataaaaacagaaacaacatatgggggctggtgaaactttgcacaatcaatcagttgagctgtatttgcaagcccagtcctggctccacctgcaattgggaaggagctggcagctgtgacgggggagacatggtgtacagtgagcagccgtttccaggcattgctgtgtgacccattttgcacatggtttgattccagatcggaggccctgtttttccatttaaacaatcctgtgctttctcaaacagattagctcagaagagatggcttattttcagtagtacaagatgggtcattttcactcaattataaaagcagctcaatttacatctaaaaatactttgcactaaaattcaaagcttgtgtaataagataagggttcaaaaatgattcagtaaatttcatacccaaacctttacctctgaggacctgctgttaatttaaaatatgaacttgtgaatttgatttgggaacctgtaaaatgtaaaaatgtgtaacactgtcaaccagcgtataggaaacagtgtggacactgcaggagaagggtggcccctctttagacccaggttaaccaggaggtgtgaactattaaccaggaggtgtgaactagcaggagggcagaggtggccccttcttctggcgatagacctggcagtgacatgaaggagcgacaggtgtcctcactgctggtggtgtcagtgggggtggatgtgactgattttggcgaagagttcacatcaaccctcaccatcattcaaggttgtgatgaggggcagagaatgctgagcctaagtctcgttaggtggtaaagccctctaagtgccagggagaggaagctaggccctgttctggggggcgacaggtggccagggcaggtttgcattgcggcagcagcccctcaggcttcctccctgccataagcacactaggaatctgcaatgggtgcaggaagcacgcaagcccacccaggtccctgaggtgctggccagggacctccagcaagccccagaggctccctggacctcagcttccttctcacgctgtgcggaggagtggagagagtggccctgcagacagacccccaggcggcgtggcagcccgggactgaggtcagggtgcccggcgtcaaagcacggggtccctgtttcaatgtcagagcccggccacagcgaattctgcagctccgggcatctcctcgggttccccctccgtgcagttactgtttgataaccccaaagttctgtcaaaacaaaagggagcctcaccatctatggccatgactccctgttgcttctggagaacaccccacttggccaatatgaggttcatgagttctgtgggtgcccaggaggcctggtgtgggggctgcccaggcctgagagctggggaaggtggggctagcgtggggccgggtgggggtggggggcttccgctgccaggcctggacctcacagctcacctttgtcctggtccctttgtaccacccgcagactaccatgccggggatgaagcgagactgcgggggtgctgcggccgtcctgggggccttcagagccgcaatcaagcaggtgagtgggccctgcccgccctctgcaggggcatcctgggtgtgcctcgtgggtgctcccctctcccctgtccgtcccgccacaggccccaccagggtcctacccgagtctccccagcggatgcttgtcccccctctgcccccaggctcttctggggcccccagagcttcccgccttcatcagagctgctctgggaggccccgagggcaaggtgcagccatgttctctgctcagggcctgccttggctccagagccccatgagcggttggctcaatgaggaagcctggcctagaccctcatggcatgtggcaggcagaagctcatggcaggggcacacgttgttctgcgtacccctcccgcaacccttctttgcagcagagctgcctctggtgactggtctcaccaagtcaccacctccaacccccaggcctggccaggcccccttcctctcttgcgtgggcaggtgccccaatgcttagcccttgctcagtggcagtagtcactcggggggcgtggggggggtggggggtgaccttgagtgaccttcccatggagcccagatgtccctggggccataaaaagtgcttattaaacaaatgaagaggccagctcatgctggtaatcccagaactttgggaggcggaggcaggaggatggcttgaaagccagaaattcaagactacccatagcaaccttgcaagaccccgtttctataaaaaaaaatttaaaaactagccaggcgtggtggcgcgcacctgtagtctcagctacttgggaggctgaggtggcggaggatcgattgagcccgggaggttgaggctgcagtgagctaagatcccactgctgcactgcagcctgggagatagagcgagaccctgtctaaagaaacaggccaatgaggagtgtgcattgactcatcagccgaggttttaccttcctagcctacctttctcaggccagcaacccagttccttggggtaaacttgaaatggaaaaacaaaaaggccttggcaagtagtttccaatctggagggtcctgctcctggccgtgagggaggaggaggaatcccaggaggaaggagctccttctgccggggcttcccagctggccgtgcacattccagactgtgtgacgggcttctgctaccaggcccagccggtggggacacggaggtgcggggctgaggcggcctgggcaggaggggctggcaggccctcacctgtgctctgcacgggtttggaaacggcctcttagggctcacggctgtttctctcgtgctgagcacacagctggggctgtacgcagcctgcaagccccatgcctccatgagcacctgccgtggcccgtccactgcagagcctgtcggaagaggctggaggaggagcatgtgtcctctgtgcgctactccttcactggttataaactaccaagggacacggctggcactcaaggagggtcttgactgccccagcatcataggccacggggcagggtggctctgggctcccactacctggccctcctccttgcctctgcccaggccccgtggctttggcagatgggctcaccagaagaatgctgaggcggacgggcccagctgtgcggtgctcgctgggcagctctctctgaagggagcagttgctgctctggggtggcacgggggcaggggtgggcaagtggttctggaggagccgtgtggccagccctctgtggccgtctttgccgttcacccctggttactcctccaacagagggtctgtcctgcctctgggacaggctggctgggaatgccccagcaggaagactcttctgagcttgaattccctgttcacaggaagccacttgacaaatgatcacagattcatcaggcagcagccgtgagtgttctcagcactcctccacctctagaggtgctgcggcctctagaggtggaggagcacctctagatttgaggggtgctgaggacaccccacccccactctggacaaagatccccctcccacaagagctccagcctggaggctccactgtgaacgcgaatgtcctgcttggccttcacatatccttgttggcctcttagaaaggaatacgcctctgtctgagccacagaatcaatcctcagggtaatgcatttacccagagaataaaatcagcatccacgtgtccacactggtaggaatagatcactgaaggaataaatgaatgggggagaaccgtttctcacactgaatcccagtttcaggctgcagaggtagtgatggaaacaggaagtcgtcaccccacagccaggcttcattccaggtgagagtggcccacagtgctggaactggagcatgagagtgggatgggaagaggacagtcaaatgctctcagagtgcctctcgcagctttatagtggtgacactcacaacccagcctaaccaggtgtcccagggcatgtcaccagggcagggacagagccacctgacatgcctccagaggcagtgtacagggaaggacagagcatttctgcaggattcccaccaaaaatgcatggcctgcctgtagtcacaaggacacgtcagacaaacccagcactgaaagtgccaaggccacaaaagacaaagccagactatgcagtcgcccagattaaggagggcaagcaggccaggcttgatgtgtggtctgatctgatctggacgtctgaggagcacatggaatctggatggtcccgagaggtgatggtcctgtgttggtgattactaccccctgctgcccattgtcccatggctggacaagatgctgacattggcagaatctgggtgaagggtgttgaggaattgtttgtggcttttttttttttttttttttccccgagatggtgtcttgctctgttgcccaggctggtgtgcagtggtgcgatctcggctcactgcaacgcctcccaggtttaagtgattctcctgcctcagcctccagagtagctgagattacaggcatgtgccaccacccttggctaatttttgtatttttagtagagacagggtttcaccttgttggccaggctggtcttgaactcctgacctcaagtgatccgcccacctcagcctcccaaagtgctgggattctggcatgggccactgctcctggctgtttgtgactatttctgcaatttttttgtaagtttgaaattatttcacagtgaaatgttttgaactttttagaaagaggatgtaccattcaaagatggaagggtacgccaggagctcggtggccctgggctctgggggtgttagcgaccctccaagcctggcaccaaaaaaaaaagcccctgacccacttaccaacccaaaacccttggccgccctgggggaccaggcccaagccctggcgtagcactggagacccttcccacgctgtcgctgaagcactcacagtccagccccatctttggccaccctcttctgttagaccagcaagtcccaactgtgccaggtaacacccaggaagtgtgtgaacattgacagctccagggctcacctccagctctgctgagtcttggattttttcagccgctcctggtgattggagaacacctccagactggccgtgagggccgcaagggcagggccgtgcctgtgctgtctctgtctcacgtcttccagccgtgcagacctcagcactgtttgccccaggactgcagctcgctcgtcttctaagccagcacttctcaagtggggtccccatgttgttagtaatatgggttctcagctctgccccagacctgctggatcagaaattaggggcagggcccagccttcagcgggtagcagccctccctgggaggctgaaagcatccatttgggaatcctcctcctccccgctcctccctcctccccccccgcctcctctcctcctcctcctccccccctcctccccctctcctcctcctccccacgccccagcaggctacagatccagaactctgctttctaggaggacttcagggctcccctcctttgttggtggagctcatctctgtggcgtccatggcctggagccccatggcctcatcctgtgacctcagggtcatgctgtcatttattcgttgttcctaaacacccacttctccctggaatgaccacaggaggcctcagcacagggacaggccgtggtcactgtacacacagatggaatgtcagtgctggggtatctggggaggagctctgagaggaggaggctgagggtcctgaagcccctgccccgtgtccctgacacaggctgggctgcgagagtgggagcgggggacttggggcccttgtggagctgacaggtggctccgatatcatcaccctgaggctggtggggttctttcccctgtgctgcgtgggggtgcggggccatctgtgaggctcaaggactgagcggggacccagggaggtctcagggactcgcagctgccatgcccagcaccactgctgcagctcctgccactggccactccttgccctgctggctgcccctgccccaccatcccaagtgtttgcctttggtgagggctctgcacccgtggtggaagagtcggctgttccaggagatgagaaagacgctggatcctatagagctgtgtgtccgcgctctcgaggcatgctccatgctaggaggatgtattctggttaaagattcgtctgcgggagcagaggaagggcagggacaggggtctgggagctctactccatttgacattgctgcccgggtgtggcccgcttcggggtcagggggcacccttagaacctgtgcagggcaggaactgccaccatctgttggccacacatttctcagtgaacaaatgacttttggcatcagaaagccataacttcacacctaaacttccacgaggctgagctcttcctgcccctctgtgtgtgtacgtgtgtgtgtgtgtgtattgaggggacgcggctgctggccaccttctgtcggcacaggttggcgaggcttcatgactgcccagcccatgcagtccaagagtcccacagcccagcccatgcccaggctcatccactgcggcgggtggcctctgccaggggaggctaggaaaccccagtggtgagccttggccttgggatctgccaggactgtacccgggatggcagggagggcgagctttggtccctgcaacttggagccatctctctctctcctgctgtctgtgggtctgagaacccccagctcgtcctcccccctccccaaacctatgacctacaactggagcctctgcccacttctccctccagggtttcaaagacaacctccacgctgtgttctgcttggctgagaactcggtggggcccaatgcgacaaggccagatgacatccacctgctgtactcagggaagtacgtctggccctcccactccttcctgcccactgttggaactcgcgacccttcccggcctgcaatgccagctcactccaggcatatcgggagggcactcagcgttggggtcccctgggcagcaggctccttgcttcccggagggctggggagctttggtagcaggcgcacctcacgttgaggggcccatggcacctggatgaggtgctaggctcccgtgcagtgcctggcccaggagctcgtggtctaccctgcattaccaggacaggtctttccaaaatttaggcctgaaatctttgggtgtgtgaagctctgacccccagattccctgctcggggacacctcctgcatctcccccttgagattgaccctggaaagtcaaagctgagctggcagctgaggagcaagtggctccagaattcaaaagagaagagccctctccccagccccatgagctggtgcctgagtgggcgcctccccgcatctcctgctcttcctccccatctgccgggtgccaggcacagtgtgctgaaggccagcccagccggttcatgccacccactttacagaagaagaaactgaggcatgggagagccaaatggctggtctctggctctccagagcagcggggcagggatgtcacctggaagccctttgctccaggcactgcattgctgtagggactgggggcatcccggccttcccattcagggaacgtgttggggttcggggagccacagggatgggcagctccaaatggggtctccccagtttcaaaggggctcatgccagtgtcccaggaaatcccgtccctgagcggggatctctaccatgccccaggacggtggaaatcaacaacacggatgccgagggcaggctggtgctggcagatggcgtgtcctatgcttgcaaggacctgggggccgacatcatcctggacatggccaccctgaccggggctcaggtgagtgctccctggatccaccccttagctgtagtcccagggaaccccaccccactcttgacctcaaggtggggaaggcagcgcgtgggggctgccgtcaggaagttttcataactgggcacgaggaggcaggaggagctgcccgtcaagcttggtgtgggcagtaccgaggcccaggctggatgcagagccgggaaccgcctcctgtgtgcttcatggccatggtcctttctgcctgtgttttttctttttttctcaaccgtctcttttctggctcccttatttctctgtctgcctcccggtccctcttttgccttgggtgtttctctcctgccgtcccgtccacacgcttcccgggttcctgcccgcccagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggtaggtttggagcctcgaacctggagcctgccacatgggtggagccgggcaggcggagccctgccttcagggtgctggtgcacccagggagctggggccccccagaagcagccacagtgcagacgagggcttgagaggcaggcgtcagggcacaggagtcatcccagacagcgtgggccactcactggcttccctgccacacagccaagggtttctcccccagtcttgggtctggctcagttgccccatcaggccctttgctggcttcccccttggcctatggtgggggcagactccttagctcatggtcaaggccctcccagcccagcttctgctgcctccccacacgctccctcccagccaccccgagctccttgcagacagcaatagtgacaggcgatggggcagggtggagagggcccggccggagcaacccacaggcactgtgtcctcctggcctccctaggaccgagacaacagccccagctcctgtgctggcctcttcatcgcctcacacatcggcttcgactggcccggagtctgggtccacctggacattgctgcaccggtgcatgctgtgagtgtctcccctccccactggccctggctgctcccgcccgcttgtccaaacagcgcccctctggctctggagctgctggcagagctcatcagaaacttctgtctgtgacccagcttccagcccgctgtccccaccacccccaggtctcatcctccctgggaacagagtggctgctgtgtgcgacccttccccagccagcctgtcctccataggggatcctgggccctgtctcacccatccccaccctgaggagctcccggggtgaaggcagagcacacagggccttgccccctgcctacgcctggcctgccagccctgaacgtgtccagccagcagcatggaaggctctgggctccggctggtgctcaggatctccttcctgagaaggggactgtggggcacgtggaggggacccaggaggtgaggggtccccaggaacccctcctgtgctgcagccccacgcccagagtctgtgtcctgccctttgcttgcagggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctcacctggcctcgttcttctttctccccctccattttagaaacgggtcctggagcccatctagggaatgtagtgcagggctgcctcctgcttctcccagaccggctctggctttgagccccagctggtcaaccca

SEQ ID NO: 10676 - DNA, 208 bp, Homo sapiens
gtggctgcagggcagggcctcctggcacgtggccgctgtttgaagcctctgtgtcttgtctctcccttctgatctagctctggcaggctgccctgagcacgctcaaccccaaccccacggacagctgtcccctctacctgaactacgccaccgtggctgccctgccctgcagggtgagccggcacaacagcccctcggccgcccactt

SEQ ID NO: 10677 - DNA, 10831 bp, Homo sapiens
cagtttttctccttttgcctattaatgtaatgactattgaaatagatttcccagtgggaagacgtttcacgctgaaggaccagtgtgtgcagaggtgaaggcaagagctgcggcagatgggcgaaatgggtgtcatgtgtttgatatcatctatgcagaaatcattagagttggctgcagctgcttggtctttttctgtaaacagccatcttgctgtcctcagatgctggacagtgttaggtctgggaaggtgggcagaggcatgatgcttgcccttttcattgtgctacttcttatccctcccagacaaaatgaaaatcaaatgccgtttccagaaggcctatcggagggctttggaccatgaggaggaggccctgtcatcgggcagtgtgcaaggtatgggaagggatgagcacaccattttaatgtgaagccctctttttccttctgatctctaagtgcatagttcccatgctttggcttacttccaaaacctctcttggaatgctgggaatgaggaactgtgggattcagcccagtccactgagggccagagaggttgattggcttacccaagcctgaccactgtgtcagctgaatgtgagtgaaggggtgggttaggcattctttggggctggggggagatggaatggtgttttgctcttggtgtaccacctgttcttgcccccagaggcagaagccatgttagatgagcctcaggaacaagcggagggctccctgactgtgtacgtgatatctgaacactcctcacttcttccccaggtaaggtaacagagaggctgcgactttgccttatcccttcagctcgtggactcctgggtcacctccttcttgcatcattgctacccatttcttccatttgctacagaaaactctccaaaaaaaaatttttttttttttgagacggagtcttgctctgttgcctaggctggagtacagtggcgggatctcggctcactgcagcctccgcctcccgggttcaagtgattctcctgcctcaacctcctgaatacctgggattacaggcatgtgccatgtaatgtatttttagtagaaatggggtttcaccacgttggtcaggctggtctcgaactcctgaccttgtgatctacctgccttggccccccagagtgctgagattacaggcgtgagccaccgcacccgtcctccacatatttttaataaagaatgctggctgggtctggtggctcacactgtaatcccagcactttgggaggccgaggcgggcagtttgcttgaactcaggggttcaagaccagcctgggcaacatggcaaaaccccatctctacaaaaaataaaaaaaattagctggatgtggtagtccctgttacttttggaggctgaggcagggggagcgcttgagcctgggaggtggaggttgcagtgagctaatatcatgccattgcactccccatctctactaacaatacaagaatcggccgggtgcggtggcacatgcctgtaatcccagcactttgggaggccgaggcaggcggatcacttgaggtcaggagtttgagaccagcctggtcaacatggtgaaaccccatttctactaaaaatacaaaaattagccgggcgtggtggtgggtgcctgtagtcccagctactcgagaggctgaggcaggagaatcacttgaacccaggaggtggaggttgcaatgagccaagatagtgccactgcactccagcctgggcgacagagtgagactctgtctcaaaaagaaaatttataatcaaatatttaatttttataaaagcactaaagaaaatgttaatgaacgtccccatccccacccccagctcacaaactgcagtgcagtagcacggtgtgtacttccatggttatactccattcccttttggcccaaggcaaccagattttgtgtttgtaattttcttgcttttccttagagtttgatcacatatgctgtatctctgtaaacaatgtatttaattttacatttttgaatttatataaatggtggcttataacacatgttcctctgccacttttattttattcccttcatgtggcagagcctggtgagagaatcatccataattatgtagttgaatctatgtatcattgtataaacataaacataatttacccattctattgctaatggacatttggattatttctaggttttactgttagaaataatgctattatgaatacttgtttctttgccatgtgccatttttatatcagactctccagttgtctgtttattccgcttttcttgctcagcatgccatctctgagtttccatttcaccattttaccagcccctgaagagttagatgctgcctggacccatgtcaactgggaaaaagaagagaacggagacaaatgaaaatactcaatatatactcatagctcagaaatgctgagttaatagctcatgaatctcaagagaggtgcaaacctgttggtcattggcaaaggggcagattcggaacagtaggagccagggtgctttttggctttcttttctgagccatgggcattctgtctcttgctcacccccacaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggtagggcaccaggctctgccacatgaagggagaggaaatgaattacatggggcaggagggaaatctgcatgccaacttctttctcctttcttctctagtctcaatttttttcttatttattttatgttattattattattattattttttttagttatttattttgagacggagtctcactctgttgcctgggctgagtgcagtggcactatctcggctcactgcaagctccgcctcccgggttcacgccattctcctgcctcagcctcccaagtagctgggaccacaggtgcccgccaccactcctggctaatttttttgtatttttagtagagacggggtttcactgtgttagccaggatggtctcgatctcctgacctcgtgatctgcccgcctcggcttcccaaagtgctgggattacaagtgtgagccaccacacctggcctatttattttattttattttttgagacagagtcttgctctgttgcccagactggagtgcagtggcgtgatcttggctcaccacaacctctgcttcccacgttcaagtgattctcactcctcagtttcctgagtaggattacaggtgcatgccaccatgtctggctaattcttgtatttttatttttattttatttttttttgagacggagcctcctgtcgtccaggctggagtgcagtgacgtgatcttgtctcactgcaacctccgcatcccaggttcaagcgattcccctgccccagcctcctgaatagttgggattacaggcgcccaccaccatgcctagctaatttttgtatttttagtagagacggggtttcaccatgttgaccaggctggtcttgaaatcccaacctcaaatgatctgcctgcctcggcctcccaaagtgctgggattacagcgtgagccaccacacccggccgatatttgtattttcagtagagatggggtttctccatgatggccaggctggtcttgaagtgctggcctcaagtgatccgtctgcctcagtctcccaaagtgctgggattacagacatgagccacagcgcccggcagctttttcttactcagtgttcctcatcccagttttgtcctccttttggttccatgatggaaagcagccccattccagaggagaaacaagttcagctcagctgggagtacaggctgcccctcttctttgatccacaagagcctctgacttccctgactcctgtttctgtaggctatgagatcaccttcagtttactcaacccagaccccaagtcccatgatgtctactgggacattgagggggctgtccggcgctatgtgcaacctttcctgaatgccctcggtgccgctggcaacttctctgtggactctcaggtgagaccgggagcaagttgaggagtccttttcaatgtctatacatatttacaagtgcagtctgttcctccatctcttagagcttgctgatttgctaggaatttcctgtgtgtatatgtatgtgagtgtcataagggtgggtactgggggtgcgtgtgtgcccttgtctgtgtccatccatccattgagggcagattctggtgtctttacttccttggcatcctattgagagagtttgtcagtgcttgttaacaaaccaccttcctatagctccctctagacctgtactcaccaattgtgcttagatgttaatgccatgacccatctttttttttttttttttttttttgagacagagtcttgttctattaccaggctggagtgcagtggtgtgatcccagctcactgcaacctccgcctcccaggttcaagcgattctcctgactcagcctcctgagtagctgggattacaggtgcgtgccaccatgcccagctgatttttgtattttagtagagacgggttttcaccacattggccaggatggtcttgatctttgcccagctgatttttgtattttagtagagatggggtttcaccacgttggccaggatggtctcgatcttttgacctcgtgatccacctgccttggcctcccaaagtgctgggattacaggtgtgagtgatggagcccagcagagccattcttaaggaatttagtttttagaaaaatgcttcctgaaatttgttattgtagtaacaataaagatgtgaagggccaggtgcggcggctcacgcctgtaatcccagcactttgggaggctgaggcaggcggatcacgaggttaggagatcaagaccatcctggccaacatggtgaaaccccatctctacaaagataaaaattagctgggcatggtggcgcgtacctttagtcccagctactcgggaggctgaggcaggagaattgcttgaacccgggaggtggagtttgcagtgagccaagattgtgccactgcactccagcctggcaacagagtgagactccatctcaaaaaaaaaagatgtgaagaatgtagctttctgtatcacgctgtctccttgtagggaaaacacgtgggagaaatttttatcaggtcttcctagtgggagtaattgcttctgaataactggcttgatttgatcttgtagacactgaattatgctgttctttgtttctctctttgtgtagactgttaggaaacctggtaaaatacgtgatttttaaagcacgtatttagtttattcagtttacccttggctttgctattttcttctgcaattattttctctcagccctgattttgtctcttatatgttgccttgtcctgattgtgtcttttttaaggcacctcaaatcttttttgggagaaagtagaatataaatctaaacaaagtaaccactccctgtttgctctacagattctttactatgcaatgttgggggtgaatccccgctttgactcagcttcctccagctactatttggacatgcacagcctcccccatgtcatcaacccagtggagtcccggctgggtgagcacctaaggatgagggtctttcttttctgccaggctagggagggaccctgacggctcagctgggtaggggacaggagttggaggtggattatatacagtgatggttcccaggttgggttggtccgaggagactgtggagattgaggctcctttttttctttttttgagacaaggccttgctctgttgcccagtctaaagtgcagtggcacagtcatagctcactgcagcctccaactcctggactcaagtggtcttcccacctcagcctctcgagtagctagaactataggtatgtgccactacacttggctaattttcaaaattttttttagagacaggatctcattatgttgcccatgctggtcttgaactcccctcaagtgatcttcccaccccagccccctaaaatgctgggattataggcgtgagccactatgcctgagccctaggttcctttttcatgatgctctgttgatatctccatcttcacacctatcatatccaaaagcatttattaaacgtgattcctagcactttttacaaatgaatgactaggctgggtctatctccctaaaagccatctaggagagaggctgtcacacacataggaaagacaacagcaaaagtacttgagggcagaatttgaattgacagttctgctgattgaggttgaataaccttgaagctagtattagagtttttcatttttcgggtggaaactaggaagaggaggtgtgactaagaactgtaacacaggcaaaccaaagtgagtatatctaattgtggaatctcagataccagaggcaggctagtgtggcccaaggattgtgagggggtggcatgtgaggccttagaaaattcctccgttcatttattcattcagcaaacattgactgagggactaccttatgacagtgctgagtagagaaaagaagggcatttcaggcaaagggaactgtgagcttagatgcagacaagtgagagagcttaggcattcaggaagctcagagtagtttagtgtggctgaaatgtgagtgagtgaccaaagatgaagccggttaggcaggcaggagccaggtcataaaggaccatgttaaggagtttgaactttaacctgatatgggtggctagtgattgagggatattaagcagggaactgacataaggtcagatttctggtttgcataaaactatctgtagtaatatgggtacattgtgggagtggccaagaaagctgtcgtagacagtcaaggggcctttgaggagggagaattcgggggtgttttggagctaaggactatgtttccatcggtatggcacatctcgggagaacattctgaagccctttactagagacaccctggacaggaggatatcctaatgattgttagttggggaatcagtcccagagtgagtgaccagcaagttagaggccgacctgggactaaggtccaggtccagcatgttttgatattctgctttccctttataccacaggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtaatagtcacactacgcagaccccagagcccatgcttctgggacaggcaggtgtccctgaaactgtgttccttctgttttccttctggtgtcctccatggcccagcctgtgggaggggcaggcaccaggaaggtgagggtgctatgtgctcatgcccctcttctgccggccccacttttgtttccgccagtgttttctatactgtgaccctttgcccttacctaggatcattctgtgtccatcttagatcttcgccttatttgtgggagtcttgcaaggttgggagccttgtctcccttgttagactggaagtttctcatgggggagaattctaaaatgggataagaaaaaaatatgttctacaggactttcaagggggtaattgggataatgtatttaatgctctccgtagtaggtactcaaaaaatattagctataccatgaggtttatagcttctaaagagcacagaatatgttttccttttctctccagagtgcctagggcagagctgtgcaagggcctggtatgatgttgtggcaatctcattccccctttcaggtatataatgttgactccaaaacctataatgcctcagtgctgccagtgagagtcgaggtggacatggtgcgagtgatggaggtgttcctggcacagttgcggtgaggtcctggatgatccacttggggacatagtctccttggctgtagaggggagttgcaaagtggaatcaagtcttacctggcagggatatcttggctgtgcctagagccccagggaaaccaagaaaagtttctaaggatcccatcatccttctaagaaggactagtaggtgacaaaatcatttatttttttttttgagacggagtcttgctctgttgcccaggccggagtgcagtggtgccattttggctcactgcaacctccacctcccgggttcaagcaattctctgcctcagcctcccgagtagctgggactacaggtgcccgccaccacaactggctaattttttgtaattttagtagaaacggggtttcaccatcttggccaggctggtcttgaactcctgacctcgtgatccacccgcttaggcctcccaaagtgctgggattacaggcgtgagccactgtgcccagccagcaaaaccagttttaagaaaaatagactcatgaatgtcaggtccatggagtgtgattagggctgcttaagaaaatagctgttaattcttatgctgcctgatggattgagagtggctgcctgaggctctgtgttgaggattctaaggctgtatctgggctcattaggaaagagtattcttctgattgactagcagtgtctctcacggatgcaggcttagagaagcacagcacatgtgccttggcaaaggcagtcctggatcatcccttaatgctaagtcccattggccccatttgttcaaagagagggtagaaaaggtgaaaggattaaactgagttggtgttatcagaagtattttagccatggaacctttttttaaaaaacaagatcttggaaatctaatgtagaaacaggtaaaagcagaaacacctgttgaagcagcgtttggggccaacttgtttggtgttgccccttatgcccccaagaccctgaggtacttccctttaacccctatggttctgggtaagattgaaaatcactggctcaggacagatatttgagaaatcttagccatgatctcccgccttgtggtctcagccaccttgatcttactccgatgttcctacaggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtaagcaggcaggggatggattctgcagcttgggactggagtagccagagagggccagagtgtggtgagaccagagagcctgtgaggtccatggtatgtgtgggcttgccatctttagtgtcccagccttcctctagacggcagtaccagcccccaagcaggagtgcagatgagagtgcgaggtttcaagctgaccctaggaaaataaaccatatccctgtagaaagacttccatagatcctggatgaactccaggcatcttccttggtagatggaaggcacagtaaggcccagcaccctttccaccaatgcctaggacttactggtataccctcttgtcccttctccttcctaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaa

SEQ ID NO: 10678 - DNA, 4101 bp, Homo sapiens
cagtttttctccttttgcctattaatgtaatgactattgaaatagatttcccagtgggaagacgtttcacgctgaaggaccagtgtgtgcagaggtgaaggcaagagctgcggcagatgggcgaaatgggtgtcatgtgtttgatatcatctatgcagaaatcattagagttggctgcagctgcttggtctttttctgtaaacagccatcttgctgtcctcagatgctggacagtgttaggtctgggaaggtgggcagaggcatgatgcttgcccttttcattgtgctacttcttatccctcccagacaaaatgaaaatcaaatgccgtttccagaaggcctatcggagggctttggaccatgaggaggaggccctgtcatcgggcagtgtgcaaggtatgggaagggatgagcacaccattttaatgtgaagccctctttttccttctgatctctaagtgcatagttcccatgctttggcttacttccaaaacctctcttggaatgctgggaatgaggaactgtgggattcagcccagtccactgagggccagagaggttgattggcttacccaagcctgaccactgtgtcagctgaatgtgagtgaaggggtgggttaggcattctttggggctggggggagatggaatggtgttttgctcttggtgtaccacctgttcttgcccccagaggcagaagccatgttagatgagcctcaggaacaagcggagggctccctgactgtgtacgtgatatctgaacactcctcacttcttccccaggtaaggtaacagagaggctgcgactttgccttatcccttcagctcgtggactcctgggtcacctccttcttgcatcattgctacccatttcttccatttgctacagaaaactctccaaaaaaaaatttttttttttttgagacggagtcttgctctgttgcctaggctggagtacagtggcgggatctcggctcactgcagcctccgcctcccgggttcaagtgattctcctgcctcaacctcctgaatacctgggattacaggcatgtgccatgtaatgtatttttagtagaaatggggtttcaccacgttggtcaggctggtctcgaactcctgaccttgtgatctacctgccttggccccccagagtgctgagattacaggcgtgagccaccgcacccgtcctccacatatttttaataaagaatgctggctgggtctggtggctcacactgtaatcccagcactttgggaggccgaggcgggcagtttgcttgaactcaggggttcaagaccagcctgggcaacatggcaaaaccccatctctacaaaaaataaaaaaaattagctggatgtggtagtccctgttacttttggaggctgaggcagggggagcgcttgagcctgggaggtggaggttgcagtgagctaatatcatgccattgcactccccatctctactaacaatacaagaatcggccgggtgcggtggcacatgcctgtaatcccagcactttgggaggccgaggcaggcggatcacttgaggtcaggagtttgagaccagcctggtcaacatggtgaaaccccatttctactaaaaatacaaaaattagccgggcgtggtggtgggtgcctgtagtcccagctactcgagaggctgaggcaggagaatcacttgaacccaggaggtggaggttgcaatgagccaagatagtgccactgcactccagcctgggcgacagagtgagactctgtctcaaaaagaaaatttataatcaaatatttaatttttataaaagcactaaagaaaatgttaatgaacgtccccatccccacccccagctcacaaactgcagtgcagtagcacggtgtgtacttccatggttatactccattcccttttggcccaaggcaaccagattttgtgtttgtaattttcttgcttttccttagagtttgatcacatatgctgtatctctgtaaacaatgtatttaattttacatttttgaatttatataaatggtggcttataacacatgttcctctgccacttttattttattcccttcatgtggcagagcctggtgagagaatcatccataattatgtagttgaatctatgtatcattgtataaacataaacataatttacccattctattgctaatggacatttggattatttctaggttttactgttagaaataatgctattatgaatacttgtttctttgccatgtgccatttttatatcagactctccagttgtctgtttattccgcttttcttgctcagcatgccatctctgagtttccatttcaccattttaccagcccctgaagagttagatgctgcctggacccatgtcaactgggaaaaagaagagaacggagacaaatgaaaatactcaatatatactcatagctcagaaatgctgagttaatagctcatgaatctcaagagaggtgcaaacctgttggtcattggcaaaggggcagattcggaacagtaggagccagggtgctttttggctttcttttctgagccatgggcattctgtctcttgctcacccccacaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggtagggcaccaggctctgccacatgaagggagaggaaatgaattacatggggcaggagggaaatctgcatgccaacttctttctcctttcttctctagtctcaatttttttcttatttattttatgttattattattattattattttatttagttatttattttgagacggagtctcactctgttgcctgggctgagtgcagtggcactatctcggctcactgcaaggctccgcctcccgggttcacgccattctcctgcctcagcctcccaagtagctgggaccacaggtgcccgccaccactcctggctaatttttttgtatttttagtagagacggggtttcactgtgttagccaggatggtctcgatctcctgacctcgtgatctgcccgcctcggcttcccaaagtgctgggattacaagtgtgagccaccacacctggcctattttttttattttattttttgagacagagtcttgctctgttgcccagactggagtgcagtggcgtgatcttggctcaccacaacctctgcttcccacgttcaagtgattctcactcctcagtttcctgagtaggattacaggtgcatgccaccatgtctggctaattcttgtatttttatttttattttatttttttttgagacggagcctcctgtcgtccaggctggagtgcagtgacgtgatcttgtctcactgcaacctccgcatcccaggttcaagcgattcccctgccccagcctcctgaatagttgggattacaggcgcccaccaccatgcctagctaatttttgtatttttagtagagacggggtttcaccatgttgaccaggctggtcttgaaatcccaacctcaaatgatctgcctgcctcggcctcccaaagtgctgggattacagcgtgagccaccacacccggccgatatttgtattttcagtagagatggggtttctccatgatggccaggctggtcttgaagtgctggcctcaagtgatccgtctgcctcagtctcccaaagtgctgggattacagacatgagccacagcgcccggcagctttttcttactcagtgttcctcatcccagttttgtcctccttttggttccatgatggaaagcagccccattccagaggagaaacaagttcagctcagctgggagtacaggctgcccctcttctttgatccacaagagcctctgacttccctgactcctgtttctgtaggctatgagatcaccttcagtttactcaacccagaccccaagtcccatgatgtctactgggacattgagggggctgtcc

SEQ ID NO: 10679 - DNA, 101 bp, Homo sapiens
gtagagatggggtttcatcacgttggccaggctggtctcaaactcctgacctcaggtgatccacccgccttggcctcccaaagtgctgggattacaggtgt

SEQ ID NO: 10680 - DNA, 5916 bp, Homo sapiens
ccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtggtgagcacccgcgagggagcgccgcccgcgggtgggaaggggagagggtgcgaggggccctcccggcgcgccaagccctggcccccgccccctttcccgcctcccctcccccaccgagtcccctctcctgtgtcccctgctctcccttctgccgccaggtctgagatctctgtgtacccccttcccttgatctctctctgtgcctccttcttctccctttcgagatttattccttccttttccaggggcccgtccccttttcccagcgtggaggtacgtgcggcagcagctgcaaccatagccctgtagctgtggagtctccagagcgctttgaggcccgtccctgcactaatgaagagaggggctgagtgcagcctgtcctcagcccccacgctggaggctaggtggaggctgagttacttgggaggcattcagactcttcatgtctccccaaccattaataccctcaccctgatcctccaggaagacttgggccattttcttccccgggaaagaaactgagcaggcagctttagtgtgttggctgtggttcctctcatggggagtggcataatgtccctccaagcctggactagcacctgtcctcttctgggggctctgtcatcaagggaggcttggtctccactgtggttaagagtttctgagctggactgcctgggttggagttccaactctgccatataattgtctgtgtgaccttgggcaagtaacctcacctctctgagcatgtcttttcatctgtaaaatggggataatgatacctttctcgtaagattattgtgaagataagtcctctgattctgtacagtgcctggcatctatgcatgctgtgtacattgggctctttgatcagtagtatttttgggccctacagggctgctcatagctgctgcctggagtcaaacaacttggctttcagggcaggggagggggtcatcataggcagggaacgagggctaggaaacctcatagcagaggctttggatgagcctcaaaggatgaaaggtgcatggagagacagtggctctccaccttggccacattcaccagcaacctgccctggccccctttgtgagaataactgttggggggggcctctctgtgggtatggggggcatgtattggagtggacctgagccctagagcttccaaagcagcagaacaccggactcccagacagagctgtggaggggagacagccttgagcctgtgctcctgggtccctgggggccaattcctctctccttactgagctaggcagcagccattcttagctgggcccccagagtactgagctcccttgcccaagcaggcatcaatggagagagggaggctggaccaggctgatgttgaagccagttgggctacaatttgcaatagcagcatttaggattcagcttagctctggggcagaactttctcagactgactgagtcctgagtaactttgggggtttattttgcaactagagggagcttccagctcatgtaccaccatttgtctcctaatttggaggaaattcatagcccttagagatggggcatctgtgaagggtaagtagaggaaagggcttcatgagaaccccttcctgtgcaggaattgagaacagagttccagggatttccaccctggcaccccttgcctggtctcttctgaccctaatcatgcaggtctgaggtttgctgttcccagattactgggccctgaatccagcttaggaagctatttgtggctgagaggaatagagcagttgtgttctgagcccttggccactctgccccttattctgacctgaccctgggtcccaggcctcatcctttctagaagagaaggagtggccgtggtgttctgagccatagatatccgtgttcctcacttcttctaaggacagagaggttgatagattgagtttgcagtagaagagactgaggttagactgcaggaagttgttcccaaatgagagaggctccaaaagttggagaatgggagaagagaaggccttacagggatctgggagttgggcactgggatcctgctccccactctgccacctccgttccctatgctctgtaccttctttctatgtctttatactggtgcttactttctgtgaaaatagggtgaatggggtgagataggggttgcccacttccattctctccccaccccacatgtgggctgtagtagactcagggccctgcctcttccccaagctgtataaagtccatgctgggccccagggtaccagatggctgccaggagggcttcctggaggggacagcgtcaggcttggggaagaagcagacctggggaagagaaaatgactttatattcacttcctgttcctgccccagaggaataggaggtggcccaggggcctggagggtgatttccaggcctctgtgggccaccaggggaggatgtgatgctgtgcaggctgacagcacgagtccctccctgcacctctcagctctttttgttgccagggcctccctgagcacttgaagttgctgctgcaagagctgtgagggttagatcaggccctgtagctccctgagcttcctcaggcagggcctcccactgttcttggttcccttcctgggcctgaggactccccttaccccttccacacccactgctgcacctgccacaccctcctcctggcctagcctgtgttcttctctatgggggtccaggactactttctccatggtggtggctcatagccagggctgcgtaaatgacctctaagggggttctctctgcttgctaagacttcctcccatttggagatcaacaaaggatgagagcaaagttggcctcctcccacctgccatatcccaggctctgggcttgagtcagcagagctttggttaagctgcttaagggagctgggctggtgtaagcttcttactgagaggagggggtttggaggagaggaggaatagggaaggggttgttcacctgccccagccccacccatatcagggaaagtccccttaacatcagcctcacctgatacatctagatgtcatgccaggggcagctgtggggtgagggtaggagtatcctccagagaaggacagtgactctcccaagacagagctgtgtggccccctttacaggtggttctcaaaggcagggtaccagagaagttgatacactgagttgcagtagaagagacaggtcagactgcaggaagttgttcccatatgagaagagaggctcccaccaggctggatacctaattctcccaaagtcatctagccagccttggcagagcggaggccagaatgaggaccctcaactccagagtgggagagagagtgttcaggaggtggccttgtcctctacccttctctgccctgcccttccctggcccccagagaccagtaggatggcactccttatcccctgttagatccccatggcggagttatgtctcttccacactgggggtgtaccccaagggcagggactgaggtccctctttccagagggcagtgatcccagggatgagaagatggtagctactctggggtcccacacaagctgacctggcagcaggggctttgcggccccttccttgctcagctgcctgtttcccctagactacctctgctcccctgaggagaatatctacaagatcgactttgtcaggtttaagattcgggacatggactcaggcactgtcctctttgaaatcaagaagcccccagtctcaggtgagtgggctgggtgggccattgatggggaggcagataggagctgcggagtgggctgcccagggaatccttgggccacagaggagtccacagagctggggcttggaccccagcattctcaggagtctgcaggcaggggggccctttcttttccttcccatatgtttctgaggctggacatcttgcgaggtcagccctaccccttcggtccctgccaacctgccctctgcagggctctctgggaactgcagtcctacgggtcccaggcctcagcatcctgtggcccggggaagcacagtggcgattgggaacatgcagacctagaacccctaggtggcactatttggccaatggtctgagccctcagtgtgccccggaatttcttggggagtttaaaaaaaatcagatagatggggacccaagggtagaaccctgggtggacaagggcccagcctgaagcccactgagccccagctggggtacattgcagaacggttgcccatcaaccggcgggacctggaccccaatgctgggcgctttgtccgctaccagttcacgcctgccttcctccgcctgaggcaggtgggagccacgtgagtcgctgggctatgggtggtggtgggggtgagggagagggtgtgagtgggcccttctcagcctctcgtaggggtggcctgtcctgagcctggctggctagttgacttcaaggacagacttagccctgcctccttttcttgctcagggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtgggggcgtctagagactgagctgcgggagggagagggacttgtgggtctgatcccatttctccccaccctggggctcttctgtgtctgccaccattcccatatcatccgtagagaaagaggctggggatatttcaggctgtttggctgtccctgtaccccagtcctgaagcccctgcagtggcgggactcaagctcctgacctttgcccggcctggctgggcctctcttgcagtcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttctc

SEQ ID NO: 10681 - DNA, 101 bp, Homo sapiens; identical to SEQ ID NO: 10679

SEQ ID NO: 10682 - DNA, 2477 bp, Homo sapiens
gctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttga

SEQ ID NO: 10683 - DNA, 1164 bp, Homo sapiens
tggacatgcagcagacctatgacatgtggctgaaaaaacacaacccaggaaagcctggagaagggacccccatcagttctcgggaaggggagaagcagatccagatgcccacggactacgcggacatcatggtaacgcctccgccctgcatgctcggggctgcggtcggggctgtggtctgagcctcacctgggaggggcagcctggagggcccagccggccagcgctcagcctctccgaggtgggtggtccgggcagaggtgtgggggagcaggcacccatgatggctgtgctcccagatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggtgctcctgggagggcagggcctggcgggacatggggtggcccgaggagatggagtccgtggccagctctggctcctcttggcctggaggtggtgtgcagggagtggtgaggcttggctgtgactgcagccatgggggtggtggggaagggtggatgggagggctgggctcagacctatctagacctttaatttgcagctgtggggcagatcccagagagggtcaggacacccaggttttccctgagctgggacccagctgcccagggagaggcttgtcttcggggaggtcaagcggccggccccagatggacagcctggggtgggaagggcacagagctcgggcagtgagcctcctgccacccacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggca

SEQ ID NO: 10684 - DNA, 865 bp, Homo sapiens
ccttcatttccattcctacagatttgttaactggaatttctgtacttccatctctttttgttgacagcttctctttgttcaggttctccatttcctgcacatttttaacacatttgcaagttgtaaattatcttctttctgcaaactcctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttcttttaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcagtggctgggttttgtatctcttttctttaaaaaaaaaaaaaaa

SEQ ID NO: 10685 - DNA, 865 bp, Homo sapiens
ccttcatttccattcctacagatttgttaactggaatttctgtacttccatctctttttgttgacagcttgtctttgttcaggttctccatttcctgcacatttttaacacatttgcaagttgtaaattatcttctttctgcaaactcctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttctttaaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcagtggctgggttttgtatctcttttctttaaaaaaaaaaaaaaa

SEQ ID NO: 10686 - DNA, 210 bp, Homo sapiens
ttttcaggcaagaggactgtccatctaggccagaggcagaagtctgcaactcttaattatatttcctgtccctggttcttttctcacagtgccttctatttatccagaggaattccagcaccagcgatggtatgcaaacctttagtggcacacgttgactcagatacagcccagattccttggccatgctttccaggtcttccataaacc

SEQ ID NO: 10687 - DNA, 491 bp, Homo sapiens
catgttcatctagttctgtcccttttcagctttacagagaggcttcctacttagatggttctctctagctatggggcttggagagtaaatgggcaggagtgggagtgtgggaaggggccatgctctgttgatctcagccagttgaagctgatgcctctgtcctggtgtttataaggggctccatcacacatgtacccgtcctctattgtgtgggaggtaccccaggcaatgaaacggagaggtgtctcctggtgttgcagtggggaggagacctctggaccaggacgtgctgtggggcgtcagctaccaaccttgtggtctcgggaaagtgacctatcaagggggcatacaacagggacaccaccttgaaatctgaagtcactgagtagcaggggaggttggagcctggggcaccccatggcctgcccttgggtttcatttaactgtggcctccccaggatgttacacgtcctggcctcctccctgcagaa

SEQ ID NO: 10688 - DNA, 210 bp, Homo sapiens
ttttcaggcaagaggactgtccatctaggccagaggcagaagtctgcaactcttaattatatttcctgtccctggttcttttctcacagtgccttctatttatccagaggaattccagcaccagcgatggtatgcaaacctttagtggcacacgttgactcagatacagcccagattccttggccgtgctttccaggtcttccataaacc

SEQ ID NO: 10689 - DNA, 491 bp, Homo sapiens; identical to SEQ ID NO: 10687

SEQ ID NO: 10690 - DNA, 5088 bp, Homo sapiens; identical to SEQ ID NO: 7228
  misc_feature (5)..(304): n equals a,t,g, or c
  misc_feature (3943)..(4892): n equals a,t,g, or c

SEQ ID NO: 10691 - DNA, 142 bp, Homo sapiens; identical to SEQ ID NO: 7551

SEQ ID NO: 10692 - DNA, 319 bp, Homo sapiens; identical to SEQ ID NO: 7553

SEQ ID NO: 10693 - DNA, 286 bp, Homo sapiens; identical to SEQ ID NO: 7557

SEQ ID NO: 10694 - DNA, 300 bp, Homo sapiens; identical to SEQ ID NO: 9955

SEQ ID NO: 10695 - DNA, 316 bp, Homo sapiens; identical to SEQ ID NO: 7560

SEQ ID NO: 10696 - DNA, 170 bp, Homo sapiens; identical to SEQ ID NO: 7565

SEQ ID NO: 10697 - DNA, 300 bp, Homo sapiens; identical to SEQ ID NO: 7568

SEQ ID NO: 10698 - DNA, 184 bp, Homo sapiens; identical to SEQ ID NO: 7572

SEQ ID NO: 10699 - DNA, 147 bp, Homo sapiens; identical to SEQ ID NO: 6794

SEQ ID NO: 10700 - DNA, 131 bp, Homo sapiens; identical to SEQ ID NO: 6213

SEQ ID NO: 10701 - DNA, 235 bp, Homo sapiens; identical to SEQ ID NO: 7589
  misc_feature (230)..(230): n equals a,t,g, or c

SEQ ID NO: 10702 - DNA, 143 bp, Homo sapiens; identical to SEQ ID NO: 7597

SEQ ID NO: 10703 - DNA, 170 bp, Homo sapiens; identical to SEQ ID NO: 7598

SEQ ID NO: 10704 - DNA, 135 bp, Homo sapiens; identical to SEQ ID NO: 7602

SEQ ID NO: 10705 - DNA, 125 bp, Homo sapiens; identical to SEQ ID NO: 7605

SEQ ID NO: 10706 - DNA, 183 bp, Homo sapiens; identical to SEQ ID NO: 7394

SEQ ID NO: 10707 - DNA, 319 bp, Homo sapiens; identical to SEQ ID NO: 7609

SEQ ID NO: 10708 - DNA, 175 bp, Homo sapiens; identical to SEQ ID NO: 7613

SEQ ID NO: 10709 - DNA, 196 bp, Homo sapiens; identical to SEQ ID NO: 7614

SEQ ID NO: 10710 - DNA, 296 bp, Homo sapiens; identical to SEQ ID NO: 7617

SEQ ID NO: 10711 - DNA, 219 bp, Homo sapiens; identical to SEQ ID NO: 7618

SEQ ID NO: 10712 - DNA, 154 bp, Homo sapiens; identical to SEQ ID NO: 7620

SEQ ID NO: 10713 - DNA, 2548 bp, Homo sapiens; identical to SEQ ID NO: 7621

SEQ ID NO: 10714 - DNA, 207 bp, Homo sapiens; identical to SEQ ID NO: 7625

SEQ ID NO: 10715 - DNA, 189 bp, Homo sapiens; identical to SEQ ID NO: 7630

SEQ ID NO: 10716 - DNA, 150 bp, Homo sapiens; identical to SEQ ID NO: 7633
  misc_feature (21)..(21): n equals a,t,g, or c

SEQ ID NO: 10717 - DNA, 162 bp, Homo sapiens; identical to SEQ ID NO: 6214

SEQ ID NO: 10718 - DNA, 301 bp, Homo sapiens; identical to SEQ ID NO: 7637
  misc_feature (98)..(98): n equals a,t,g, or c

SEQ ID NO: 10719 - DNA, 301 bp, Homo sapiens; identical to SEQ ID NO: 7639

SEQ ID NO: 10720 - DNA, 267 bp, Homo sapiens; identical to SEQ ID NO: 7644

SEQ ID NO: 10721 - DNA, 246 bp, Homo sapiens; identical to SEQ ID NO: 10003

SEQ ID NO: 10722 - DNA, 100 bp, Homo sapiens; identical to SEQ ID NO: 6215

SEQ ID NO: 10723 - DNA, 129 bp, Homo sapiens; identical to SEQ ID NO: 7645

SEQ ID NO: 10724 - DNA, 311 bp, Homo sapiens; identical to SEQ ID NO: 7646

SEQ ID NO: 10725 - DNA, 193 bp, Homo sapiens; identical to SEQ ID NO: 7396

SEQ ID NO: 10726 - DNA, 3991 bp, Homo sapiens; identical to SEQ ID NO: 7650

SEQ ID NO: 10727 - DNA, 140 bp, Homo sapiens; identical to SEQ ID NO: 6216

SEQ ID NO: 10728 - DNA, 280 bp, Homo sapiens; identical to SEQ ID NO: 7656

SEQ ID NO: 10729 - DNA, 187 bp, Homo sapiens; identical to SEQ ID NO: 7657

SEQ ID NO: 10730 - DNA, 246 bp, Homo sapiens; identical to SEQ ID NO: 7658

SEQ ID NO: 10731 - DNA, 153 bp, Homo sapiens; identical to SEQ ID NO: 6795

SEQ ID NO: 10732 - DNA, 202 bp, Homo sapiens; identical to SEQ ID NO: 7667

SEQ ID NO: 10733 - DNA, 275 bp, Homo sapiens; identical to SEQ ID NO: 6733

SEQ ID NO: 10734 - DNA, 203 bp, Homo sapiens; identical to SEQ ID NO: 7398

SEQ ID NO: 10735 - DNA, 166 bp, Homo sapiens; identical to SEQ ID NO: 7670

SEQ ID NO: 10736 - DNA, 190 bp, Homo sapiens; identical to SEQ ID NO: 7674

SEQ ID NO: 10737 - DNA, 2364 bp, Homo sapiens; identical to SEQ ID NO: 6735

SEQ ID NO: 10738 - DNA, 1367 bp, Homo sapiens
atgaaacccggtctctactaaaaatccaaaaaattagccgggtgtggtggcaggcgcctgtagtcccagctactcgggaggctgaggcagtagaatggcgtgaacccgggaggcggagcttgcagtgagcggagatcgcgccactgcactccagcctgggcgacagagcgagactccgtctcaaaaaaaaaaaaaaaatctttattaaattgacaccccccttgaacacctgttattatgaggtacgtaggttctagaccaaagctaatagaacactgcaatgttgaaaatgttctacatcttcagtatagtatctaatatgatagccactagccacatgtggctattgagcacttgaaatggaattagtgtgactggggaaccaaattcttaattatatttatttttcattaacttaactttaaatagcccactatgggtagtggctatcataatggacagtgcagatctgtacaacaaggatgcaacgcagcagggtgttagacacaaacggcccctgccccctggggactttacattttagtgtaggaaatcagcaagaaggaagaaagtgattagataaggaaaataagagctcttcagaaaataaaatagagagttcctggagcgtggaggggcaacttcagcaaaggtcagggagggcactttttgaggaggagacatttgggctaagacctcaacagatgaagcagctgggcaaagttttgagggaagggcttcccagacagagggagcagcaggtgcaaaggtcccgaggtggtggccgggtgcggtggctcacacctgtaatcccagcactttgggaggccgaggcaggaggatcacgaggtcaggaaatcgagaccatcctggctaacacgatgaaaccccgtctctactaaaaatacaaaaaaattagccgggcgtggtggcgggcacctgtagtcccagctactcaggaggctgaggcaggagaatggcgtgaacccgggaggcagagttcgcagtgagacgagatcgcgccactgcactccagcctggcgacagagcaagattctgcctcaaaaaaaaaaaaaaaaaaaaaggtctcaaggtgggaaccagcctgatgtgtttaagaaaatgctgtggctgggccgggcacggtggctcacgcctgtaatcccagcactttgggaggctgaggcgggtggatcacaaggtcaggaaatcgagaccatcctggctaacaaggtgaaaccccgtctctactaaaaatacaaaaattagccgggcgtgatggtgggcgcctgtaatcccagctactcgggaggctgaggcaagagaatggcgtgaacccgggaggcggagcttgcagtgagccgaga

SEQ ID NO: 10739 - DNA, 261 bp, Homo sapiens; identical to SEQ ID NO: 7678

SEQ ID NO: 10740 - DNA, 776 bp, Homo sapiens
cgcctgtttgtagtccggggacagccagccgacgtgttcccaaggctgttcaaggtaagcgtgcagagccccagagaagacagtgagattctgtccctgacggtttccccacagcctgagtgatatgatattccgactgagggaatggaaacatcagggctggtctggctgttgctgctagagaagttgggagcaaaggcagccagttagcttgctcttggaatggaaactgtgttaaggaaaaaaattctgggaaaccagtgtcttgttggaaagctctcagctcagtccagacataggatgtggtaagtcattccactctggatgccactggcttccttcaatgttttcttggctcaagccagccagatttattagggttccttctaggccaagactttgaggtggggtttcatgtctagcaaggtacatttcccatcttgctttgctctgcttattgggaaaagtcagccttttctgccgggcgaggtggctcacgcctgtaatcccagcactttgggaggccgaggcaggcggatcacgaggtcaggagatccaggccatcctggctaacatggtgaaaccccgtctctactaaaaatacaaaaaattagctgggcatgttggctggcacctgtagtcccagctactcgagaggctgaggcaggagaatggtgtgaacccgggaggcggagctttcagtgagccgagattgtgccactgcactccagcctgggcaacagagcgagactccgtctcaaaaaaaaaaaaaaaaa

SEQ ID NO: 10741 - DNA, 318 bp, Homo sapiens; identical to SEQ ID NO: 10030

SEQ ID NO: 10742 - DNA, 276 bp, Homo sapiens
cactttgggaggccgaggcgggtggatcacgaggtcaggagatcaagaccatcctggctaacagcgtgaaaccccgtctctactaaaaatacaaaaaaaattagctgggcatggtggcgggcacctgtagtcccagctactcgggaggctgaggcaggagaatggcgtgaacctgggaggcggagcttgcagtgagccgagatggtgccactgcactccagcctgggcaacaaagcgagactctgcctcaaaaaaaaaaaaaaaaaaaaaaaaaat

SEQ ID NO: 10743 - DNA, 108 bp, Homo sapiens; identical to SEQ ID NO: 7680

SEQ ID NO: 10744 - DNA, 61 bp, Homo sapiens; identical to SEQ ID NO: 6218

SEQ ID NO: 10745 - DNA, 312 bp, Homo sapiens; identical to SEQ ID NO: 7681

SEQ ID NO: 10746 - DNA, 158 bp, Homo sapiens; identical to SEQ ID NO: 7682

SEQ ID NO: 10747 - DNA, 193 bp, Homo sapiens; identical to SEQ ID NO: 7690

SEQ ID NO: 10748 - DNA, 95 bp, Homo sapiens; identical to SEQ ID NO: 8302

SEQ ID NO: 10749 - DNA, 323 bp, Homo sapiens; identical to SEQ ID NO: 7699

SEQ ID NO: 10750 - DNA, 310 bp, Homo sapiens; identical to SEQ ID NO: 7703

SEQ ID NO: 10751 - DNA, 253 bp, Homo sapiens
ctttgggaggccgaggcaggcagatcacgaggtcaggagatcgagaccatcctggctaacatggtgaaaccccgtctctactaaaaatacaaaaaattagctgggtgtgtttgcaggtgcctgtagtcccagctactcgggaggctgaggcaggagaatgggctgaacccaggaggcggcttgcagtgagccgagatcgcaccactgcactccagcctgggcgacagagcgagactccatctcaaaaaaaaaa

SEQ ID NO: 10752 - DNA, 183 bp, Homo sapiens; identical to SEQ ID NO: 7707

SEQ ID NO: 10753 - DNA, 136 bp, Homo sapiens; identical to SEQ ID NO: 6219

SEQ ID NO: 10754 - DNA, 260 bp, Homo sapiens
ccttgggaggccgaggcgggcagatcacgaggtcaggagatccagaccatcctggctaacacggtgaaaccccgtctctactaaaaatacaaaaaattagccaggcatggtggcgggcgcctgtagtcccagctactcgggcagctgaggcaggagaatggcgtgaacccgggaggcggagcttgcagcgagccaagattgcgccactgcactccagcctgggcgacagagcgaggactccgtctcaaaaaaaaaaaaaa

SEQ ID NO: 10755 - DNA, 279 bp, Homo sapiens; identical to SEQ ID NO: 8074

SEQ ID NO: 10756 - DNA, 202 bp, Homo sapiens; identical to SEQ ID NO: 7718

SEQ ID NO: 10757 - DNA, 320 bp, Homo sapiens; identical to SEQ ID NO: 6742

SEQ ID NO: 10758 - DNA, 300 bp, Homo sapiens; identical to SEQ ID NO: 6744

SEQ ID NO: 10759 - DNA, 150 bp, Homo sapiens; identical to SEQ ID NO: 7399

SEQ ID NO: 10760 - DNA, 322 bp, Homo sapiens; identical to SEQ ID NO: 6747

SEQ ID NO: 10761 - DNA, 142 bp, Homo sapiens; identical to SEQ ID NO: 7400

SEQ ID NO: 10762 - DNA, 123 bp, Homo sapiens; identical to SEQ ID NO: 6220

SEQ ID NO: 10763 - DNA, 270 bp, Homo sapiens; identical to SEQ ID NO: 6749

SEQ ID NO: 10764 - DNA, 301 bp, Homo sapiens; identical to SEQ ID NO: 7743

SEQ ID NO: 10765 - DNA, 214 bp, Homo sapiens; identical to SEQ ID NO: 7748

SEQ ID NO: 10766 - DNA, 243 bp, Homo sapiens; identical to SEQ ID NO: 10081

SEQ ID NO: 10767 - DNA, 307 bp, Homo sapiens; identical to SEQ ID NO: 7758

SEQ ID NO: 10768 - DNA, 166 bp, Homo sapiens; identical to SEQ ID NO: 7759

SEQ ID NO: 10769 - DNA, 228 bp, Homo sapiens; identical to SEQ ID NO: 7231

SEQ ID NO: 10770 - DNA, 214 bp, Homo sapiens; identical to SEQ ID NO: 7765

SEQ ID NO: 10771 - DNA, 268 bp, Homo sapiens; identical to SEQ ID NO: 7767

SEQ ID NO: 10772 - DNA, 906 bp, Homo sapiens; identical to SEQ ID NO: 7771

SEQ ID NO: 10773 - DNA, 368 bp, Homo sapiens; identical to SEQ ID NO: 6222

SEQ ID NO: 10774 - DNA, 131 bp, Homo sapiens; identical to SEQ ID NO: 10092

SEQ ID NO: 10775 - DNA, 823 bp, Homo sapiens; identical to SEQ ID NO: 7774

SEQ ID NO: 10776 - DNA, 2925 bp, Homo sapiens; identical to SEQ ID NO: 6223

SEQ ID NO: 10777 - DNA, 4706 bp, Homo sapiens; identical to SEQ ID NO: 7776

SEQ ID NO: 10778 - DNA, 3322 bp, Homo sapiens
acgggatgcagccatcatgaagatggccaaggaggctggtgtggaagtagtgacggagaattctcataccctctatgacctggacaggtaagagatggggcccagggatcaggttaccaattgtgagagttagtaatttgggcccctgctgagcggaactcagagaggttcagcattagggctacctgacccaggaggcatggcatcttctagaagctggaggagaataggccagagtcaggacctgtagaacaggtcacaaagagctttaccccattgaggtggcagagaggcttgttaggcccaaagcatggaagcagtgaggacccacactcagggtatttacaaatctgctcctagtatgcccgagtcccacctgtgcctcatattcccacttccatcctgctcaacagctgccctctgacctcagtggaccctgtctgttacccctccaacagacctctgttcacacaggtccagtttttgtacctaagatgagttcctaggctgggcatgctggctcatgcctgtaatcccagcactttgagaggatcacatgagtccatgagttcaagatcagcctgggcaacatagtgagacccccgtctctactaaaaataaatatattagccatgcatggtgggacatgcctgtagtcccaattactgaagaggctgaggttggaggatcacttgagcccaggggcttgaggctgccatgagctgtgatcatgccacgtcactccagcctgggtgacagagcaagatcctgtgtcaaaaaaaaaaaaaaaagagttcccaggttctatgactatctgggtttccaggccatgttgcttggtggcggggagggctctagagatccctgcagggagctgctaactacagaggagcctcctcccctggtgacagcctctgtgctttcagagattctaggaggaaatcctctcctccccttccctgccatgccagagctgtcaccctcctgctgctgctgctgctgttgctgctgctgccaagccagcagccgccgccgctccccacccccacttcccaacccagtgctggctgccaagaagccaggtcacacagctgtgcacgtgagccgggccctcaggaggagaggctgggtgtggagatcctcctcctgctgcgtgccagaggagagggaggcatagcagaggcagcagccgaccatatatctccactaacgtggggagagcaaactgagaaatgaactcacccagccagatgggccttgcgtaagctacttcttggccaagaagagccccgggaatgtggctccataccatcccaattcatccttatataaacagcctccgttctcttcttcgccctctgatactccttccttcttgcatgagtgcagttatgttttccctggtcatgaaaaatactttgtaaactacaagactctctttaagtatcagttgtggctatgaactctagctccagtctctgaatttgggaggataagctgtcttccacctctctgttcaatgttctaataaatggaggctaagaaggggatgattttccaagaaaggaacatgtctgctattccttatgatgttagagttaaaaaaaaaaaaaaaaaaaacatgtcttcagctcttatcaaagaactttctccagggcttacatgggtggtagaggcctatggggattcccttagcttggacagataggccaagtgccaagcaggctagtagggatttttctgtgattagagattttgtcagtctctgtctttaggcggctctgcgtcaacaccagggagcccggaattgagtcccagctctggccctgccttgctccattactgaggcacctgcttcagctctctgggctttattttccctctcggtaaaatggagatgcggcctcccttgccccctcctttccactcaggcatgggacctgtgagtggatgaggaaagccaccctcaaagccttcagagtctgggttcttttttgggtgggcagggacccacatcacagggccatgtgggtaacactagctatgctttgggctccccaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctgggtgcgtacttcctgcccagagccacttgtgctggtgcctgcttttgtgtaaagaaattctttgtgaaagtaatgcatgtcattatagaaaggttagaaagcacaggaaaacaaaaatggaaatggcagtcactattactccaccacccagaggtaaccacaattaattttaaactgtgtccttctagtatttgttctgttcatactcatacatgtaatcttctgtttctggttctagatcatgcctctatttttgtactaacctctcgcagacaatacaggcactgcctggtgctggtgtccatgggcttctcagtaacaagatagctagtattgcttctgttgaaagcagggaatctgtcagcctctcagattactaactacactctttcacccctccctctttcttaccttttttttttcttttttagacggagtctggctctgttgcccagtctggagtgcagtggcacagtcttggctcactgcaacctccacctcccgggttcaagcaattctgctgccccagcctcctgagtagctgggactacaggcgcctgccatcacgcccagctaatatttgtatttttagtagagacggggtttcaccatgttggccaggctggtcttgaactggtgacctcgagtgatccacccacatcggcctcccaaagtgctgggattacagacgtgagccacacctccagtcttttgatctgaacaaagctattagcctttttcacctgaaaaccacagttgttgccagctaatctgaaaaggcaggaggtccgggattgttgtcatctacctggagcgatgagggtgcaggggaaagcagagaaaatagtgactgtgggaagagaaccaagttgacctagaaaacgctaaaactttaaggattatctaacccccagtagcaccgagacactgtggttcaattctcataaagttcaaataacagaacagccgtgccgggctatcactgaaatggtcaaacctcctgtcttgtgacctttccttctcttcagggttccccactgaaggacttggtccagctgtctggcagggaggagagac

SEQ ID NO: 10779 - DNA, 4704 bp, Homo sapiens; identical to SEQ ID NO: 7404

SEQ ID NO: 10780 - DNA, 1049 bp, Homo sapiens
tctatgacagagccctgcgtagccccctgagctttgtcaaggctgctgagaggtttaggggcaggtgcagtgtcaggagtcccccagccaggccctggcacatagaggccatgcggccagacttggatgtggcagtggtcttggggcaggtgctgcaggctctaccactcttcaactgtgtcttcctgttctcctcttctcccatcagcaagctcaccccctggcttttgatgccagcctcctttgtggtgtggcaggaatgtcctgggaagagacaaggcttgaccacgtggatggagtgggaagacaggaggcactggggacagcatgtggctggggtgagctagtgggcggtggtactttccccaaagtccagagcactgggtgggagcagcgctcagctgtagggatgtctggtgtgaggttcttctgggcacctggcagagatcccaggtggcaactggcagaaggtccccagctcagagtgggccctgcatggcgttgtatgctggtgttcttttgtgggcaggacacctgcaagagggctacagctggagaaatgggtggggaggagtggctgttgacagctccctgggcccagagagaattgagtcagaattggggaaattgcagagcgagctcaaaagcagaaacccagttgggggaaagtatcgtacccagggctctaaatgactaatgcagaaatgatgttaagtttacctccagtcagagtgaaactttggcagcccccgctccctacacgcagctgccttcaggggaagtgagaattgacccaagccacaggtgaccatgacaggaccttgcactagctgagacccgagggtttaggaaattatatgagaaatgaagcaagagatgattatcttttgacagccaagtccccagatggaatttagatatttgaactaggcctaaggaatgtctgtctattaagtgtctgtagaaatttctgtcatctgcttgcagcgttgctgttttagctctgctaccattcttttctctctccatctcgtaaagaaaaaaaaaaa

SEQ ID NO: 10781 - DNA, 394 bp, Homo sapiens
tcatccaagtgacactgaggctgaggctccgttggtggaaactctgaagaagtgttttccagatggaagtgaatagacctagggttctctagaggtgcatggatggaaatggctgcggggcgggggactgggaggagcggcagagacaggaagagccaatggcatgtgggggcggccaggccagaaggacactccctggggtctgtacttcaccctcagtgaggcagcagggtttccagggggagcctgccccagtgccctctgagctcactgagctttgccctgatcagtcagccccactctttttgcttgtttgtgtaatgaagcccactgaagataaaattgcattcagaagaaagaaaattatgacctcaaggggaagcaaagagaaacc

SEQ ID NO: 10782 - DNA, 6717 bp, Homo sapiens
cctcccagtctgaggctgcatcctccattaccatcgcccttcctgtgggctgggaggccaggtcctttcctgcccagcgatgtcagcgtttcctcaggggccaggcactcatcaggagaaaggaactaattacttgagtaatttgccttgccttgctgagaggagtgtgccctgagggactccatgtgagtgtggtgacgggtgtgggggtgtccctgtgttattttaaaatgggtgccttcaggacgatgagcatgtgaccatttcctctctatttccatcacaagagtattatggtatgagggtctcaggttagattatcctcccaagactcttctctcttccttctctactggaagcccacatagcatttccttatggcttgagggagaggttcggagccacttacaaattagataaagtacatttacaatcttgtacaaagccacacaatgaagtcatttttctcagctttttttttttttttttttttttttttgagcctgagtctcgctctatcgtccagactggagtgcagtggcgcgatcttgcttcactgaaacctctgcctcccaggttcaagagattctcatacctcagcctcctgagtagctgggattacagacatgcaccactatgcctggctaatttttggatttttagtagagaccgggtttcaccctgttggccaggctggtctcgaacccctgacctcaagtgatcttcccgcctgggcctcccaaagtgctgggattataggtgtgagccacagtgcccagccttgtttttgtttttgttttgttttgacagtctgtcactctgtcacccaggctggagtgcagtggtgcgatctcacctcacttcagcctctgcctcccaggttcaagtgattctcctgtctcagcctcctgagtagctgggattacaggcgtgccaccacgcccagctatttttgtaatttcattaaagacagggtttccccatgttggtgaggctggtcttgaactcctggcctcaagtgatccacctgcttcagcctcccaaagtgcagggattacaggcatgagccactgtgcctggcctcagctatcttgaatgctggagaattaaatccttttctgtctagggtgtcagctccctaagggctgggccaaaacagttggatttataagacactagagtcttgcctcagtagctcctttgaattctgcactgaattgatcagtttcttggcccaaagtaaactcagatggcagcccaagagccactctgcagtgccttctttcacatggtcatcatgctctctgatccctcaggttctgtctaagcctcatgttttatgaccgtgctgttctcagcccacctcaccctgccccatgccttctcaatggtttgttcacctgaattccccagatttcatgccagtatccccaaggttccttgacctcttggtgtaagcattcagcatctaaaattcattttattcccgtcaacgcatttctaactgtagaacaagaattataaatgacaaagctcatagaaaattggcaccttgtcttccccctccctcttattttatacataaaagagaatatgggctgggcattgtggccaaggctgggcatgatagctcatacttgtaatccagcactttgggagggtgaggcagatggatcacctgaggtcaggagttcaagaccagcctggccaacatggtgaaacctcatctctactaaaattacaaaaaaaaaattagctaggcatggtggcagatgcctgtaatccagctactcaggaggctgatgaaggagaatcacttgaaccctggaggcagaggttgtagagagccaagatggcgctactgcactccaacctgggcgaaagagagcaagactccgtctcaaaaaaaaaaaagacaaaaattagccaggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccgtaagtggcttcctttccccgttttgccttcatttctaatatcctcagttatccctgggaatgggacactgggtgagagttaatctgccaaaggttggaagcccctgggctatgtttagtactcaaagtgaccttgtgtgtttaaaaagcttgagcttttatttttctgttggagaccagagtttgatggcttgtgtgtgtgtgttttgttcttttttttttttccattgtgtcttgtcaaccccccgtttcccctcctgctgccccccatttcctacagaacgacctgcagcaataccattgacctgccgatgtccccccgcactttagattcattgatgcagtttggaaataatggtgaaggtgctgaaccctcagcaggagggcagtttggtgagtatttggttgacagactttgtccctataagggaagttggtcccctttgtgtgatgctctcacatgtacacaccgagagctggtcactcggaatggtaggagattctagagctttgctttccaaaagagatggtatgaatgccacatgtgtgagtataaatcttctagcagccacactggaaatagacgaacttaatttttacaatatattttatttaacccactaaatccaacatactctcaatttaacatttcagaaaaagttgaggctgggtgagtggctcatgcctgtaatcccagcactttgggaggccgaggtgggtggatcacttgaggtcaggagttcgagaccagtctgaccaaaatctctaaaatataaaaattagctgggcatggtggcgcatacctgtaatcccagctactcaagaagctgaggtgggaggatcgcttgagcctgggaggtggaggttgcagtgagcagagatcgtgccactgcactccagcctgggcgacagagtgagactccatctcaaataaacaaaactaaactaaaaagaaaaagttgagacctttttttattcttttttttcatactaagcctttaaaatccagtgggcttttgacagccacagcacagctcagtttggacaaaccaaatctcaaatgcttggtggccacgtgtgtctcggggctcctgaattaaacagtagatcaagggcagaagatctcaggacagccttagagcttctgtaaacatggagctctgggaatcagttaaggtgggaatgagaaaggacccttcccgaggcagggtcctccagggaggagggtaaatctggcttttctgaccatccctgggccttaaggggcaggagattggatagcagtggtagcctgggccctgtcctctgaagggctgggggcgtggcctgccagttgcagagggtggacaactgaactagttttccctgtctgtccctccagagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 10783 - DNA, 418 bp, Homo sapiens
aaaggtgtcagagtggaggcctccctccccggccccctcctaccccccagagcggcctcgtcctgtctggggtcagataagccacctaagcggggtggggggtagatactcccaccgcaccaaggcctccccttccacagttggctcctttatcactttcccttcagttcacccagcggggacaacacgcagacacccggtggtggctgcagggcccccggcagccagcggtgataatgcagggaaaggcgccccaacctcagctacgcgggcgcccacagggcttctccccacccctacacgtgccccagcgccctggagaccgcgcctgggagctacgagcgagcaccttccctcgcagagatggatcagattagccccctggggcggtggcacctgcccgtcccctcccctcctc

SEQ ID NO: 10784 - DNA, 327 bp, Homo sapiens
tccagcctgggtggcagagtgagactccatctcaaaaaaaaaaaaaaaaaaaaaagcactttgggaggccgaggtgggcgaatcacgaggtcaggagatcgagaccatcctggctaacacggtgaaaccccatctctactaaagatacaaaaaattagccgggcatggtggcgggcgcctgtagtcccagctatttgggaggctgaggcaggagaatggcgtgaacccaggaggcagagcttgcagtgagccgagatcctgccactgcactccagcctgggtgacagggtgacagagcaagactccatctcaaaaaaaaaaaaaaaa

SEQ ID NO: 10785 - DNA, 90 bp, Homo sapiens
gtgaaaccacgtctctaccaaaaatacaaaaattagccgggcgtggtggcaggtgcctgtaatcccagctacttgggaggctgaggcagg

SEQ ID NO: 10786 - DNA, 11566 bp, Homo sapiens
  misc_feature (8601)..(8602): n equals a,t,g, or c
  misc_feature (8617)..(8617): n equals a,t,g, or c
  misc_feature (8619)..(8619): n equals a,t,g, or c
  misc_feature (8625)..(8625): n equals a,t,g, or c
gcggccgcctgcagggccctgcaagccgccggagccgggcaaccaggtgagactgcgcggggcccggctgggcgcgggcgggcggtggctcgggcacgtcccccaagttggacccctttggccattcccttattgagcaccgaggtaaactgaggctcagagcagggaggtgcctagagccaggcctcgcagctagcggagagcgggccgtgcgtagcggatcgagtctgtcccggaagggtccggagtgcacgggagatgcctagggggcgtgggaaagctgaggggccgagtagaaggcagagggagtgggtagagagaagggatgaatcgggcaaggccgagatctaggagttacggggtgggtgggggtggggagagaagaggagtggggaaggaaatgggaaagccttgggatgggaaagtttcaagggggtggatgggtgctaaggagattggcggtgccagaagctaaattctagggcgctgcgcagccagagatgcgtcgggagctctaggaggggcggaggggcatctccagcgcggtggaggctcgtcctggaagccctgcctggttttaggaagagggcaaggaatgggtgctcgggacttgacgtgtggggaggtgagagggactaagagtacattttctattgatttctggccacccaccaaggctgtgcacccaactgctgtgtccctcagcctcccccaggtctgctgaggccaccttttccctccacattctcctgaaaggtggaagggatttaagggtcttttcccagcccccgtgactgctgccatcagcagaagggtcaggatctccttcctcctggaacacaaggctttacaggaactctccaatgttctaggatgaaaatatgcacattaagagtagctgcatctggctatcgcaaggacaaaaaaccaaacacagcatgttctcactcgtaggtgggaattgaataatgagaacacatggacacaggaaggggaacatcacacaccagggactgttgtggcgtagggggagggaggagggatagcattaggagatatacctaatgctaaatgacgagttaatgggtgcagcacactaacatggcatatgtatacatatgtaacaaacccgcacgttgtgcacatgtaccctaaaacttaaagtattaaaaaaaaaaaaaaaaaagagtagctgcatctggcaaacccgggagatctttgcactctccagctcccagctttctctccctgcccagctgggcagcccttcaagccctccagccccttcctcttaagtagataatgaagaaagtggctgtattgtgtgtctcctggagtattggcgttggttggggggcggagggtcccagcaaggagacctgtcacctgtgatgctgccaatgtcacattcacctgccagcctggcctgcctgggcgagcgcgcctgccctaaccctcctcccttagggtgcaatccatttttttgttgaggctgtgattgttctgatttttgtttcaacccctttgctgaccaggcctccaatagaaagaagggaattcacacacattttctataccctaatgagtgcatgcattttttttttttttagatgaagtctctctttgttgcccaggctggagtgcaatgatgcgatctctgctcactgcaacctctgcctcccagtctcaagcaattcttctgcctcagcctcccaagtagctaggactacaggcgtctgccaccacacccagctaatttttgtttttttggtagagacggggtttcgccatattgaccaggctagtctcgaactcctgacctcaagtgatccacccactttggcctcccaaagtgctgggattacaggcatgaactaccacgccctgtccctcctaagctttttgtagacacattgctgttgcctgagcctgaagagccttttctcctccctcctcctcacctggccaatcccatttgtgcattcagaactggacttcctcctccgggaagcctcccttgaccttccctgctcccacttgcaagttcactggcgaaatcccagaaccctttatccctttgctctctgagctcttaccacatgatttcgttcccttgtgaacatgattttgttcccttgtgggtttaaacaccatctgcagtcccatttcctgataccctgcctggcatgcagacagagtgaatgaatcctcccttccttttaaataaacactaatacttttgagattttaacactttgcaagggaattgttctctatgttaagcgctttcctacttttataaaaacatactgaacaaaattaaacctctcgcaaatgactaaaggtcgtgagtggaattataacttatagcccactgatttctttgcagcttttgcagtgggcagaactattatcttcacaccaaatggattcatgtcactaagatttcgctagtggttggatctgtttttttaaagttttccaatttctttcctcaccgtctgatgataattcttattctaggttgcttgccttttggcagtgcccttttacccagttcgtggtacctaatccagctgcctttgggttgaaaaactaaggatacagtctctttacctttgggtgcgggttaagagtaaattggtcctgaataaagattatgaacaaggattttccttgttttggttgcctgaagtcttttaaaaataaataaataaataaaataaacaacctagttcctgttgactttatagattactaaaaaatgtatctattcctgccaagaaatagtttgaactaaaatcagagggaacgtgcagctctttgagtattttgtttggtgctatgtaattgtaattaatttcatgtcattttcattgctttatttcctcaacatggtacctacatcacagggcttttgtaagaattaaatgagataacatagataaaagtaaagcaatcatttttaaagttcggttttaaaaacccacccacttttgcaaatcagactctgtgtttttaatcagacagttgaaactagggcagttgaccgttggggcacttgatttgctaaacgaaatctctcagtcttgtgaagtgggaaccatgtgaccctctgactcaggttttgtgttcttcctagtggaaggagcctgggagaggccaggcctccccggactgctagcctgcttttcctggggtccctggagccggaggaagaaccaggatgttgctgcctgcagaagctcagctcagggtgagtgctccccgacctcctgcatcctgagggccaggtgcatggaattatgggagtggtcacgtgaacttggggaccttagggacagagtggaccaacatctatggagtgcttgccatgtgccaggtgtggggatgagcaatgtgaggtgcccatatgccaggcagtgggcacatgggctcggtcaggctgggctctttccccaggagtctccacctaatgaaggcagtatggggagggctgtaacaaaggtgtctccaggagcatggtggggtgcatgggacgtgcatgggaccaaacacagcaagtctccctggagggtccagggagtatcctagagcaagtgatatttgatccggggatggagggattttcgtaggcagaaatgggaagttttggaaaaggagcactgagctaaggagtgacagcatgatgtcatgctcagaaaagggaccaccttcgagaggccctgggagtgaggtgcagaaggaaaccagtgagggccaaggctgaagggaagagtttggaccaaatcagtgtcccagatgtgcagccttcaggagtagtgtgccatgagcgatttctgagcagagagattggggtgtgtttagagagatggactctaggagagggagacacctcggcagagcccacctaggaggaggctgtcgtgtcccaggagggataacaggcggcctgggcccgacctgggcagtgggaatggaggggagaaaactcacccggagccactcctaggtggaatcatcaggccactaaatggaaatgagggagaaggggaaggggaagacacccctccatgtcaatgctgatgttagagagataggaagcgcactgatcccccccttatccacgtgagatgctttaagacacctgtggatgcctaaaaccatgggtagcaccaagccctacgtatacactgtgttttttactgtacatatatacctacgataaagcttaatttataaactaggcacagttaagacatttaacaatatataacaaaagttacaggaatgaggtatctctctgaaaatatcttattggactgtaccgcaggtaactgaaactgcggatagtgacgccatggatgggggtggctacagtactcggaagcatggtgtagcctgctgaatgcacacagcccatcccaaagtgcactgagaagtatagctttgttacagaaacaatggatggtggttcaaaattaactttcattgtgtctctcatttaagaaagaaaaccattagttgatgtgtcagtcttcattgctgcataagaaatgatcgcaagtaggttgggcatggtgactcatgcctgtaatcccagcactttgggaggccaaggtgggcagatgacctgaggtcaggagttcaagcccagcctgaccaacatggtgaaactctatctctactaaaaatacaaaattagccgggtgtggtggcacatgcctgtaatcccagctacttgggaggctgaggcagaagaactgcttggaccccggaggtggaggttgcagtgagccaaggttgtgccattgcactccagcctaggcaacaagagtgaaactccgtctcaaaataaataaataaataaataatcacaagcttagcagcttcaaaggcattgattaggtgtctgacttcttgctggctgtcagctggggctgctctcagctccaagaggcccctgccattccttgctctcacaagccctctcacaagagatcctccttcaatcagcaggagaaccccgctctccagtctgctaggagggagtccacataacctaaggagtcaaggtagtcactagccattgcatttgtcagagagacaacctactccccagagtgactaagctatcacattcacagagcccatccagactcaaggaagggctttataaggggccagaatcttgggggctgtcttagaattctgcctgtcatgtttgaaaactcaaaaaaaagtacaaaaaaaaaaaagaaagaaaacaaatgtgaaacatcattcacttaattccatcattcagagataactacaattatattttggggtacgccattctatttacctatctctccttgtgctctttaaaatttaataaactcacttctatatcatcttcaaaatgcagtagatatttaaaatgtttaattgcaaaaatgctaacttcaacctctccaccatcattttggatatacttggaaactaaaggagaaaagatgaagcaacagaatcattaaccattttacataaatcttggataatttctctctctgtggtatgtacaaatctcatatagaagtgaatgtattaaaatgcaaatggcatttatggactatgtacacacattgatagcatatgataaatataggatatcataattacatgcatttatacaatcatgagttgcttaatgacagggatatacattctgaaaaatacatctttaggggatttttgttgtgtgaacacgatagagtgtacttagaaacctggatggtataacctactacatgcctatgctatgcggcatagcctatcgttcctaggctacaaacctgtacagcaggttactgtcctgaatattgtgggcaactgtaacacaatggtaagtagctgtgtgtctcaacatacctaaacatagtaaaggtgcagtaaaaatatgctataaaagatcaaaaaatggtacatctgcataggacacttaccatgaatgaagttttcaaggctggaagttgctctgggtgagtcagcgagtgagtggtgagtgaatgggaagacctaggacattgctgtgcactactgtcgactatataaacgcagtacacttaggctacactacatttattttaaaatatttctttcttcaataataaattaaccttagcttactgtaacttttttactttataagctttttgattttttggccaggcatgatggcgcgtgcctgtagaccctgctactccagaggctgaggcaggaggatggctcgggcccaagagttcgaggctacagtgatccgtactcctgccattgcactgcagcctgcacaccatagtgagactgtctcaaaacaaacaaacagacaaacaaaaaccacctttttaaattattaaaagctttttcactcttttgtagtaatacttggcttaaaacacaaaatattgtagaaatgtacaaaaatattttctttctttatatccttatttagtaggctttttcctattttaattttttttttttttttttttttgctaaaaactaagacacaaacatgcgccttagcctacacctacacacaaggtcaggatcatcagtatcactgtcttctgcttccacatcttgtcccactggaaggtcttcagggacaataacacacatggagctgtcacctcctatgataaacaatgccttcttctggatacctcttgaagggcttgcctgaggcagttttacaattaactatatatatatataaactttatatacgtgtgtgtgtatatatatctttatatatatatatatatacacacacacacacatataagtagagggagtacactctaaaataatgttaaaacatatagtaggccgaggctggcggatcacctgaagtcaggagttccagaccagcctggcccacatggtgaaaccccatctctactaaaaatacaaaaattagccagggcgtggtggcacacgcctgtaatctcagctactcgggaggctgaggcaggagaactgcttgaacctgggaggcggaggttgcagtgggcagagatttcgccagtgcactccagcctgggcaacagagcaagactccatctcaaaaaataataataattttatatatatagagagagagagagacagtacagtaacatagtcatttcttattattatcaagtattgtctactgtatataattgtatgtactagacttttacatgactggcagcgagttaggttgtttccaccagcattgccacaaacatgtgagtaatgcattgcactgcaacatcaggacaactacaaggttactaggtgacaggaattttttagctgtgtttcaatctttttttttttttttttttttttttgaaacagagtctagctctgtcacccaggctgcactgtgcagtggcacgttttggctcactgcaagccccgcctcccaggttcacgccattctcctgcctcagcctcccaggtagctgggactacaggctcccgccaccacgcccagctaattttttgtatttttagtagagacggggtttcaccatgttagacaggatggtctcgatctcctgacctcgtgatctgtccgccttgacctcccaaagtgctgggattacaggcgtgagccacggcgcccggccagctgtgtttcagtcttatgggaccactctcttattaaggttcgtaattgaccaaaatgtcattatgttgcacgtgactgtacttactggtttggaatctgctttcttcatcaataacatactataactgccttccacagcaataattatatgtcaacaacatattttcttttttgaggtaattctaaattaacatgcagtggcaagaaatcatacagaaatcccagcactttgcgaggccgaggcagggggatagcttgagctcaggagttcaagaccagcatgagtgacatagtgagaccctgtctcaaaaaacaaaaagggagatcacccagagagatcctgtgtatactttgcccagtttcccccaatggtaacattttgcaaaactatagtgcaatagcacaaacgggatattgacactgacgtaatccacagatcttattcggatttccccaattttacttctatgcagtgtgtgtgtgtgtgtgtgtgtgtgtgtgtgtgtgtgtgtgtgtgtgtttaggtctgtggaattttatatattgtctttaatacctgaatcccattatatgtgtgagccatagttcactcaaccagtcccattgttggacatggaatcgggacactttcaactgcaagtaaagataccatgacacacatgagcacaagcagtaagagaaatcattatctcacctaaaagacagtccagagatggagtcggcttcagagttggttgattcaggggctcagggaccccaccaaacacccaggtttgctctttctctctgttgggccatcttcagtgtcagtttcatccttaggctggtagcaagatagctccagcagttccactaattattcctaattattttcttaggataaaatcctagaagtgaaatttgtgggtcaaagggtgtgtacatcgttaaggttnntgatatgtattttgntntgtttnttaagtaggtatttgctggggacaactttctcctttcccttcctagataactcactcacaacctttctcttctgattcagtgatttcttctcctgtgttccagaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaacaaaa

SEQ ID NO: 10787 - DNA, 693 bp, Homo sapiens
tacagaaacttagtctgtgtcttgtagccctgagctcctcctcttcctcaccagttaacaatatctcaaagaagggtgttgtcctgaaccattaccataaccccagcctaagctcaccctgaccaccactgtcccaggtatatcaccggctccagaactcctggctgccagggcaaccccccgcccccagccccttgctctgggacaggagggagtgggtctcacctttagcctctgcccccggttctggtctgacccagcacatggcagctccaaagagcggacaaaaccttgaagcaaagccaaagggccaggcctgaatgggaggtcagagggaagaaggcccaggagagggtctaagccagccctgtctaagaggaatctaacgcaggcacataggtagctttctatggtggccacattagaaaaaagtaaaaagaaatagataaaattaattttaagcatacatttcatttagcccaatatatctaaaatatcatttcaactgtaaattatcgagacattctgcattctgttttgcatattgtctttgaatcccatgagtttacacttagagcccaattcagatactacattttcatcagaaaaacttgatctgtatttagatttaattaaatgtacagtcgtaaacattcacatcctcaaattgtttcagaaatactgaaaggtttt

SEQ ID NO: 10788 - DNA, 576 bp, Homo sapiens
tttagtgttatgatgtcttttaaaccacagtttatgcctctatcccttttttttccttagtttttatgttgaagaacccagggagagttaaccaaagtttgaattttactgattgtacactcatgttgcatctttcttcattccttgtatattttgcaaattggttactgaactcagagacttggtcagactctggttcggtctctttagcaatactgtaggcagtgttgtgttctttcatggggaggcagaagtctggttttctcttttttttaaatcatgtccgcagttgttgggctcagtgcccagatccattaatttatcaatggtttaaaaatagtgacattctaattgtgtgggtttttttaaaattttttgttggaatacttttattaagagatgcttctgcttacctgctgttcagttatccagtggcacagttatataggaaaggtaggatatatacttgattctttgcctttatttattcttttttcaaaatagtgacttagttccctattattctctaagagaaccagctatttaatttaatttaattaattaatttttttgaga

SEQ ID NO: 10789 - DNA, 576 bp, Homo sapiens; identical to SEQ ID NO: 10788

SEQ ID NO: 10790 - DNA, 366 bp, Homo sapiens
ataatgaactagaatatcctcattattaattactcgcttgttttctcgtatattacacagtagtctcagaatagcaatactaataataccataaccaatgtgattgctgagaatagttgcataaattgtttcatgtatgctgtcctcatcaccccccgacatcatcatatctgtattatatctatcttgtcagattattcattacatgcaatattctctttcaaccttaatttgtttttattctgtaagtaattatatagttcagtggctggcattctttttctgtaaaaggccaggtagcagatgttttaatttttgcaggcccggaggcaaaattaaagatactatatttagggtgggcaaagt

SEQ ID NO: 10791 - DNA, 246 bp, Homo sapiens
aataagttagccaagtgtggtggtctacctgtaatcttagctacttgggaggctgaggttggaggattgcttgagcacagaagtttgaggctgcagtgagctatgattgtgccattgtactccaatctgggtgacagagtgagaccctgactcttaaaaaaaaaaaattctgttgtttataagccacccagtttatgacttttggtatagcagcttgaatgaactaagtaggtatgttttctaagt

SEQ ID NO: 10792 - DNA, 245 bp, Homo sapiens
aataagttagccaagtgtggtggtctacctgtaatcttagctacttgggaggctgaggttggaggattgcttgagcacagaagtttgaggctgcagtgagctatgattgtgccattgtactccaatctgggtgacagagtgagaccctgactcttaaaaaaaaaaattctgttgtttataagccacccagtttatgacttttggtatagcagcttgaatgaactaagtaggtatgttttctaagt

SEQ ID NO: 10793 - DNA, 366 bp, Homo sapiens; identical to SEQ ID NO: 10790

SEQ ID NO: 10794 - DNA, 7639 bp, Homo sapiens
  misc_feature (7413)..(7413): n equals a,t,g, or c
gtgtgtgtgtgtgtgtgtgtacaatataaaccaaatacaaccagatccattaacacttgatgaatttaggtgaaactctcacttacgtatggaaaatcccagaaagatctggagctggaacagaggattctgcttgtattccatgggcttattattcaactgtggatcaagttaaggtaaaatacaaatcatttgttttgtgacacttcccaaaatagacacacaattgaaggaagacaaggttagtgttttcctgtggtccaattctacgttaaaatcctaagaaaataaactgtttgcaatctactttagcaactatgctgctacctatgacacacaagacaaaaatctaacatttcctaatatgatacagctcaaaggcctttcaagatatttgggaagtttagatttttgtcttgtgggtcacaggtagccactgaaaaattgaccaagaatggcagtatatttgcatttcagatccttcattctggtggaatgaaggaaggcttggagggggaagagactggaggttgggaggccgttgtaatacgtgaggcaaatttcaaggacctctactgtaaggagggagaaaagaaatggagtcggttatagataggtgggtgaagtgcctgagtgagccgggggaagtagctccttgataattcagtgttctggctcaaacaaatgagtaaatctggtatttgtggtcctatttattattacacatttcattcatctatggatttttagggactgccatagcgcttggctcacactcaagagttcatgagtttatggaacaaaccaacactgttcatttgggattcttttaaaatcactgctcattagctgagctaatttttgcctctgcagacatttctgttatgtcagcatcacccacatgacctacctactactcaccattgttccaatttaactacttcaagtgaaaagttactaaattggcagtaccacattgggcaaagtctgttacttcaattggtctctccaaaattcctgaggccctgggtgcaaagtctcagttctctgaaatcctgacctaattcacaagggttactgaagatttttcttgtttccaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatggtatgtcacattattctaaaacaatttttctacttttttatcattttctctttcaaataaaattattttggagaccattcatttgttttgtcttaaaataaaccacttctgcctcactttgtatgtcaggtagaatcctgttcaaaacaaaaaggggactatgttcaaaatcatttgctaatttattttccaattccaaaatctcatttcctttgaaataatccaaaactaagattaaggcttttggtgcaaagtgcctagaaaagcaatgtgatattattgactttaaagtatccatttctctcatttgtagtaaaataagtcctattacatcaaaaagattctttacattaacctaataatcatattttctttgaaatagctattggtttaaaatatcctgaaaagtaacataaaaccatatgctttccctagctattaatggaagaatgtttggaaacctacaaggcctcacaatgcacgtgggagatgaagtcaactggtatctgatgggaatgggcaatgaaatagacttacacactgtacattttcacggccatagcttccaatacaaggtaagagctatccatggcaattactcttgctctgtttgaaaatgttttaatacaagtgaagaaaatattttctcagagagacttatgaaaaaaagctgcaaagagtacagccggtgcttcatatccgtggattccccacccaggattcaatcatggattgaaaatattcaggaaaaaataattccactaagttccaaaaagcaaaacttggatctgctgcactgagtactatgttgaatccatgcaaatgaaatgatatgtaggcactgtattaggtattataataatctagagatgatttaaagtatatggaaggatgtgcataagttaaatggaaatatgccattttatataagggacttgagcatccatggattttggtatgggggcattcctgaaaccaatcctccatagatactgagggatgcctatataaggcacagcaatttcaattgacacactagcctttgttacacattgagctcttcctaggatttgcatttttaactgaattttcatggagttctgctcagattcctgattaaggcaactgagcggaattgctaacaaagagggtaggaatgttcacataatgatggatgagagtagagaccacaacaagactttattataacccttgccctgcctgttctaagttctgtatcttaaatggcccatggtgagcaagatcagttaggtgacaagcaactggtctgtacatctcaatcttacttctattctttctcagtactgatttcagcagaagccagtggccctcctggaaatgctttttccttatgctttgggctaatttagaaaaggcagaagttatcaaaaagcatactgcagaaagcctgttttgttacctgcattttgttttacatagatatattgtattcttagtgggctttcaattctatccttgcagaaatagactattgtcacccaactactgtttccagccgagactccctgaagtgcctctggtttttgtcgttttcatcagcctccttttctgcttcctttattatttaccttgacttaaagcttcagacaagctaggacagattcaggcaaaagtgaggctagggctgaaatggggccacagctgagttccttttgtgtagcttaagtgctatgacaaacaggcaaaccagaatcaaggtacaggaggtttgtaggtagtcctgattgatgaattcattctcatcacatctttctttcacacccacttgatgtggataccaaagacttattaggaatacaaaaaccacattttaccatttgtattaaacacagaaacgagctcgattttttaaaaacagatttatccattttttcaatatccctgagctgaacattaacaaatgacatgagtgaactctcatatacaatattatacattatttgtcatttttctaattaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtgaatatccaggtagtaattctagaagccatatataaaagatataactaaaggaactactttgcctaaatacttcccccaatatgatgcatcaatatgaagcatttgtgaatctgctgccctgatttcttccttctctacctccaaacaggatttttttcctgctaaatggtgagggatactgctcatttcctgacagccagtacttgtaacagcaccagtcatttctaagttaatacaaatgtgtaattatacttaaagctgatataagggagtagtcatgttatttaccaagaaacaaaccattatttacataagacacatttagaatctaatttctttcttaacaaaaaacaattttttttctaggtggcacctccatgtaagagaagcccaagacaaccccaaataatataatttcaaataggcagtgtcttttctgtgcttccaaggggaaggaggaaccttaccgataattgtttgtgaaagatccagggaagaaacaaaatttaaatgcactgctccccaacccctgcaataaccctccccatgtgtaggtacacacacacacacacacacacacacttaaaatggagaaaaatgaacagtttttttggtaagattcctgcactgtggctgcaggctttggtctttcctgggtctttcgagttgaggattgttgtaattagaaatggtaaattcaaagggaggaaattatgtaaagaaaaccaatctatgtctttcctccctaaaatggggaaaaagggaacatacaaatgaagaaaatataaatgtaaatatatttgaagatttaaaaagccctgaaaggttaacctttagtgcaaatggaaagttttaatttctgctcctgggtcttacacaaacaacttacatcatgaaaaactatttccattaatgccctttttattagagcagtcactgataacactagaatatcaaagactctaacagacaagccactaaatttaacgccaataacttgaacaaagtgaagagagccaaatatgagaaagaaaactttagtctttaaataacacttgcaaccatgtggttacatgtggttgcatgtaaaccacacaaaaggatggtcttgctcaaaaaaataatggtgagtaagtaacatggaggcatttggggaattcatgtgtgcaaatgcctggcatgcagagtatggcactacagggtaaccctacacacacagccacagagaagattcctcctgtgtaacaaccgtgaaagaagagggagattactgcttggttaagaaaggcgagatagtttttaaagctatagtaaaaattacagaacaaatagcaaatatgaagtaaaaatcaacactagataaaaaattaaagagaaatttgacttttgcaaagagaaaaggtattgcatgagactgaaagcagcagactgaataaaaaaagatagtttgaactatctttggcccataaaatcagtggccatgtttatcagtctgaatcatctttaaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtagccacattggctttctcattcttttccctatctccctctcatgctcaccctctatatgtacacacacagacgtgtatagatacacatacaactatctttcctaaaaacaagaatattcttgtacatgaccacaatacaatgatcgaaattagaaaagcaacaatgatttaaaaactagagatcttcaaatttcgctaataatcctaatcatgttctttacagaaaaagaaaatcccggatcatgtactgcattgttgccatgtcttttaagtctcctttactctgaataattccttaataaagggcactttgtagaatgtccttcaatttgagtttgtctaatgtttccttatgattagatttaggttatgcacttttggcaagactatcatggcatgatgttgtgtttttcttagtacaccatatcaggaggcacaagatattgatcagttctattactggttatgttaacttcaagctttggttaagatggtgtctgccaggtgtctccattgtaaagttattcattttccctttacaattaataaagatcttgtagggaagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgtgtgtgtnatatataaaataaaaaactcctctacttgtactttggcattcaatttttagaaattcagtctcaaatgccattatggtatttttcaaatgatacctttaagtcaatggtttctttcgactgcaatagagaagatatggcaagaaaaatgttgcagtaccatcttctgggagaacattcatgaaatccttcagttctagttccacagcaacaattgacaatgtttct

SEQ ID NO: 10795 - DNA, 3339 bp, Homo sapiens
tggtcttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctggacctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtaatcccagctactcaggaggctgaggcaggagaatcgcttgaacctgggaggcggaggttgcagtgagacaagatcgcaccattgccctccagcctgggcaacaagagcaaaactctgtctcagaaaaaataaaaacaaaaacaaaaacggggtatccattgctgtacttccctgatcccctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcatcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcggaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaccagcctggccaacgtggtgaaaccccatctctacgaaaaatgcaaaaattatctgggcatggtggcaggcgcctataatcccagctactcgggaggctgaggtaggagaattgcttgaacccaggagacagaggttgcagtgagccgagatcacgccattgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatggtcttgaaggatggacaggagtggcaggctattcccagggggcagatggcaccatactatcccactgtactgtaattgcacgttacacgtatgtccatgtctgctccttcccaccctacccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttggactttggccttcagatataagggaaaatctgaatttattggggcaggggaatgacatgaagaaagcaatctttcaggaagagacatctgaattttaaaaagagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcgtaactcctgggctcaagtgatcctcctgcctcaggctcctgagtaacttggattacaggcacatgccaccaggcccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagaccctgtctccaaaaaagaaaa

SEQ ID NO: 10796 - DNA, 3334 bp, Homo sapiens
ttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtaatcccagctactcaggaggctgaggcaggagaatcgcttgaacctgggaggcggaggttgcagtgagacaagatcgcaccattgccctccagcctgggcaacaagagcaaaactctgtctcagaaaaaataaaaacaaaaacaaaaacggggtatccattgctgtacttccctgatcccctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcatcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcggaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaacagcctggccaacgtggtgaaaccccatctctacgaaaaatgcaaaaattatctgggcatggtggcaggcgcctataatcccagctactcgggaggctgaggtaggagaattgcttgaaccccggagacagaggttgcagtgagccgagatcacgcccttgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatggtcttgaaggatggacaggagtggcaggctattcccagggggcagatggcaccatactatcccactgtactgtaattgcacgttacacgtatgtccatgtctgctccttcccaccctacccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttggactttggccttcagatataagggaaaatctgaatttattggggcaggggaatgacatgaagaaagcaatctttcaggaagagacatctgaattttaaaaagagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcgtaactcctgggctcaagtgatcctcctgcctcaggctcctgagtaacttggattacaggcacatgccaccagccccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagacccttgttcccaaaaaaaaaa

SEQ ID NO: 10797 - DNA, 3292 bp, Homo sapiens
tcctgtgcaccataactccccagcagtagtctccagtgggaatttgggagggcaggacagaagccaaatccaggccctgagcaaacagaacgctagatagatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtaatcccagctactcaggaggctgaggcaggagaatcgcttgaacctgggaggcggaggttgcagtgagacaagatcgcaccattgccctccagcctgggcaacaagagcaaaactctgtctcagaaaaaataaaaacaaaaacaaaaacggggtatccattgctgtacttccctgatcccctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcgtcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcagaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaccagcctggccaacgtggtgaaaccccatctctacgaaaaatgcaaaaattatctgggcatggtggcaggcgcctataatcccagctactcgggaggctgaggtaggagaattgcttgaacccaggagacagaggttgcagtgagccgagatcacgccattgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatggtcttgaaggatggacaggagtggcaggctattcccagggggcagatggcaccatactatcccactgtactgtaattgcacgttacacgtatgtccatgtctgctccttcccaccctacccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttggactttggccttcagatataagggaaaatctgaatttattggggcaggggaatgccatgaagaaagcaatctttcaggaagagacatctgaattttaaaaagagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcataactcctgggctcaagtgatcctcctgcctcaggctcctgagtaacttggattacaggcacatgccaccaggcccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagac

SEQ ID NO: 10798 - DNA, 3339 bp, Homo sapiens
tggtcttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtaatcccagctactcaggaggctgaggcaggagaatcgcttgaacctgggaggcggaggttgcagtgagacaagatcgcaccattgccctccagcctgggcaacaagagcaaaactctgtctcagaaaaaataaaaacaaaaacaaaaacggggtatccattgctgtacttccctgatcccctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcgtcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcagaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaccagcctggccaacgtggtgaaaccccatctctacgaaaaatgcaaaaattatctgggcatggtggcaggcgcctataatcccagctactcgggaggctgaggtaggagaattgcttgaacccaggagacagaggttgcagtgagccgagatcacgccattgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatggtcttgaaggatggacaggagtggcaggctattcccagggggcagatggcaccatactatcccactgtactgtaattgcacgttacacgtatgtccatgtctgctccttcccaccctacccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttggactttggccttcagatataagggaaaatctgaatttattggggcaggggaatgccatgaagaaagcaatctttcaggaagagacatctgaattttaaaaagagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcataactcctgggctcaagtgatcctcctgcctcaggctcctgagtaacttggattacaggcacatgccaccaggcccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagaccctgtctccaaaaaagaaaa

SEQ ID NO: 10799 - DNA, 423 bp, Homo sapiens
ggctttgacagccgccgccacaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggc

SEQ ID NO: 10800 - DNA, 1482 bp, Homo sapiens
ttgtttatttcaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaac

SEQ ID NO: 10801 - DNA, 305 bp, Homo sapiens
aggtcgggcacggtggctcacgcttgtaattccagcactttgggaggccgaggcgggcggatcacgaggtcaggagatcgtgaccatcctggctaacacggtgaaaccccgtctctactaaaaatacaaaaaaattagccgggcctggtggcgggcgcctgtagtcccagctactcgggaggctgaggcgggagaatggcgtaaacccgggaggcagagcttgcagtgagccgacattgcaccgctgcactccggcctgggtgacagagcgagactccgtctcaaaaaaaaaaaaaaaaaaagtg

SEQ ID NO: 10802 - DNA, 22058 bp, Homo sapiens
ggacacggaactccctgggtaggagtttgaagctttcttaactcagaaagaaacttccaacacagtttcccaaagaaaaatgggcaccaagggcaaagtaagcaagtaagctgtatctttgttcagtttgtgcttttctgtgtccttgtatgtttggctaaaaggagcttccttcaggaactcaggaagcagtgacttacagttgatcaaaaggatatgagtgacccctatgccaggaatttattctagggaaattaactgtggattgccaaaatgtttattagaagggtgttcagttaatattaatattatttaaatggccaaaagaagagagatttaagtaactgtgctgtaaccataaaatataatatgcatatgttacaaataatgttgcaggagaatatgggaaaatgttcacagtatattaatagtagaaaaagtatattacaaaatactatggacaatgtatcttatttggggatactcgaagaatctgcatcaaaagcataaagtgggtgatgagcttacagatgaatcttattctattttttgtctttaaaaacttgataggccttggcattttgaaacttcctgttaattaatatatacttcatttgaaacaaaataaataatattcaaaaacataattcaaaattatgtaactattgaaaaatatacattaatgtggtcaaagactttgggaaaagtataccaaatgtaagcatagtagtgttagaacagaagattataggtttgtttctttctactttctttcaatgttgcttatatttgaaattaaaaatataatttgaggctagaaaaaattggggttatagaatcctaaatatttaatttctgttcattcatctttacccaaattcttacaattagatgaaatttttatttaatttatatcctacagataaatttaataatgatgtaagcctcatttctcagacttttaatgaattctctggggatattgttcaaatgcagattttgatttagtggatttgaggcagggctttcatctctaacaaattcccaagtgatgtgaataaatgcttgtccgaggaccacacttcgagttgcagagatgtaaaacacatctattctccagcaattatctgactcaggtaattcagaggtgatttcaaacagttcactcaatagatttttataggccatctaccttattcaaactccataaatctattctctctgttatagagggaaaaacttgagacattatatcaaggtaaactttaatacacctgtttttttttcaagaaataaaaaatgtaatgactataatgtagaatttaacttcttatttttctttaagatcccttgtctttaaaataatatctataagatccagctacaaactctttaactctttgtcatgaaattacagtatcaatatattctaattttttctcatgatctcctctctcctacccccaaccctgtcaaaatctctatctctatctccctcttccttttctttctctctttcaggttattaaatgcaaagcagccatcgcctgggaagcaggcaagcccctttgcattgaagaggttgaagtagctccccccaaggctcatgaagttcgcattcaggtaagtggagactttccttgggtgggaacagacagggccccaagtggagacctggcttctgtcaggtcaatcctctgtgctatgattcagaggccttggagtttctagtacagggaagctgtatttttagattcagtcaaaaacaggcattatcccaaaaaggaataaatcatccattattttagtaattttcaaataatgggcttaaaatttaattgatcttaacattaatcatttaccctaagaatcagacaaaggaattcactttggatttgaattagttaggttttctttttgctttccaattgctaattatttgaaagtgttattaaaaggaagatagacaatttgatcgaaaacaagacagaagaaaaaacctgacgtgctgccctaggcagccgaagggtcctgggtatccagaggaagggacaggagtaggtcacagggagaagagagtgcatggaatggagtgagatcactgatggcaagtttggacaatttccccatttttcccaagctgaccaggcttatattttccttgaggacccccacattaagagtctgtacatgagagtgaatgggacattctcactgacagaaccttaaagaagaatataggtatacattggtaattaattcagacaatccttgatttgatattgttctctcaactgtaaaaggtgtattacctcaacttcatttcaataagccctattacctttgattttttcctctcctggaggcaataattgccaatcctatctcttttatgattttctgacaacagcaaaaggtagaaaacaaagatgcattataagaggaaaataatctaacccagtatatttttattggttcttttttcaaaaggtgattcttttattgagttctagaagtcttataaagttttaaaatgatatcaagcctaatcttatatgtaacatccagcccaataatatagttgcagaaacacaattaaagtctgtgattgccttgtagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtattttattttattcagaaaaaatggaaatgtcacaatatttcagagataattattgatagagtcctggcttggcatgctataattgatctctatttacaaaaggggaccatcttttccaaagtaaaacgagagacacaatttatcacagtctagcaataggacagaatatttgaaatcagaattgtctaataaaatctaggaaatgtggtcactttatttacacatagcactgagaaactgtcccatgaagcaaagttatgaggttagctctaactgaaacttccatgtttaacaaatgacaccttataaaagaacaagatcatgtcctttgcagaaatatggatgaagctgtcagccattatccttagcaaactattgtaggaacagaaaaccaaatactgaatgttcttacttataagtaggagctaaataatgagaacacatggacacaaatggggcaatgacaggcacactgggtcctacttaaggatgaaggatggagggaggagaggctcagaaaaataactatcgggtactatgtttagtacctgggtgacaaaattatctgtacaccaaacttccgtgacacaagtttacttatatagcaaacctgcacatgtacccttaaatctaaaattaaaggtgttgtttttccttttttttttttttttgagatggagccttgctctgtcacccaggctggagtgtagtggcacgatctcagctcactgcaacctccgcctcctgggttcaagcaattatcctgcttcagcctcccgagtagctgggattacaggcatgtgccaccacacccggctaattttgtattttcagtagagacgggttttcaccatgttggctaggctggtctcgaactactgacctcaggtgatccacccacctcggcctcccaaagtgctgggattacaggcatgagccaccttgcccagacttttttttttgttcgaaacagagtctcactctgtgccaggctggagtgctgtggcacgatcttggctcactgcaacctgcacctcccaagttcacacaaatcttgtgcctcagcctccagagtagctgggattacaggcatgagccatcacatctggctaatttttgtatttttagtagagacagggtttcaccatgttggccaggctgctcttgaactcccaacctcaggtgatctgcctacctcagcctcccaaagcactgggattacagatgtgagccactgcacctggtgtaaaataaaaggtttttaaatgacatgttataataacttctatataaaaaagcaaactattttaatattaacagcaaactatgtaaagaatgaggacttagaggtagctttagtgagaaatattatatatatgtcaacgttagctgaagtgtttttttggaagtttgtaagataaagataatacctaaatgaagcaccccaatagctgaaattatttactccacattttacaacagatcctccagatactggaatatgggctatgtaatcctcatttggcaggccagatgaaccgtgccactcttttctcttttaatgagaatgctccaaagttagaggtatattagtatctttccattccaaaaaagattgtacaaacaaattgcttcccaaaattttgtgtcaatgaaggagtctggccaatataatccctttagccccagctctgccacttactggctatgtgatcttggccagttatgtcacttttctgtgattcagctcagatttctgttttctatagtgtgaataaaaatagggctcgtctcaaagagttgctctgagaattaagttctgaaataatacatgtaagtagttataatggtgcgtggtatgtattaaatgttgaatgaatgtgaattatcatcattagacctcaggcatcgaagcacagaagtcactattaaattggaatttattaaaaagtggaaaaatgtggaatttgaaagtgaatctaaaggtgaaacatagcaatgatataaagtttatacctagcctataattgtttacctctcctattatctaaggatgttatgtttcgtacatggtgtttggaaatgtaataaacaatagtcatgatgcagagagtcacaatgacagcaaagtcccagagttctgtatctgatgatatcaacatagatttgttgctggactgcctagcagagtaattttttaaaaaatacaatatatgcaatacgttggggaatctgcagtcttgtaaggtaatgaaatactgtagccacctatactttccactgaatataaaatgtatactataaagaaaaggtgttttccactgatttatctggtagaagctataagtaacaccttaggcaccatccaacatatggcctttctttctaggtgacaaagtaattccactttatgcacctctatgtagaaaatgcaagttttgtctgagtccactcacaaatttgtgtgggaaaatcaggtaagcactctacactgttagtattagtataaatttgaatgaatattttggaaagcatattgacattacctaaatggccttgaagaggtgcaaaccttccacccactaattctaatcctaggtgtgtacaagatactattgcaagtgcacacaaagaaacatgtgctggaatgttctttgtaacactgtttattagagtaagcaatttaaaacagcacaaatgtccatcagaaagagaatgaattttaaaactgctatgtagtagcacaatggactactacacaacaataaaaatggctaaacttgagctgcatgtattaacataaaataatctcacacacataatgttaagggaaataagcaaattgctgaaggaatatttagtaaagtgtcatatacaaaaacaatactatactttcttatggttatttgtatatgtagtaaaagcataaacaaatcactgaaataataaatgccaaattcagaataatagctacttctacagggatgagagagggatacaataaggcacagtaaagtaatttactccaaggcaacatagttataagtcttagagccaggtttttaaccccggcagtatggctctggagtctaaaatcttaatcatcttgtttttgctttactagactacagaaggatcctttcatccttaacactaattgaaagcagttatttaagaagctaaaattgtactactcttacatctattactgtgcctcaattttttcatctataaaatgaggagcaaaataatgcctgcttcatagacttgttctagatattcaaagaactaattttttttgcaaagctttaatgaaataatggatttaggcaataccaataaattctttctaataaatgttataaaaagagataatcagatattccaaatgaaatatacgataccacctataaagtattaccacaaaaatataaaatctgaatcagatcaagtgtttagatcaaaaatactaatttatgaggggatgcagggatagagaaatatgttcaaccagattacaggaatgttatgagcaaaattcagaatgagaaaaactctataggacaaatgattcaatttcttcaacaaataaattgcaaggggaaaaagagagggagaagggatctataatttaagataattaagagacaacaaaaatgtggacctaaagtaatcctttagagatatatggtaatgtttttacagatgaaatcgtgatatctgggatttgcttcaaaatattccaatgtgggggagggagcagatattgtggaggaataatagatgaaacctgactggccatgaattgatggttactggagctgggacatggacacataagggttcattatgctattccttctacttttatacatgttcaaattttccacaacaaaaatgttttaagagttaatacatgtaaagcccttaaaagcatttctggtacacaaaagcattcaatgaaagtttgttccctggccgggtgcggtgggtcatgcctgtaatcccagcacattgggaggccaaagctggcagatcacctgaggtcaggagttcgagaccagcctgaccaacacggagaaaccccgtctctactaaaaatacaaaattagggccaggcgaggtggctcacacctataatcccagcactttgggaggctgaggcgggtggatagcgaagtcaggagttcgagaccagcctggccaacacgatgaaagctcatctctactaaaaatacaaaaattagccgggcctggtggtgcgtgcctgtagtcccagctactcgggaggctgaggcaggagagttccttgaacccaggaggcggaggttgcattgagctgagatcgcgccactgcactccagcctgggcgacagagcaagactccgtctcaaaaaaaaaataataataataatacaaaattagccaggcgtagtggtgcatgcctataatcccagctactcgggaggctgaggcaggaaaatcgcttgaactcggaaggcggaggttgcggtgaacggagattgtgccactgcagtccagcctaggcaacaagagcaaaaactccgtctaaaaaaaaaaaaattgttccctgcactccagcctgagtgacgaaatgacaccctgtcactttttaaaaaattgttgctgttattttttaaatttgctgttattcaacaaactatattttgtgaaaagtcttgttgtttccctaatttttctgtcttgtaaattgtcatcaaaaatatataatgctcaacatattttgtaggaaaatgatcagtgttccatttattataacttctctttatttgtatcactcttttttttaattttctagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtaaatggttaaacaccagtttgtgtaaaacagaagttactaggaggcagtgtgatacagatgaactagagttagttatcttcaaactgtggctgtgtcatttattacctctgtgattttaagcaagttatttaatccctctagaataatatctactacaaatacttatgaggataattgaataatattatatatgtaaaacatctggcccagtagcctacatataattgacccagcatatgttcttatactatactaacatattaggttatagatcttccctgatttaaatacagcctgtttaaatatgtctcctaaggatgaatgctcatcctaggacagctgactcagtcaaagggcaacaaaaatgacagaaactcacttccatcttcacacaaccacccctgtcttctccctgttgctacagatttatctccctccatcagtagtaattcatttctgctactcatcatgtccctttgtggcttcaaaggagggtctctggtagcagccgtaatgttgaccagatgtgtccctggaatcccatgttagaatttagaaactcttacaaagcatctgatctagaactagagagacatcaaagagggatctcacaattggacatctcaacctgcttatctgaacctccctgacatcgatctttattcctgactcaaaaccgcaaaatgcagccagagtggtctttcaaacaacaagtctgaagattttatttttcctgcattatttcatttttccctcagggtgagctcaaattcctcagtaggctacagtgacttcctacttctccctttccactgtgcactcactgttcccttggctccactctgagtctccaggcttcagtcactgtggtctctgggctttccacacttggcttccagcaacaatgcagagaagactgccctacctccttcaggctgactccacttatcacttcctctcagagatctacttcaggctctcagccatgctttgggtatccctcccagttttcaccccaaatttttttcttttttgagacagggtctcactctgttgcccatgctaaaatgcagtggcatgatcattgcttactgcagccttgacctcctgggctcaagtgaacttcccacttcagccctccaagtagctgggattacaggcatgcaccacgatgcctggctatttttttaattttttatagagacagggtctccctatgtcgcccaggctggtcttgaactcctaggctcaagcagtcctcccacttcgacctcccaaagtgctaggattacaggcatcagccaccaccagcctctgtcttcattcttatcacactatagagaaatctcccatttatttttttgtcctattgtactatttgttccttgagggcaagaactctctgttgttcattgtgatagctccagagcctggaattgtccctggcacataacaggagcttgataatttttcaacgaatgaataaataaaaccaggtgcataaaacatcctggtgaggcctggtcctcggctttgtaatccagaaagtccttcttatcaggttacctagagttgttcagtgtcaaggaaacaaagtcagcctcaccacaataagaggttgatctagtagccaagataccaaagtatgactcttcattgagaattttatctgccacatagacaaaaatgctaccctttgctatcaacatgttatctccctttaaaaatgtatttacgcacacaattactcattaataaaaaatttaaaaaattgtgttagaaaccaaactacaatcagagaagggtactagtagctgggtggagttgacagcagatgtgcacatggcagtcaaagcctattttctgctgtatggcgctagagacttagggaagaagtatcactcttcaagtcttcctttgctgggctccatgcagtccatcctcttctactactccagtccttttaagggccatcagcactagaggttcagctacagctttcttttttaattacttatttatttttaattgaaaaaaatttatacatttatgaagtgcaattaacgttttgatatatatatacactgtagaataattaaatcaagctaataatgtatccatcacttcatatacttatctttttgtggagagaacattaaaaatctactatcttagcaattttcagatatacaatacattattattaattatagtcaccagagcgtacaatgaaattccagaaattattcctccactctatccgaaattttgtaacctttgaccaacatcctcctattcgtcatttatccccccagactctggtaaccaccatcctagtctctgcttctgtgagcttgtcttttccacatataagtgagatcatgcagtatctgtctttctgtgcctggcttatttcacctgacataatgtcctccaggtttatccatgttttcaccataacaggattttcatttttttaaaagcataattagtactccattgtgtatatacatatcatatttttcttatctattcatctatttgtggagcaaaagccagaggtgtgcatacctaatattattgataaataaggaaaacattgcagtttacctgttgcttagtaattttgtttccaatttagaatgtattaaacttaccttgagcagattttctgttttccttttgtttaaggattggttccacattttggctattgtgaataatgcttcattgaacatgggtatgcacatctcatttcctttggttgtatatacagaagtggaattgtacagctttcttttaaatccagtcaaagtcgacctaaatttccaggagttgttcttcccactgttaaggaagagattctagctgctaagccacctcatgagatcctcagagagaaatgaatctgataggaagaaattaaggaaagtgaagtatcagtaattctgcccaaaaggcaagagctttagtaaaatttaacttacttctgggaagaaaagtgaagcaacttctctgtataattattgagaacacaccaacatcaccagaacccctctttctttttgatgtgcttgtatcctttactgccaattaaacaacattacacagagacctttggaagtgtggaaatgtcctctaacagtggtacttgcagatagataatcatctactgtgtgtagactcacttgcaaattgtgggggcaatttatagtgaccccacctaagttctgcaaacaaaggcacttttacacacaggggtccagttgtataatacaagtaatgcagcatattatatttatacactgttgtgagctagcctgagaatccaactactagttacattgctgcaatgggaaaaatgcatttccacttcctaagagactcacaggctccttttaactgagactctggagcaatatattaagaatcatactgaacacatgccacaacattatagtaaagaagccatcataagaacaatattcttactatttgcaatatatatacatatttattatttcctctgagtagcaaaagccagaggtgtgtatacctaatattatagtaaataaggaaaatattgcagtttacctgttgcttagtaattttgtttccaatttagaatgtattaatacttaccttgagcagattttctcttttccttttgtttatgttttaatcctaacagctttgcatcctcattaggaaatattaagtatttctctatgtagtatttttctatcgctataatagtctgtagaataacatattccagttacagcatcttttcttaccatcttatctattatttccatttaatgcaatgaaacaaatatttattaaagactcaatatacagaagactctttcataataatatggaatttaaaaagtttctgccttcataaaatttacggtcttttaaagaaacacaccatacacccacaatcaaggcaggttataaattatataataaaagaaaagcaaaaagacaggcattgatttctgattgaaaaatcaagaaaagtttcatagacagaatgtcttggaagtcaggcctaggagtataggttatactttaattaaagaaaataaggttaaaagtacatcagtctgagggagcagcgtcaactacggcatgagaagaaagtgcaacaatctgttcgcagttcttgtactgggaatatcatggggatgaagctggaaggtaaacagaggtcagacaataaaaatgctttcatgccatgcaaaacaaattggacttcattccaaactggtgatttggagtgatcaagtaaatcactgtaatattaatacaaccaaatgaggactattcgaaatatagatgtcaaattaatagtgatccaattttaaaaggaaagcaataaacccttcagaatgtgtgggttttcaaattttgttcagataacactgaagggaaaaagtaaaacaagggaattatttttacttgggtttgtttcttataatcttaatgaacactaaataattctccaaatttaagtagtaatgcatccattttcgcattggcagatttcctccattggctatatcatagagtttaatagcaggctgtctttaattcatatgttcatgcccccacttcctcctgactcttaaaagaaaaaaagtgggactggctgctttagaagttactttataattttcctgcttgcaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatggtatgtatattttgttcttggatcatattttcaatgtattctttggctgtcaaataataggggaaagtggattatgtttattatggtacttagtactttcaaatggatgacagggtggtagaactataagccacaaatcatttcccattccctcagctatactccatttccttcaatgcccatgaatgtgtccccccaaatgccagtactatcttggtgagttcagtcttctcttgtgataagaagccataccagcattatttgtagatgctgatttttcttttgagatccctttaaaaagctcaatattatttgtctggagataatattttctaattttgttttctatgataattccaattcctattccttggagacaattttaggggttttttcatttttaattagagaaatgttccttttgactattaaatcaaataaaatgacaagtgcattaactagacagcattctttagccaaagatataaagggatgaattaactgcaatgcataaataggaataaacacctattttgtttagctatcttatgcattatatacattattaatattaacatttgttaatgtagaatcttttctttaacagtatataatatttaaaattaataaacaatatgtgcatgtgttgttatatttaatattaacatattctcaacactagctatatgttagaatttcctgaggggtttttcgttgttttgttgcttttttaataccaatgaatgggccaaacccaggatattcttgtgtgctgggagcccactgacaacattttaaaaattaatttctcaagttgagaaccactgacctaaaagttagcatcttctattattaagctgacttattataccatgaaagtcattttcaattatggaacagaattatattagagaatccaaatggaaagagaaagatttatttaatcaccaaaagatgagttacctactctcccaccaaaagtttctatagctaggaaaagcttctatagaaagtttctaggttccaatgacctctaaccctctaaaccaagggtcaacaccctgtagcttaccagcacaaggattgtttactaacacctgctaaggacccttttaaggagctgaatgtagtgatactggagtctatgacctgactggaagctgtagaaagattttataaccttgcagtgattaattttttagagctttgataacccccagcaataagtcagagacttaatttagaatttaattttgaaagtgtttgtcaaaaatgttaaaggcctcaaaacatttgattaaaacagaaccacaggtcattgtaaaacaatagttacttatttagccaaataaatcatcaaaagactttaaaggcaatacatgaggatgtatggatgtaaaaaccttaacactatttttttaagcaattaaaaacctaatgtagacaacatgggaattattttgataaaatgtaaaatgttgtttcttaagtcagttaccagaaatggaaagaaaaactggtagtgtgactgcttctccttatgggaagcccatttcaataaacctgatgggaaaagtgcttgaatttaatcagacatgggaaaagtgtgttcaggattatgagtacagcaggggaatacataattcttagtaactgcatgagaaattttctggttacattgaaaaatttaaacatatcaagaaaagccaagagtacagaatcaagttgtactggaggaaaacattcactcctagacctttaagataaaacattttagtatcaggccataagaatagttagaactggaggaaaaaaacttataatagctgatgaaaaagctaaagaaaagagttatctctgtccaaggggagacaaagctgaaagcagggagacatagcaaaaggtgaactgacatatgattttgagaagttttcaaaagaaacaggttataaaactaaaagttaagtttcttttaattgtattaagagcaaatcaatactgtaaagagactttgttttaacataggggaataatcttagaaagactattctaaataatccttttttaatcacagcaaatttaatcacatacaaaatttttttataaattcctcttcatgaaacttattatgacttacacagatgatctatgacatgcttggacttctgacttatcctaattttttccttttaaataataagtcattttattttaggacaagattttaccataagattcttttttatatgaaattattcttttttaataacccttttattaaaaatacatttttatatttataactttacatttctctcccctacttacttttttttatctttttaagtaaataactttaaaataatttccaaattatgtaaaattattctttaataagaatacaggccaggcacagtgggtcatgcctgtaattccagcactttggaaggctgaggtgggcagactgcttgagcccaggagttcgagagcagcctgggcaacatggcaaaaacccacctctactaaaaatatgaaaattagtcaggtgtagtggcacacgcctatagtaccagctacttgggagggtaaggtgagaaaataacttaagcccaggaagttgaggctgcagtgagctatgatcacgccactccactgtagcctgggcaacagagtgagactgcctcaaaaaaaagataatacaattatatatttatatatgaattagaattcttattcctagtaaccttaaattttcatgaaaacttagaaagcaagaaatcctgaactgttagatgtaagcattttatagatgaaatcatttcacaattttagaaacatgttttcctatatcataattttttaattggaaatgactcacatatccagcatttattatttaatttaaaataattttcagattttatattacacaaaaagtccacttataagcatttatttcatttacatatactttttcatttttaatagttatctagataacttttgataactgagatattatgcagaactagccattatttaaagttatttccttgttaactttttttttgagatggagtctcactctgtcgcccggtggagtgcagtggcacgattttggctcaccgcaacctccacctcctgggctcaagcaattttccttcctcagactcctgagtagctgggactacaggcacatgctgccatgtctggctacttttttgtatttttagtagagacggggtttctccatgttggccaggctggtcttgaactcctgatctcaagtgatccacctgccttggcctcccaaagtgctgggattacaggcgtgagccaccatgcctggcccttgttaactaaagtctaaacattaggtgaaaacctaagtaagaaccataaggttaaacacataggtattttgctgataaattaggtgattcagttgctgttattgacctaacaattttaaattagtcttatttgtcaaaaaaaaaaaagtcacacaacgatagatttggctgggtttacagtctcacaacctttgtcccaaaccctgacactttaaacatttagcagaggcaaatataaaacttatttacttacacacaaatgtatgctgattttttagacatctttatttttattttactaataattttttttttttttgagacagagtctcactctgtgacccaggctgcagtgcagtggtgtggtctcggctcactgcaacctcctcctcctcccgggttcaggcagttctccagtctcagcttcccgagtagctgggactacaggcaggcacaaccacacccagctaatttttgtatttttagtagagacggggttttgccatgttggccaggctggtctcgaactcctggcctcaagtgatccacccaccttggccacccaaagttctaggattacaggaatgagtcacctgcacccggactgtgctgaacattctatttgtaatggaacactgggccctcaaggctcaatctacaatgatactatgatgtcattagcttgaatcccattatcttacatgcagagttggattaatttttttctaaagcattgtacattgccacactggagttcatattctacttttccactgactcaagtattcttttatgctccatcacagaaagcagccctggactgtacaaccgcaggctggggatcatgtactttcattggagtagctgctggtagcaaaggattgactatttttccagaggagctaataatcggccgtactataaatggaacattctttggtggtcagttttttttttcttcatagctttaaattcttttcctagtagttctgaaattcttagagtgaaggttattgaaaagaaataaaaataatttattcaaccattgaatccctagagcatatccaaatactacataaaaactattaatgacttataaataatttatataaaaaggtaattataatttgcaaattgaaatttaatttgcatttgaatgaaccaacatggaggaacaaaaaataaacattgaccttattgagataatttcttatatagagtggaaaataatcttaaatttttcttataaagaaaaattttaaaatagatataagtacagaaaattaaagatggaaggagtttaatctatttgaagcaaaccaaatctgacctaataatttcattcattcagcaaatgctgattaaactacttcgtgtcaagtgccatgtctttattttgcattttgtccacattacaggttggaaaagtgtagattctatcccaaagctggtcactgactataagaataagaaattcaatctggatgcactggtgacccataccctgccttttgacaaaatcagtgaggcatttgacctaatgaaccaaggaaaaaggtacattactaatagatgactgaatgatttaaaaaacgtttacaatgattctatcttctttttgatgttaagaagcaaccagcttgttttttctgacattttccacatcccaggtactagatgtgcttaaaagattaaatagtggtcatttcagaggggaaaaccttccatttcaataatgcacatctgtacactgttacaatatagaatggtggcataaattgatacaatttccatttcacaaaccattaactcagttgggcctgctccctagaaagagaggtttctgtgtagtatgttagatccctctagtagagtgtacccctgagtttagcaccgtggtgttctgcagtttgacacagagtgcctaccccagacccttcacaatcagaatggggtgaaaaccatgcctctgtggcagggatcagacatgtaaaggatgccccaactgtctcattctcttgctttgtcatggagttcctctaagataccttctgatccactattttagttatacagtgctcccatgtcagggatcccaggaactgatgcatagaaatgttccacctggaagattcttaggggttgggggattagtaagactaggatcaatgattctaggtaaaatgttcaagcacagccttgatcaatagaaacaaaggtcaaaaacattaggaacaatgttacatagaggagacgcaggaccaagaagaaatgaaaagagaagatacaacaaaagagaggaggaaaagtctaaagtaaaattaaaataactgggatttgaagcagggaataaatgttgcagaagaagaagatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaagttgaagtggggtttgagcctcacacccttctattcatatcctcgaacacaaaccttttctcctagaattctcaattatggaatacatccataaggaatgctaagtggcagccaggtggaaaatgctgcattgctttatgggcaagtctcccacattctcccaggaggcttccctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggccctcctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgttggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgttattaacagcgtccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttcccacaataaaaagatttttactggaaaaaaatcactgtatttcacatacatgtgtacatatatacattatatatatatatacacactatatatatgaaatatatagtaattgtgattatgtgtgtatatatatattaatatatacacacatatatacataaaacattattatatactttgtgttccaataagccacaagctactttttaaaaataagttgctaaataattttctttttaacatctgctaatttcttttctcttagccccactctatcatattaactgcaatcacatggaaggagatatcagaatctatttaagtgaatattttaaaaagaataaaagcatatctactctctcaagtttctatctctgtaaaataactgccctttcatctttgataattttttttcttcaacttttaagttctggggtacgtgtgcaggatgtgcaggtttgttacataggtaaatgtgtgccatggtggtttcctgcagagatcaacccatcatttaggtatgaagcccagcatccattagctattcttcctgatgctctccctcccgccacccccctcaacaggacctagtgtgttgtttcccaccatgtgtccatggattctcattgttcagctcccattataaatgggaacacacagtatttgtttttctgttcctgcattagtttgctgaggataagggcttacagctccatccatgtccctgcaaaggacatgatctcattccttttcatggctgcatagtataccatagcatatatgtgccacattttctttatcctatctatcattgatgggcatttggtttgattccatgtctttgctattgtgaatggtgctgcaatgaacatacatgttcatgtatctttataatagaataatttatattcctttggagatatacttggtaatgggattgctgggtcaaatggtatttttgcctctagatctttgaggaatcaccaccctgtcttccacaatggttgaactaataatttacattcccaccaacagtgtaaaagcattcctttttctctgcaacctcaccagcatctgttgttccttgactttttaataatcaccattctgactggcataagatggtatctcattgtggtttgggtttgcatttctctaatgatcagtgatctttcctaatttttacaacacataatgttgagcttaatgatctgcaattggcactaattaatactattgatctgtaactggcactaattaatgctattttcaatagtcaatt

SEQ ID NO: 10803 - DNA, 1844 bp, Homo sapiens
ttccctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggccctcctaccacccaactgcaaagaagcaaggaagtggggggatggggatgggatacaatgactgactagcctgttgaggtgtagtgatcctgccccagagtgaggaaaggacacagagattctccttctacaggtaggggtgtcttccagtcctgggtgaagaaaacatttatgcatagcaccctgctcatagcaggggttccacagttccagcagtaatgtttgagataaagactgctctgtccttgaggcttatccccctctttgtgtctacatgttggagttacccagaaataagaacatctgggttcttaaaaagtagcatcccaacacaccaactttgatgcccactccctccttcaatgctcaactttgccctcagctataggagatccgagaacagtgactattccaagactaaaacctgactccctccttggtacattctaattctcctcaacagcaccactgagtaacaaggacgctgcctaaggtgagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattatacttattaatgttttattgttattaacagcgtccgaacaatcctcatcttttgaagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaaccagattgggcctatgtttataatttttttagaatgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggagatggacaccccatattacatgatgtgattattacacattgcatgcctatatcaaaacatctcatgtaccccataaatatatacacctaatacccacaaaacttaaaatataaaatgttttaaataaaaataaagaaaagatttcccaca

SEQ ID NO: 10804 - DNA, 707 bp, Homo sapiens
cctcaacaggccctagtgtgttgtttcccaccatgtgtccatggattctcattgttcagctcccattataaatgggaacacacagtatttgtttttctgttcctgcattagtttgctgaggataagggcttacagctccatccatgtccctgcaaaggacatgatctcattccttttcatggctgcatagtataccatagcatatatgtgccacattttctttatcctatctatcattgatgggcatttggtttgattccatgtctttgctattgtgaatggtgctgcaatgaacatacatgttcatgtatctttataatagaataatttatattcctttggagatatacttggtaatgggattgctgggtcaaatggtatttttgcctctagatctttgaggaatcaccaccctgtcttccacaatggttgaactaataatttacattcccatcaacagtgtaaaagcattcctttttctctgcaacctcaccagcatctgttgttccttgactttttaataatcaccattctgactggcataagatggtatctcattgtggtttgggtttgcatttctctaatgatcagtgatctttcataatttttacaacacataatgttgagcttaatgatctgcaattggcactaattaatactattgatctgtaactggcactaattaatgctattttcaatagtcaatt

SEQ ID NO: 10805 - DNA, 3326 bp, Homo sapiens
ctgttttgggttccccagctacagtcggaaagacatcagagtgttcaaggcggagtccaggcctgagatctcagcaggccagacaggcagcagatgcttgttgcttttcttgtgttatatttttcgttcccttacttagcatttgtgggaccaaagccaacaaacaacaggttgttaaaagaatgagagtaatttgacttccgacagtgattggggctcggggttgttgggtgttttgttttctgatttgaaactagctgtatggtaaccactaactctcgccttattcttttcttgcagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccacaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttacaaggctgggtgaaataaacagcttcccagaaaacctccttctgacttaaaactcttttatgttgtacagaattccctgtcttgataaagaccacctagaagcagcccccagcgagggttcttgaaagtcatggggtcgagattgttgttggctgaacatcttttaattctgagttaccaacacgttgtgcgtgcattgatgacccggcttcctggcctgcccttggtgcctgagccccagtaatgattgccctctatgttgggagaagaagggagaaagtagtacaagtagtgaagaaaaaaatgtaggtggtgttggtggttgagagtacatggcacagaaaataaaggagccaggattacctgtgcctttggcttctccttcccctgctgctttttcttcctttttccatgtcagtgcttgggaaccctcacaactggcaggtaacggggtcgggataaaatgtaaacctgtgggtgtcttctgctgagtcattaggatctttgtagcaggctgcggataaatatgtggatgacatggggcaactaagagccccttttgcttgccacctcccacccctgctctggatggtgtctcctcttgctagactgccgggtacagatcacgtggcaattaaggcaaatgttaataaataccatgaaacagtggtttgcatagtcttctgaatagccatggctttggttagtcagcaacaaagcctttcacccttaccctggataatcaagagttgacaacagccagaaagtactgggaatagtggcttttggccatgacatctgctcattcttcattcatgtaatgggtcaaatcagaagtaattctggagatacggtatggtaagagaagggcctaaagagtctcaagagattagaaagcatatgccattgtaaggaaggatggggagagacagtgccaagattaaatggactcagccatttgacttaatgggatgcactgcccatggtggcaccctcccctgggagttcttccttgatcttgagactttcccaaactggaatccacttagctctgccacatcggtcccagatttggtgggactctcctctggtatcagttttcaacgccacttcttgtttggagtcattcccagtgcagtcatggactctatgaacaaatacggttatttaaatgtatttgtccagtatgagaatcagaatgaactagtagaggctttacagatcagctggtctgacccattttacagatgaggaaacaggcctgagaagatggagggagttacccacaatctgaaggggttctaccatgactagacccaggtcacctgcctcccaggcctggctctttccactccgaggtgctggctcaccacagacttattctttaatggaattttggaaaggcctcactccagtgactctttggatctttcttctctaagtagatgggaagcctgtaagaagagacttggaggcaaagcaaagggaatcagcacttaaccctcacccaaagggcccaagagaatctttagtaactggaggcagagcagactggagcctctatggggcatctccccatattggagaattcagtctttgttttggaaatcttataatgtctttggagaggctttaaataattttgtttttcttagcaatgttatgctctattttgagacatggattttttttttcttctagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaa

SEQ ID NO: 10806 - DNA, 296 bp, Homo sapiens
ttaattaggagaggaaactttcatctgttgctttcaaaaagcttatacactgaagagagcacacagctgttctgtcacctcacattcacacacttccgcctcttaggtttgagctcatgttctgctttcagtcttgttgtgatgggcagagagaaagtcgttaaagtatactgtccttaccacattctcgaaacacaccatacaccctgtacttcaggcagagtcacagtgtggggccagaagcttctgtaggtaagtaggactgagagagaaagtcctggttacctaattccttt

SEQ ID NO: 10807 - DNA, 1751 bp, Homo sapiens
ttttaatggataaatttgtgtgttgattttggaggaataaactcagaatactccctaaagatagtgaattttggtctgggtaatgaaaagtaggaatataattgattggaataatgttgtcatatgttgttttaatgtttatcttaaaattagtaacttttccaaggaaaattttatttgatagcataacttctctggatattattttaaatcagtctggtaaagagaaaaaatacagaaagtattataatttgtgttttcatcataaaatattttgcatcagtatcttattgcagtacggtaggagactatgagaaatattttgaatcttaaaagtaccagataaagacacaataactaatgattttgtctttaggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattgggtaatgtgcttctctgcagcatttaaaatacatgcctgtttgtacctcagttggagatttctctattctgatttgctaaatagagaactgacaggcaccaattgcaacattagcagtgtagggaatctggggctatgacttggagccctaagaaaaatggttaaatcgtgcagcacaatatggtgaaaagagcccccagaggaaatagaaattgtaggtctggtcctactctgtcatatttatcactcattttgagcaagtcatctaactcaatgcttcatcacttattttccgaggcttggaggttatgaaactgcttcccagaatgtaaagcactgtaagagtacttaaccatgacttatcagtgcagcacccctgagatgtgagtggcagcctcttttcctcccagcctgtcttgctttcatgctgacattatattatgtcctaattttttcttcgccacttaaagtgcctttagaatttcccttctgcagcatctcccatttgtatatattgctggcaggctagttcctagactgaacatgaagacttatctggtaccccagataatccagttgttttatctagaattggtcctttaatctctctaggcttctaattttgattctataaaataatgatttggattagacaggctacatgatattattagatctaaaatttattatttctctgataagacaaagagactcaacatgtccctgaaggaaagtctaagagagactgagaggaaagaaggagagcggaaaagaaaagaaaaaacaaaacaaaatgagaaagattatactttgggatttggagggttggagagtgggagtgagggaagcagttgaggattttcctccatttccaaatatgagtgtacattcatcatttcatttatgaaccagaaagtgattttggccatggctggtgaatgttggactggtgtttatgaaacattttgttaaagaaagtaaaatcatggtttttcaaggggtctttaacatgataaagataattccactgctgtcagtgtttaaccttgtgacagtcctaaaggacctcctgagaacaaaagtatctctatctctaccctcttcatatttctgttatatttattcaattaaactggcctttaatatgaagaaaa

SEQ ID NO: 10808 - DNA, 1751 bp, Homo sapiens; identical to SEQ ID NO: 10807

SEQ ID NO: 10809 - DNA, 4828 bp, Homo sapiens
gacttggcattgggttgttctaaagagcctgcccgaagcctttggatcagcatgcaggactatgctgttagtaaaggtaagataaagaagataaagggagtaaatttgtagttagctcataatgctcgcaaatatatatgcaatatatgtaagtgaaaattatagggatcacccttttttttaatagaaaaagatattttattaacatttttaaacaatttgtttttccctttgtggaaaatagtgtaactattttttatatacatgtattccacttaaacctactgtgtgaaaattgagatttatataatacatttataggtaatcattttactgaagtatagtagtctccccatatccgcgggtgatgtgttccaagactcccagtagattgcttgaaaccacaggtagtaccgtaccttatatacattacgttttttcctgtgtgtacatacttgcccatggtaaagtttaatttataaattaggcatagtaagacattaacaacaacagtaataaaatagaacaattacaataatatgctaactgaatcactactcttgcattttggggccagtattaagtaaaataagggttacttgaacacaatcactgtgataccgcagcagtagatcataaaaccaagagggttactaagtgacttcgtgagatttcatcatactactcagaagggcatgcaatttaaaagttatgaattgtttatttctggaattttccatttaatatttttggaccacagttgatcgcaagtaactgaaaccatgaaaagcaagatcatggataagggagactgttatattccgtgctatgtaaatggatctattttaagagtctgtttaacgattatcttccctttgcaagccatggtttaatgactgaaaggatgtgtacttagaagtctaagctataggtgtggtcagtattcatctataaaacattttgcctactctagagtgctggtgaagattccagtttgagataagatatactattaagtaccatggtaaagtactatgcaagtttgtggtggtatttcagtttctaatattatttgagaaaattaattttataggctgggcacagtggctcacgcctgtaatctcagcactttgggaggctgaggtgggaggtatcacttgaggtcaggagtttgagaccagcctggccaacatggcaaaaccctgtctctactaaaaatacaaaaaaatattagctggtcatggaggcgtgtgcctgtaatcccagctactcgggaggctaaaggacaacaatcacttgaacccaggaggtggaggttgcagtgagtcaagattgcaccactgcattccagcctgagtgacagagtgagactctgcctcaaaaaacaagcaacaacaacaaagaaaattaattttatgtacatattttcaaaggctgtacctgatttctttttagctcctttgtttttttaacgatgatcgggattgttcagaatcacctatctctagttttctttctctgtgtcattctcttatcctgtcattagttttgtccattttttttggattttctttcttgtgtgatcaaaatggcaaaaataaatacatttttactttttattggcctttattttttataaagaaaatgaaatgagatacatattattcagatctgccaataagatgacacctttgaatgtttaatctcatcttttttttgttttttgttttttgagacagagtctcctcttatcgtccaggctggagtgcagtggcgtgatcccagctcactgcaacctccgccttccgagttcaaacgattctcctgcctcagcctcctgagtagctgggattacaggcctgcaccaccacacccagctaatttttgtatttttagtagagatggggtttatgccatgttggccatggctggtctcgaactcgtgacctcaggtgatccatccgcctcggcttcccaaagtgctgggattacaggtgtgagccacggcgcctggccccattttgtttgttaatcatttattcattcattctgttgtggtgactcctaccagaggtgaaatagtaatgaggaggaaaaaagtttactttctaagatgtattttctgatatttcatatttgtaacatttgcttgggatgtgcagttaggttttctataccacattatcacttattaccttgcagtgagaactaaaaaaaaaactagatataaggtgaataaaaacttgttgtatgggtctgtttgttgtattgcttatacactgtaagcatagactttattcctgaatagtggaaacattctttgttgtttggtatgaaatgaacataattttaatgaaggtgttttaaaggaacccattattttaaaaatggcataggagagtaatacctgctaaatttaaaacacaacaaagagtgttactttagtttgcttttaaaattgaatattaggttccttgaaatggagtcttgttggattttttagtcatagcagttctcagaatagcaagcaattccatggaatggatgatttcctaagagcctgatgaggattgtcattctaagattctctgtgggctttaagaatttcttaaaatctggcatatttgtccttgtcaattttttttactgataaagcaggataagtctgaacttaaatttctgacttaggcatactgaaatgaaaaccagcatataacatttttatctctggagatgagagttttaagaaggaattaagaaccaaaattaatttgaggctaaaaatttttcaagcgtgttttttgttggttttgttttgtttataagtagcccagatatttagcaaatctgtcaaatgaacggagactagcagtccctctgggagcagggtggacaataactctcccacccccatttgaaatctactgaatatactacattgttaaagtacaatactggtgtgccaacatagaattaaagaatgggaagaggccgagtgtggtagctcatgcctgtaactctagctacttaggaggctgaggcaggaggatcgcttgagcccaggggtttgagactgcagtgagctatgtagccaccactgcactccagcctggacagcagagtgagaccctgtctcttaaaaaaaaaaaaaaagggaagaaaaagcacctgactagtcctcatcatctaatgttgtgatttcggttttcaactacatgtcttcatttctgttttaagaaatgttgtttcatttcttacccacttaaatgtacttgtattcacagtatatacttttatggcatcaaataccagatacatgtatatttgactagtttactcactatctcctctagaatgtctaatggagagtattcaaaactagactcctgattccagctccctaccctcgaaactgttcatgtggtcttcctttctcagtaaatgccaactacattttaaatacatttagaatcacctttgacttctctcatattctcacatcacagatctgatctatcaacaaattctgtcaattctgccttcaaaatgcatgtggactctccagccacttgtcattaccttcgctgctcttacctttttctgagtcatcatcatttctcacttgaattactgcaataattacttctgctattgctgtccctataagtcagttctccactcagcagagtgagctttcaaaaatacatctcagatcatgttgtatctctgttcaaagccttctaatgctgcttctcatttttccccgagtaaaacctggaggacttgtactggcctgcaaggccgttgggatctggtccccagccagctctctgatgtcttctacccattctgtgcatgcacggtttgccccagccacactggcctccttgaacccatcccagatcctctgcactagctttttctgaggggacccattttcacaagctttttcccccacttcatttagatctctgctcaaatgtaaccttatcagaaactttcccagaccaccttatataaaatagtaatcccacatatacagtactccctgttctccttaccctgctttattttccctcatagcacttacctgtcatattaatgttttcttttaaattttatctcccaccctgctcctcctaacaataatataagctctgttagatcagggatttagttttgttcactgctatatccacagcgcttggaacagtaagtgggatctaatgaggtgcatttgttaagtaacagtttagaaagatgataaaattcaggtgttggatgactaaagctataaaaattacctctgaactgttttctgagcccttttaaatgtcaatgcatcatttttattttcagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaa

SEQ ID NO: 10810 - DNA, 2295 bp, Homo sapiens
taacaataaattcaactgattcgttaatcagttctaataactttctttcttatttttaccagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgctgacccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgctgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagcagttgggcggtgggcagggtccagaaagtcagcagtgtgcctgggcccaccccatcctctacctgccacacctcagagggttcctacagctgcacacaagcagttgagagttgatgaccaggcccacaggactccacagctggttcccaggccagtgagtgctgtgagaatacagtagcacaagtccttgttctcttgagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaactaacccagctgccttttttgcagaaattgacaagctaatcttaaaattcacatggaaatgcaaggaacccagaatagtcaaaacaatctagagaaaaaacaaagaggactcacacttcctgatttcaagattgaccacaaagctacgataatctacacagtgtggtagtggcataagaatagacacatagatcagtggaatagaggcgagagtccagaaataaaacatatatccgtggtcaattgatttttgacagtggtgccaggaccatccagtggggaaagagcagtcttttcaacaaatggttctgggacaagtgaatattccatgcaaaagaatgggtttggacttctgcctcacaccacatacaaaaaatcaactcacgatgaatcaaagacctaaatgtaagagctaaaactacaaaacctactgaaacagcttgtaggataaagagggaggagacaaaaagaaaaa

SEQ ID NO: 10811 - DNA, 11544 bp, Homo sapiens
aaccgcgcaagaaaggaggcatctgttgcccatagagattctcaaaggcaggagaaagggacgacgatgaggaaaaccttcctgagggagagatccctcctccccaagaccccagtgaagaatggttggtaacatcatggattagctcagaggaacatcctcagacttgcgctgacattttgggagtgattttgttgggttgttatcgagccatttctctttattcttcctgggtgttcttttgagacttccctttaagttaggttggattaggttattatagttgtaaaaacagtagctcaaatgaagacataattacaataattacaataattacatataattacaaatactgactgggcttctgctgtgtgcccagctctgtgccaggccgaaggaaacccagtgcctggcagacttggcttgcctggctcactaacatgaaacagtgagggcagagcgccttccttttgtacctgtgctgctgccttacccgtgttcttgttctgacatggtggagagctgtcatctaggagaaggaagccggcagaggtggcacagtgtgttttactccgcctgtgacattgtttggcactgtggtgtggactcgtgggccttggatggttccatctgcaccttttactggctgtatgatcttaatcaggttccttagtctttgaggctcaggatcttccattataaaatagagattataatgcctcattcccatggccctttgctttaacacccccccgccccccttcaagaagtaagtgttccaggctacacaagaaagtgcagcctgtggagtataagcaggcattttgtaaacttttattattgtcattttcctgaattttgcctatatgtagatgaatgatagaagaaccaaactcgtcttttccttaaagagactttgtatcaataagtagagagaccagaatgggaattctgttacaatgatttttttctacctaagatattattgtttggaaactgttcagcagtgcttgaaattgctgagagctgtactgatgctctgacaatttcctgggaacccatcctcttgcctttgggattcttcttatcctcctttcaaggctcaaatgtcctccttgtggtgggcatttgttaggaactgctcaggactctttgtagcaggcgttcatcttttgtcagcctttggccttgtgggcagtcattgatgagctgaagagagcagtcccagctactgtggatggcagagaaactgcatcttcattctactgagggtgtccatgttggtttagaaataacattctcattgggataaaacaggtatctttttacctactgtcttaaaaacttagatctaaatagtttgataccatttggaacaggtgtcagcctgcaagctataagaaaccaaaagagaagaacatgcagtctcttcttttggtgtctttcttcatcatttctttctttcttttttatttatttgtttttgaggcagggtctccacactccgtcacccaggtgggagtgcagtggcatgatcatggctcatcacagcctcgacctcctgggctgaagcaatcctcctgcctcagtttttaattttttttgtagaaacaaggtctcactatgttgcctaggctcttcttgaactcctgggcttgagcaatcctcctgcctgggcctcccaaagtgctggtattacaggcgtgagcaccacgcctggcctatcatttctaatgtctaagtgattgctccctcatctgaagtcaggtagcacttaatatacttcctgctcttcgggtattaccttttatttattactgacacatactaggcctcattatcagaaaaagattttagcaaacttttggtagtctttacgtacccagtgttgttaataagcgtttcatgggtgtgtgccttaacttccctagacccttggaagatggcatggctgttagccctcttgtattactctccttgcctggggaaagctttgtttgcctgcaggggttgctcagtgggtgattgctgattagatggagccgtggctgactactgtcttgcctcttctatttaatgagatctgtatgttttggaggccttctccagaaacagaatggtctatgattgcttttcatagcagaaatctcatctcctttgaaaggtctaatgtctttttaaaaatttttgcttattaatgcctgtgtgattacaagcaatttgctagtgatttgaagagtttggagggcaattgaaggtgtcacatgccaccatatggtgaaggaagacgctctgcaagcagttctgacacatttttttgtttttaaattaagctccagaattgtaattgcttgtaaaatccttttgatagttaaattccaggtggtagaaaatctttccgtaaagatactgtaaataattacacagaccatctggctagatggttttcttcccccatccatttggggggaaaaaaaggaagaaagaaactgcttgctgcagttggaggttttatttcttgtgataatcagcttcagtactagagtaaacactcagtttttaaatcacaactaacaattgaaatcagcattgcttgagaggaaaaaaaattgctaacaaaagcaaagccacatacctgccaaatctgaccttgaattggtctgccagctagtacttattggaccttactgtgtattcggtaccctgctaaaggctctaggaggttctctgcccataatttaaaaagtaaaatatctgttgcgtcataatacaaatgagatgtttttcatgaacatctgtccgtattttccattgtaggaagtcagaatatttcactttgccttgctatctgcctggcttagctgtctgaccactgtctagtttgagcaaagatgaggagagaggtatggtgtttggcttcctcctaattaagaagagtccaactctgaaaaatactgtgcatttcttacattaagagtttgctaatacattgggtagaattataccaattagaggaaataagagaaagaataaaaagtcagacttgaagactgtgaggaaatgagcaagttgagaatctcaggcacaaggcaaagttattaagatactgataaaatgtctggaattgtctcaactaggttaaagtaagttcgtagatgctgcagcaaaattccgtgtgggtgatttatctgtgagatcaaaggcataaatgatcaaaattattgttaacagtttctaaaactaatatttaataaggggcacaatgagcttattgtgtgtcagctttaaaaagcatattcctatcagtggtagtggtctctgaggttgggggctcttcttggtagtgaggcctatcttcccccttcactgttcacctactccctgacttaggggcttgtacatgtgtacaagtccttcttcacatctttttgctttcatttcagggtggattacgtggactctttggggcgttcccggcgctgtatgagaaaggatttgccagatctgctggagatggataaaaatcttcaggggagactgtaagtgtgtgtggtatacagagctctgccaaggtctgaaatgcagccacagggattgttttgtgaggggaggctgttttataattaatgatctctgttgctccagtaaggagatattgattgattgattgattgattgaagcactttttagtggttagcatgcacatacacacataatccacacttggggaacaacctgactggtggatgagtagagctgtctcttttacttggaaggatgtctgacaacagagtaacagaataaacccaaacgaaaccagcaaaccaggctttgtggagacaagtggtttgagaatatacacttgattatcccacaaacaagtggctctagggagagaacttactcactttttctttatgtatcattgcatttttgaagtaagggccttataactagatttttcagcagggcctaagacctaagacataactctaaaacgtaagacctaagagataactctgaaacatccaggggaataaattcctcttaccataggaacttttatgtgaaaagtgttgggagaaactccaccttgtccaagtcctgcaggttcaggcatccagcacatagcctttggcttggcataagaaagggagaatggaagctgggcgcggtggctcacgcctgtaatcccagcactttgggaggccgaggcgggcggatcacaaggttaggagttcgagatcatcctggctagcacagtaaaaccccgtctctactgaaaatacaaaaaaaaaaaaaattagccaggtgtggttgcggccgcgtgggagtcccagctactcaggaggctgaggcaggagaatggcgtgaaccaggaggcagagcctgcagtgagccaagatgacgccactgcactccagtctgggctacagagcgagactccgtctcaaaaaaaaaaaaaaaaaaaaaaagaaagaaagggagaatggaaacctttgagcctctcagggcccagccatctgcaaggacaggagacaccactcaggccacagtgctaagcagttttcatgtccccagatgagagaccatccacaggaggagacccagagttcctcctccctgcctgggccacctcccatctggtcagcccaggacctgggtggaaggaaagttttttgtcttgagtgctcaggcaagattccgtcaggctaaggtaacaagtctggtgcttgagtaagaagggtgaaggctggccgggcgcagtggctcatgcctgtaatcccagcactttgggaggccaaggcaggcggatctcctgagatcaggagttcaaaaccagcctagccaacatggtgaaaccctgtctctactaaaaatacaaaaattagccagatgtggtggtgggtgcctgtaatcccagctactcgggaggctgaggcaggagaatctctttaacctgggaagccgaggttgcagtgagccgagatcgtgccactgcactccagcctgggcgacagagcaagactagtctccaaaaaaaaaaaaggcgaaggctgttttattgattttccagcagtcttgtgggtcagaagcctctgtagttccctgttttctttatcaaatagtgttacttatgcatgatgcaactgactgtacttaaacactgatatctcaatccttatctgaagatagtttttgctctgttttcctgctagttttattagtcctgctaatgaaaaaaccctattatctgaagatatgagaaaagaacttcagcgccagcaatgggaggaagaagaaagagaggccctgaagagcccatggggcccgtacattatgaagacattcgggaaaatggtatgactattttcttgcagctttgcaaatcttatttttaaccttaaactgatggcaaacataaagggaagtattcataaagcaatagcttttacatggaaattaaagatcctgctttggaaatagaaaatatctcctttgttcacttcatagccttaaaatactcacatttgggaatatcttcctgacagagggtctggtaatccaagggattgttccctgagagaagtggagacagcccatggctgaaagcaaacgaacccttgttatgcttcccttggcaaacaggacgaaaacttggtctaacttttgtgtttctttggttttttgtttcttcgcttagctgttttctttttctttttaaaacttgtgccaaatatcactgtgtttctttttgctttggtaggaaatgtggcttgagtgtagttgaatgatcaggacagtctgatcttttgggtaattcatacttctttcagaggcccggcaacttggtgttgggtattttgcctttgcccgagacaaagagttgagaaacaagcagatgaaaaccttagagatgctgcgtgaacaggtacagataaatcccaagtgactgtgaggaaagatgtgagcgcttggtttcttgctggaccatactgcagaaaaatctagtaaattagttagaaattaaaattgatattcagaattgcataaaggtagttgccatactatttttgtgtttcaaattttataactgctcacaagtaacctgtgtaactttgatgttttaaatctggtcccaaatgtggtacttttggggtggcttggatgggaaaatagaaagttacttaaaggattaaggtgtaggacggaatgggttggtttcttgagtgttaaggcttgcaagatgctctgtgaactcttatgaaactttgtaagacatcagagggttcataggagagtacttcatagggcttcattgtgaggatctcaaggacagcttcttagaggtggcctgaagatcaattaactagtctatttttagaagaaaatttcatctttttggacaggaatattgcaaatttggcttcaagcaaataattttctgattttctgttcagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagaggtatatcatggctatgttgctgaacttcaaaagggaaaattttatttccattgatgtcttgctaatagggctggcaatgtgaaaattagccatttagttttatatttaagcaaacagtatacctttgaggtactggcaggagcaatttttataaccaaagtgatgcagaatgacattcaatatttttaggctatagatgaggatatgaagcaacaatacattgtgttgcatcttagaatggcatagtcttgtaattgagacttagtaaagagatattttaagataaagtttagctttgcatatatatgttttagacttaaattttttgctattggttattttatatatatatttaaagaaatttatattcataaagttacatagtaaaagaatttagaaatatgaatatcgacagcttgccaaagcttaccaaagaactgtgctccagaagttggtgatgtggaacttggagcacggttccccttggaaacactgttaaatgctatgtcagactagcttattgcatgagttgtggtagtacaggctaaattgccatcaatctagagactcctacatagaatggctcaaacaaaatagagatctgtttctctacttaacaacttggaggtaggtgggtgagtgggtatccagggcatgtgagtagctctgccctagatggtcatctagtcccaggcttcctccaggcttgctgtttctgccatttcctagagtatttttctcttctgcatagtcaaagcttgctcccctgctcacctgttcatgatccagcctaggggtaggcagggagactgggaaggggagccaccttcctttttagagatgtgagtgggaagttacatacagcctatgcatttacatcctgctggccagagctcagtcctgtgggccacacctcactgtaggagaagctgggaaatggcctctccagcaaggtggccacatgctcagctgcaaccggggggcattctgttacccaaaggaaaaggaggagtgtgggtatgaagggacgtatagctctccagctctcacaaagcttatgtgaagccatgggccatttcctaatgtctgaacaaaacagaccagaaacatttaggaatttgaaaaccatctgtttagtttcagataaatgctcgctctataacatgttaagctgtgcagattgtttctcaaattttgctccatctcctgaacatctgtcatgtccagaaaatgtgaagcgccaccacagtgttttttaaaaatccatttttcttttacattttaaaaatgtgaccaaaattgaacagcctacaccagaccccagctgttcatccccttggctctgcttgcttcgcctgagattgtgatgttagttgagtgatttggggatttctggtcctgcaattgccagtttggagaagcagagtggcatagtgaggggcacagagactaaaatccatccagcccagcccaggactccagcccgtatcactttctacctgtgtaccatttctgagcttaattttccccctctataaaatggggataatatggaagtattgaatttattaggattgttacaagaattaaatgacctgttgtatacaaaagacttaatccactgcctgggacatgttaggtacttcataaatactgatggttacttttactttcaggattagcatgttctgtatttttaaaaatagctttaggcttttttataacagtgtcttattcttttacaaaaaatagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaaggtaagggaggtgggctctgaggtgtaagaactctccagtgaatggaaaatggttttttttctagaagcacttggggtaagttttaacttcgtgctgccttgtgtggttttacagctttggaatgccatttctcaggacctgcctttaaagtattatgaaagtttggtgttctcatatgctctgtttttagcagcctcttttatgttcagttgaaaatggtctacatgccagtgtactaacctggattcacacatggttccattggggaatttccctggccattttttctgtaattttccagagtgtccacagcagcctctctggaaggactatggtttatgcctctttgaaaaagatcatttcagtagaacattagcccatgctgtctgagctgataagatccaaagctaaagtaagagaaatgcaagagccactgttagaaatagagatgaaataccagacaaggttggacagttcccttttgtgtcttccaaaactcaataacggacaaaatttgtattttggtatgaaatacctacaatgtcatgtcaagcagataatttgtctgtatttctctttttctgtatttccccatctagagatagtcactcccttttcttagcctggtcttttatactcgttgtaggtattacttataccttgtaatatagttttgctgttgccattcttattctttggataatttgtggtggcttttaagaaatatatgatacaattagataatagtaacaataaattcaactgattcgttaatcagttctaataactttctttcttatttttaccagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaactaacccagctgccttttttgcagaaattgacaagctaatcttaaaattcacatggaaatgcaaggaacccagaatagtcaaaacaatctagagaaaaaacaaagaggactcacacttcctgatttcaagattgaccacaaagctacgataatctacacagtgtggtagtggcataagaatagacacatagatcagtggaatagaggcgagagtccagaaataaaacatatatccgtggtcaattgatttttgacagtggtgccaggaccatccagtggggaaagagcagtcttttcaacaaatggttctgggacaagtgaatattccatgcaaaagaatgggtttggacttctgcctcacaccacatacaaaaaatcaactcacgatgaatcaaagacctaaatgtaagagctaaaactacaaaacctactgaaacagcttgtaggataaagagggaggagacaaaaagaaaaa

SEQ ID NO: 10812 - DNA, 300 bp, Homo sapiens
ctgggcacggtggctcacgcctgtaatcccagcactttgggaggccaaggcgggcggatcacgaggtcaggagatcgagaccatcctggctaacacggtgaaaccctgtctctactaaaaatacaaaaaattagccaggcgtggtggcaggtgcctgtggtcccagctactcaggaggctgaggcaggagaatggcatgaacccaggaggcggagcttgcagtaagccaagatcgcgccactgcactctagcctgggcaacaagagcaaggctgtgtctcaaaaaaaaaaaaaaaaacaa

SEQ ID NO: 10813 - DNA, 949 bp, Homo sapiens
ctgggcacggtggctcacgcctgtaatcccagcactttgggaggccaaggcgggcggatcacgaggtcaggagatcgagaccatcctggctaacacggtgaaaccctgtctctactaaaaatacaaaaaattagccaggcgtggtggcaggtgcctgtggtcccagctactcaggaggctgaggcaggagaatggcatgaacccaggaggcggagcttgcagtaagccaagatcgcgccactgcactctagcctgggcaacaagagcaaggctgtgtctcaaaaaaaaaaaaaaaaacaatgaatagacaaagaaagatggaaagaggatgtgtgtgtaacccagagcagaaggacttgaggctgactgtggagtagaaaggagaagggagacagagacaaggcaggcagcaggaagagctgtaggtgtgggagccagcatcacaaagggtccatcccaggtgaccacatccatgcctgcagcacccgggtggacggcgaagcagttatgctcgttggctcatggtcactgttatctgaagataactgtgagtcacattttctctgggatttcaaaaactaaataaacctatttataatcccctcttaacagtataatttagttcagtgttttgtgagcccttttctgtttcagatccagttctttgagtattgacacaccatcacagtcttactgtgacacgggcctgtcttgtaccagtgtatccagcagatggcattagaattcttaaatgtcagctccatactcttaaaacagcacactccaacagaaataaaaaataaatctgtggcgcatgcctgtaatcccagctacttgggaggctgaggcaggagaatcgctggagcctgggaggtggaggttgccgtgagctgagattgcgccattgcacttcagcctgggcaacgagtgaaactccgtctcaaaatta

SEQ ID NO: 10814 - DNA, 424 bp, Homo sapiens
gtagatcttaactgtactcacccctccaatacacaccatacatgcacaaaatggtaactgtgtgtggtaatggctgtgtaatctgtggtaatcacaaattaatgtatatcaaatcaccatgttgtgcatgtttaatatatgtaatttttatttgtcaattatgcctcaccaaagcttgtgggtggggggaataatgaactctgatgtaaggtatggcctctgggttatgatgtgtaaatgcaggctcatcagtcccacaaatgtcccactctgggggaatgtgagaatggagactgtgcatgtgtgggggcatggggtatatgggaactgtaacttcccttccatttttctgtgaagttaaaactgcttttttaaaagtctgtttaaaaaataaaaataaaatgaagaatgatgaccgtgctga

SEQ ID NO: 10815 - DNA, 314 bp, Homo sapiens
ctccagccattctttttttatttatttttttagacggtgtctggctctgtcgcccaggctggagtgcagtggcgcgatctcggctcactgcaagctccgcctcccgggttcacgccattctcctgcctcagcctcccgagtagctgggactacaggcgcccgccactacgcccggctaattttttgtatttttagtagagacggggtttcactgtgttagccaggatggtctccatctcctgacctcgtgatccacctgcctcggcctcccaaagtgctgggattacgggcctgagccaccgcgcccggccact

SEQ ID NO: 10816 - DNA, 1458 bp, Homo sapiens
caaacacagtttcacactgattcttaacattttgttcaacttttactcagagggcaggctgagccagggagcaaaaaggcaaaggactcctactcacatacccacttagcaaaaccaaagcaccttgggctttgaacgccacccttcttagaaggcaggtttgggggttgaggccccttgagaagctcacttcaccctctccatgccatcccattcctacccatcccaagatgcttctcttgtatttctttcagcacatccagccatctccctgggagcgtttcatatctgactctttatacttccagtgatgttttggcatccctaatagactggctcccaaggcagtctttaatcaggagtcttcccctaatctagctcctcaagaacccaagggaagaggcacaaagagaagtatgaataggaagatagaagggtaacccagtcagagagggagtggcagatgacactgctgaaaaggagtttccagagagttgcacaccatgagccacgctgtctgtccctgaccacaacctccactggccaccacctcctgggcttcccctccctccacccacagaaaccattgctcaatctcaactggactcttgcaggcctatctctccctccaaacagagatgtcctggacacagagctgcagacctctaaccactcctggaacataaaaaaacccacggtggttctacagcatttacacctccagtttccctcagacagaatccagaagagaagaacctcgctgatctctgagcggagcatgtctccaagctcaggccagccccagaactccaatggcctcaactggagtggaaatccctcaaaggcacaaacccagttcctaccatctccctcagtgcctggcaatgtttgtggttggttgagtgagttaacaggagaccatcttttggccttttttctacctctgttttctcttactatacttgcctacatctcatcttctgtcaacaccaggtactcaccccatgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaataacagactcatccacactatgaggctgtgcataaggtcatgtatgtaaaactacttgctttgttgatcattctgtcccagataagtatgaattattatgcatcatttcattaaacaagaaagcttcactgtgttaatatgcacaagtaaaagattagcatgta

SEQ ID NO: 10817 - DNA, 1460 bp, Homo sapiens
caaacacagtttcacactgattcttaacattttgttcaacttttactcagagggcaggctgagccagggagcaaaaaggcaaaggactcctactcacatacccacttagcaaaaccaaagcaccttgggctttgaacccacccttcttagaaggcaggtttgggggttgaggccccttgagaagctcacttcaccctctccccatgccatcccattcctacccatcccaagatgcttctcttgtatttctttcagcacatccagccatctccctgggagcgtttcatatctgactctttatacttccagtgatgttttggcatccctaatagactggctcccaaggcagtctttaatcaggagtcttcccctaatctagctcctcaagaacccaagggaagaggcacaaagagaagtatgaataggaagatagaagggtaacccagtcagagagggagtggcagatgacactgctgaaaaggagtttccagagagttgcacaccatgagccacgctgtctgtccctgaccacaacctccactggccaccacctcctgggcttcccctccctccacccacagaaaccattgctcaatctcaactggactcttgcaggcctatctctccctccaaacagagatgtcctggacacagagctgcagacctctaaccactcctggaacataaaaaaacccacggtggttctacagcatttacacctccagtttccctcagacagaatccagaagagaagaacctcgctgatctctgagcggagcatgtctccaagctcaggccagccccagaactccaatggcctcaactggagtggaaatccctcaaaggcacaaacccagttcctaccatctccctcagtgcctggcaatgtttgtggttggttgagtgagttaacaggagaccatcttttggccttttttctacctctgttttctcttactatacttgcctacatctcatcttctggtcaacaccaggtactcaccccatgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaataacagactcatccacactatgaggctgtgcataaggtcatgtatgtaaaactacttgctttgttgatcattctgtcccagataagtatgaattattatgcatcatttcattaaacaagaaagcttcactgtgttaatatgcacaagtaaaagattagcatgta

SEQ ID NO: 10818 - DNA, 268 bp, Homo sapiens
gttctctgcccttacaccaggtgcttcaaaacccttagtggctcctcattacttacaaatgaagtccatacactttagcaaggctttcaaggcctccacaatccgatgccagccaacttttccattcttattccactctaagcctcctccccacagcagcttgggatccaaccccaaaacaccactggccttctttcagacacatatctccccagtaccctacctctaggcatttgtcatgctgtcacctgggcctggaacatgttct

SEQ ID NO: 10819 - DNA, 268 bp, Homo sapiens; identical to SEQ ID NO: 10818

SEQ ID NO: 10820 - DNA, 888 bp, Homo sapiens
aggaagctttgataacataaattgcttgcctgccatttaacaatttttgaaatgaattattgtctgaatagtttcaatatatgttttattttatgaatttaacaaaattcttttttcttgatttagctaattttaatagagtgttttcttatcaaacatttacttatcttctaaaactccattcttgcaaactgtttggagggatttgtttttatttttattttgtagtatagctcatgtatctagaataacttgttatgtttgttatttcatcatcataaattggcttatatttcatatgcttgcagacatatagaataatcgaaaacaacaaaattatatgtatatacatatgcatacacacatatgtaaaatgtgaatgttttttatgttttgccttttattacacgttctgccttttattacatgttttgccttttattaaatctcactttgctcttcctcattcttttcggggagacatactttttcttttaaattctactactggctccttacaaaattaactatcctttaaagtttatttattaaatttatagagtcaagtttgaaaaattgttttatttcatcctttatgcaacaaggtatttattatacttttatttttcatcatctgtgaatatttagagccaaatttttatggtctttgtggttttattcttgctatattatctctgtctggaatatttatttatgtatatatttattaaataagatttacataaaaggttgagccatttattttagaattaattcaaagctctttggatgtaattttattctaaggctttgttattcttaagttcttaattttaattcctatcactgtgatttagaataaagtgatatttcttcaataattgaaaa

SEQ ID NO: 10821 - DNA, 2015 bp, Homo sapiens
tgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgctagtaatgaacgatgacttagttcggatatttcagaactttttgtttataccatcaggtatgcatgaatttataatctgaaagaggacttaaaataataattaaaacttaccagcttaa

SEQ ID NO: 10822 - DNA, 2026 bp, Homo sapiens
ttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccccttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgctagtaatgaacgatgacttagttcggatatttcagaactttttgtttataccatcaggtatgcatgaatttataatctgaaagaggacttaaaataataattaaaacttaccagcttaa

SEQ ID NO: 10823 - DNA, 265 bp, Homo sapiens
ggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacg

SEQ ID NO: 10824 - DNA, 265 bp, Homo sapiens; identical to SEQ ID NO: 10823

SEQ ID NO: 10825 - DNA, 2015 bp, Homo sapiens; identical to SEQ ID NO: 10821

SEQ ID NO: 10826 - DNA, 2026 bp, Homo sapiens; identical to SEQ ID NO: 10822

SEQ ID NO: 10827 - DNA, 265 bp, Homo sapiens; identical to SEQ ID NO: 10823

SEQ ID NO: 10828 - DNA, 265 bp, Homo sapiens; identical to SEQ ID NO: 10823

SEQ ID NO: 10829 - DNA, 2654 bp, Homo sapiens
cagcaaagcccaccagagcagagaattatttgacacaaaatgtcactagttccgaagctgagaaatagttacatatgtgtcatttctcactgagtgctctcaagagttttgtctttaattctctgaaatttggatttgatattctagacatggatttcattgcatttattctatttgggtttcattcatcttcttgaatgtgtaggtttacatcttttgccaaagttgggtagttttaaggccttctttcttcaaatatatttttagctctgctccttttctgtttctgggactctgatatgaatgtttgatcttttgttattatccctatggcccatgggcttccattctttttttcccccaattgattttatttcttgtctagaatggataatttctattgatgaatgttcaagtttattatttcctctgccatctccattctgttattgagccaatccagtaatttttaaaaatttacttgttgaatttttcatttccatttttttctatttggttctttgttatatcttctatttctttacttagtgccccctcctttaatttgatttaagagtgtttgcaattgcttggtgcattttaatgataggtctcttaaactcattgtcagtgaattattaatggcaaaaactgaaattacttttgcaccaaccaaatacagtatcagtgtaatcttggtgttggtatctgttctctttttctattaggtttagatttgcctggttttggtataatgaatatttttaattgtatccttgatattttgagtattaggttatgaggcccaggtttctattcattttgtgtttaactttttaagaaactgccacactgtttcccaaagtaattgtaccattttaatttccaccagcagtatgagcttcacctgcttcttatcttcactaacacttgctatacttagctttttaagtgctagccattatattaggcacatagtgttaacttattgtgttttaatttgcatttcacttgtgactaatcatatgtttatttgacatctgtatatcttctttgggttgttgaattttaaggtctttttatattcaagtctttgtcagatatatataagattagaaaatattttctcccagtctgtggctaatcttttccttctcttcacaaagtcggttaagagcaaaagctttcaattttgatgactaattaatttatttgttaaggacttgcagtttcagtaacatatataagaaatttttgcctactccaaggttctgaaagttttatagttttaagcatatgatacatttttagttaacttttttttttttaagacagaatctcactctgtcacccaggctggagtgcagtggcgcgacctctgctcactgcaacctctgccttccaggttcaagagattctcctgcctcggcctcccaagtagcggggactacaagcttgcaccaccatgtccagctaatttttctttttttgtattttcagtagagatgaagtttcaccatgttggccaggctggtcacaaaccagccagcctcagctgatctgccagcctcagccccccaaaatgctggaattacaggtgtgtaccaccattcccagcatttagttaacgttttttgtaggtgctttgagctataaatcaatgtaaatttttaaacatatatataacaagttcttctagcattgtttgttaaaaagattacctcttctttaataaatttcctttgcaccactgtcacaaatcagttgtccatgtatgtgtgtttctcaactctctattttattccatgaataccacacagtcttgattactgtagctttataataagtcttaaattcaggtaacatatgttctccaactttttctttttttttttttgagtcggagtctccctctgtcatccagactagagtgcaatggcgtgatctcggctcacttcaacctccgactcccaggttcaagcaattctccctgcctcagcttcccaagtagctggaatttcaggtgcctgccagcagacctggctatttttgtattttttagtagagatgggttttgccatgttggctggtcttgaactcctgacctcaggtgatctgtccaccgcagcctaccaaagtgctgggattacaggcatgagccatcgcgcccagcctattttccaactttcagaattatttttaaaagttgttttcactaatctaggtcctttgcatgtccatatgtattttagaattgagttcccaatttctacaaaacaaaaagcctcctgaatattcaaaatgggatttcactgaatctataggtcaggttggaaagaattgacatattaatggtattgagtcttgtagtctctgaacatagtatatctctatttaggtcttttttaaagttctcccagaagtgtttttaatttttatactatacatcttgcacttcttttgccagatgcatcactatgtatttcatattgtttatggtgttataaatggcatttaaggttttaaggttcagattgttcatggctagttcatgcaaaatcatctgctttatatatattgatctttattttgcagtctcactaagctcatttagttctaatagtgttgtagataccttcagattttttttatat

SEQ ID NO: 10830 - DNA, 300 bp, Homo sapiens
atactttgtattctttcatttattgcactagctagaacttccagtataatgcttagtggaagtgtttagaccaggtatcctctttttgctgatctttggacttttaccattaagtatgatgttagcagtaggtttctcacacatactctttattggttaaggaaattcccagaatcccagaattcttttcctccttaactgaattattctccttaatgaatgctggatgcctagtaaattttttattttattttattttttaatttttatttatttttttgagctggagtctcgctctgt

SEQ ID NO: 10831 - DNA, 5622 bp, Homo sapiens
ctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggtaaggaaggggccctccctggggtgtgccaggtgtcagccgagcatgttggggcctgtcccacgctgcccagagggagagaggcccctagctgaggttccctccacccggttgaacagggagcagtcctgcccctccccgagccgtcagtctcctgtcgtcactgatgttggaggaggtcccactgggggtctggatgtgacccatccttggcctgggggcagtggtctcagaagatggcctggcccatcctctgctcaccacccaccctgtgcaggtatcttgtaccccactttgagccagtttatgaacccagggcctccacagggagctatattaggagcctagaagccaagaagggaaaaggatggggcaaagggggctgactttaacccattcttccccagcagtgatgcaaactgcctttcccaggaagttaggctggaagctccaggctgtgaagtgggggaagaatcagactcctcctcctcctcctcctcctcctcctcctcctgttgttcctcctggtcctcctcctccagcttctccttttcttggagtctgcatggccacatggctctgcctgagcccatctggcagccttccttggcagggacagaaggggtgatctagaaggggtgatccctccatgaagcatggaagggaacagggctaggtctgtgtttggcgctcaccccatccctccactccctggcttcctctggcctggggagttttgtttttcaccctccagagggggaggacatggggccacaccctggcctgtctctcaggcttgtgtgggtggaggctgggaagggagttgggctaaacttcgctgttgcccgaggccatggccacttcccggcaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggtcagtaggagacagaaaaaaagagggttcacttagtgcagaatcacccttatccacttcccaagtctccttaggttgtggttagaggtcctgctgtggcacctctgtatttcttgggcctcagcaaggcactttatcctcttcaggtctcagttccctgatctttgcaggcaggagaatcgtccccaccccaaagacaagacagggtggaagagatggagagtttcacgcagagcacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccaggtaaggagctgtgcaaagggaagctcctcttccctagtggtggctggtgagaggtccggggatggcctagtgctaaagctggggttggtcctcaggggctgaggtctgtgggaaagcactagcgttaggtatcagggctggttaactggtgcatggtggggcaagggccagttccagacacaaataagacagttttatcaatttttttttttactgtaaatctcagttgtatatgaccaaattagttttaaacattaaaggaacattcttctggctcagtctgggccttaattgcaatcacagataagccccttaccccagccagattgagcatgggcccttgacagtggagtgtggctggctctggggatgaacacattcctatcccaggaagggcccagccaagcactgagtcagcctcaagtgttgctgacctaaggggagtcccttgggtcaggatggagtgttgagtcaggaagatgcagttgccgtcctgagccttagctgggctctgaaggagaggaggttggtcaagggacagagggcaagggaagagaactgggaagtagcagaaaatctcagctgcaagtgttaacttagagaagcagggggtgagggagagacaggaaggagaacaagttttcttttttttctttttttttttttgagacagagtctcactcttcttgccaggttggagtgcagtggcacgatcttggcttaccgcagcctccgcctcctgggttcaagcaattctcctgcctcagcctcccgagtagctgggattacaggcacgcagccaccacatccacctaatttttgtatttttagtagagatggggtttcgccatgttggccaggctggtctcaaactcctgacctcaagggagcacagattttctaaaaggtttcttcaataggtaaataagaaatgtaaacagagctgggcagtggctcacacctgtaatctcagcactttgggaggcctaggctggtggatcactggaggtcaggagttcgagaccagcctggccaatatggtgaaaccctttctctactaaaaattctttatatttagccaggagtggtggtgggcgcctgtaatctcatcttcttgggaggctgaggcaggagaactgcttgaacccggaaggtggcggttgcagtgagccaagatcacgccactgtactccagcctgggcgacagagcaagactccatctcaaacaaaaaaaaaagacaaagaaaaaagaaaaagaaacgtaaagagagaaaaggctggagatagcaccagagcgggaagatggtagacaaagaaatgatacttatttgatgctgatcaaatgcccccagatctctgtacaggagcaagtggtgaaacaaggatgaccttgcctgtccttgccctccaagcatttcagacaagcacatgtgtgacctccaaacaaggcagatggtgatgagaggaaccaggccacgggagattcagaaaaggcacaagtgctcccagaggggcctttgaagccttcccagaggtggcatctgagctgagcctggcaggttgagctgggttttgatggcctgagatgatggcaggggaaggaggtgctcttaagtttgcaggggtggcagcagaaaacgcaggctaagtctaagcgcaagtagagtgtgagttaaagggggtaaggaaacgatggaatcacagccacaagggcctgcttctcttacccaagcagaacttgctccttttccattcgctctggggggtagggcttaggcagttcctcgcccctcctgaactgtgcccattctctggccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaaggacta

SEQ ID NO: 10832 - DNA, 201 bp, Homo sapiens
gacagatgtcgggggtcctctccctccatgctaagggtcatctagcctgtccgtagactctcctgtgcagcattcctgacccgtgacgcttcagcccgcatcttgaccacttttagatacaggctgggcagctctgattattacacagggcttccttcagaaacctgcctccttgtaactttcacccaccagttggagctc

SEQ ID NO: 10833 - DNA, 14112 bp, Homo sapiens
gctctgccagagaaaacgtttaattccctcatgaccaagacaaaaaagaactggcttcaacaactagctgggtctgtgctggcctccaagaccttgaatagcccagatatggagaggttaggtaatgtggccatagtgggcgtgggatgagacatcatcagttcacgccaacacccgtggctttcctcagcagcccaggtttctccatttccccctctgggctctgaatttgtcctcctgtcccagactcatagcctcccctaaagggcagaaggtaccagtgaggctgaggctgaaggaacacccagagactccaagatcggaggggagggcccactccctggagcctactgaccccctccagctggactgacagcctgccagggacaaagcaggaccctgaccacaggaccctcgggaatagcccctctactcttgctccccagggaactcccctggaagagggaccctcagcatttctgggagtccaggggcctgctgcccacaatccccaggtagcctcagataaggaaaaagataacaagttggtactgaaaataaagcaagcgaagagggatttaaaaaatctcaacttccttttcatcctgacaggatttccccaagcgtgctgcagaaaaagcagcatttaaatagagtcctgaggtaacagttttccgagtgcccaggcactcgaggcggggccgggctggcccattgttgacagtgtcccacagagccagcctgccactagtcctctagcactgagctcttggcctccacatactccagggccttggccttgactgcctgcacatccttctcagtgccatgctgcttctcgtagtccaggtagcgcttgaagaagaacttcattctcttgggggccaagctcagatgaatgacccgctcaaagatgtccctgttgaggaaaagcagagtggcatttgcctgtcagtcccaggtcacgtgcttcctgcctagcactcacccacttgctctcagccctggaaccaggaccctctcccatccaggactcccacttctaccattatctttattaatccatgatgaactcccatgatgccttggggagaggcactaccaccctcatcttccagatgagcagatggacacccagagatggtaagggacttccctgcctaaagccacacagtgatcaagacaaagctactggggatgggggacacacagtgataaacatacatagtgaagggcttgggtgaggcacctgttctttttggacctcagtctactcagggggagaccctccctgtcttgtggagacgctggggtcaaaagcagagaatgcctgtgaaagtagtctacaatgagagtcaggaacagtgttaattatgagagaaactcgagtctcttgacaaggctacctcctaccaatggtttcagacacagaccagatgctggcctttgaggcagaaagaggagttgaagtgaatgtcactgggcctggggcatcacatctagctggttttctagatcaagtaagagaactgggatgctgagagctgctgtgggaccagtgcctaccacgccctctcctgaggaactcggccttggccagctgccccactcaccggacgtccttctggctgccgtgcttgatggtcatgtcgatatagaccgaccagacatctgtgcgctttgggtaggtgctcagcgtgttctcaaaaatggctttggcccgctctgcatcccccagctgaaactcaagctgggcaaacttggcaatgacatccacatctgcagggagaggactgctcagagacccaacaagcagacagccccctcaccacaacacagtgttccgcagggtcagcgtgcacctgactccctgctcttgggtcccaagactcaggttgtgacaagagggacaaagacccaaaaggggtgggtttggggccaaatacacagatgggcactgcagacacaccactctctgggcacagaagaggtgggggatcccaggggcaacagaactagtactaactgcgttttgttcctccatcttttggagcctgacatttgaaatttaacatgcactgttatgctgaggggcagagaatcaacaggcagcaagaggaaagccctcacaaggctctcctgacttagaagaagcaatgccacagccagttcctactccccgatcctggagtgctcatgggctcaggagctgggaatgagcactcacgctccttgctaggcaggcactccagggctcgctgcagcacgcggtgactggctgcagcctggctcctccgcagaaggaaggcgccgtatttgatccacacagctttctcctgccggaaacgcttcagcatccggttgtagagttcaccagcttcctgtgggaaaagacgaggcacgctgaggagagtgtgatactacagaggggacaagacagacaagcagcaacactcacaagaagctagacctgggctcccagacaccaaatcactctcagggcctaatgctagagacctgagaggagcgggagggaggctcacagaagggcaccgtgaacaggcacaacacgacggaggggattccctgctgatccgcacccatgggagggcggtcctagcctagaacatgagaatgacaagggggagtaggagagacgccagagcggatgctgggccgggacgtccccttctgtctgtgatgccctgccagcagcccaaggcagacacaccaggggtccactgccccttcacttccaaagccactccttccctcaccttgaccccacaggcctgaagaagaggtgagggaaatgacttcttttacttggaagatagggaagttggggccccgatgttgggtggcaagctcacagcaggactggacccagcaccccaggggctcttctctgagattgtggccctggaactcccaggagttcgtctgtggcccaacctcctacctggaatttctctgacttggcgtagatgtcagccaggtggagaaagactttgagaggctcgttgtactgcacggctcgctcaaagaccttggtcagggactcctgagagccgtacatgttctccaggttcagcagagccacccacacgttcagcttctcctgctcctctctggagggagagcagtcagcacatgagcgccacatgaaaccagtgagcctcccgccccatccagacagactcaggaaccacctccccctcccagcctctatctgtgtcctcagatcccaccccaaatgtagaccctaagaggctgtgtccccacagctcctgcagcattagaaacccctgccccaaccccaatggctgagtctgaggctctcctggattctgcctccattcctagaaaggatgcccaccagatcccaaacgggcctgaggtttgggctggacgcagagtcctgggtctgattctctcttcaagctaagaggatgaagcaaaggactgccttccctcttcattaggcctcaaaaactccctctgtttggaaaaccaccacagggatttcgcccaggtatgtagtgagttcttttcttactgtgtttctgctcaaactggttccctcatataagtgtatggactcttgtgaaggttacccttagcagtttcagggaagaagactataaaatataaatgagtagatctatttcacagatggccgcagctatggcagaaagcctgaggacccatgggcccctggtggcagccacccaaaatgctgccggcctgcctaggaggagctaccccacaggttgagaaacttcccagcccagaacgtgcgaagacactgtgctccctggggcaaagctgagacctgaaggagatggtcttaagggccctctcagccacggcacgggccttctcgatctccgtggcctgcaggtggaaagccatgtactgcagccacagaatggagctgttgggggagctcagcaccagtcggtcaaaatcatccgcggactctggctgccgcccaggatccatcagcgcctcctcaatgcgggacagttccttctctgccttctgcttctccaactccctttctttcttgcttttctttatctgctatggaaagcagaaacaccgtgagtcatctgctcctcaaggcctaggggaggtctgtggtggaagtcacgagttggctgggcagcccagggctctatatataccccctggcctgggactggccgctgccccctcccccactcacccaggaagacacccagtctaggaacagagcacaagagactgacaccaaggggtccctgcaaaaaggacatgccctgcaaaatacagcaccgtggcttggtgtggcttctcatcctcctcgctgtctgagctctctgctagaggtggcaaggccggggtcagagagtctagtcccacattccaagcgaagcctgaagacagctgcagccggggcgcttctgctggcttggtttgcttctcctggaggaacacagaggcgctaaagaaagcacctggctcaggctgctccctgttcccccgtgccagcccacctggaggagcatggactcctaccaagcccagagacccctcctctcctctcctctcctcctaggccatgccaggccccagcccactggggaaactttatagcagtgacataaaagttttctttgtaaatacatttatttagataacaaaattttcacacacacacatgcatatgcataccagtatataaaataacagtagaagccaggtgtggtggctcacacctgtaaccccaacactttaagaagctgaggcgggccgatcatttgaagtcaggagttcgagaccagcccggccaacatggcgaaaccccctctctactaatacaaaaattagccaggcatggtggtgcataccggcagtctcagctactcgggaggctgagtcatgagaattgcttgaacctggaaggcagaggttgcagtgagccaagatcacacaactgcactccagcctggatgacaaagcgagactctgtctcaaaataataaaaataaaaataacagtagagctgggacagagagatgacaataattctgagggtggcagggaggccctgcccagatggttataagccatcccatacccggtcctctcagcccaggtattactattctcatcttttggaggatgcaggctcagaacggctcagcctcctctttctctgcccagcctcctaatttaattcagttccacccaataaatattccttagaatttattttatgcagcctgctctgggtaaaaagggtcccttgtcctcaaggagctgacggtcaatggaggcaactgacagcccctgctttcgtattttataggaaatgaagtaaaagaggatgaggcagaggatggcccagctcttcccttgcctggagcagccttcccctccccgcgacgtcaccctcaccttgggcagcacattcgtctcttctgcctcctcttttccctcccgatagtacacgtccacaaggctgtcgtcctcctctgacaggccggctttctttggcttcttgctcactctttcctgagaggccaggtgggagaatgcctaggagcatcctcctgcagccccaggcgacaccctccctcggccccactgggtgccctgtccccacgccctcatggctgtccctccaggaggaggataggcagccacagccctccgcaggacctcacctgctcactcccagactcccggcactcccgcccgccccgcttctgcgcctgtggcttctggggctgttgcttctccttgctgggcatctccacctcctcctgccccttctggttcttcttctcgttccttttctgatttttcttttcccctttttggtctctctcctcagcctctgttttcctctcctcttgctttgtaagttgcccttccaaggaagcagaaagcacgtctggcttcccagtgtctccggggaggaaagacagctctaccaggttcttctggtggttaaggctatgacagagcaagatggggaggtaaagacatcataaaaagcagagggcaccacaggcggcccaggcctttttcctcctgatcagcccacgattctgggccctgcccccatctgccttgggagtcctttcaatattctcaagaatgatttgcacaatttttcatgcttagtagaaaaatacagggggtagatgtgatgccccctccaccatccccaacaacaggagctatgcagagataagttaccacctgttttcacaggcactgggggagaaggttccaaacaaaggccttttattcatctgaacaccactacgcaagccattatgtttacagttcaccctgaaatctcctcccagggctcctggagaaaggggtttgattcacattacagagagagagagaacgggaaggcacctaccgtaggaccctggctgtgagcagcttcccttcagggaggtgtttgttataaagggctttcttggacgggctgtgctgggagacatgggagtaccgagccaaacccacaacggaggggccaaggctgaaaggagagaggcaagagtcctgtggtcacaaatgcaacaacagaattccaaccaggcctcgggacttcactctcacagggactcaagttgtgacaaggatttgtgacagacataagttcctggcattcagcaggatgaagtgggctttgtaaacttgaaatcatcatcaagcataatgaagatatgattgagggtattttttactccacactgtggtatcataatatataaatcacaaactgctaggagaaactgcagaaacagcatggcagggaaggctgcagtatcaggtgcttgtgaacatgaggtgatttcacagaacgaacacttacaaatcatgatcaaacactaaaacagaatatccacatttatgtattttttaatttaaatttaatttttttagacacagggtatcactgcctcccaggctggaggtcagaggcacaatcatagcttaatgtaacctcgaacttatgggctcaagcaatcctcccgcctcagccttccaaatagctgggactacaggctcatgctaccacacctggttaatttttaatttttttctggagacatgggggtcttgctttgttgcccaggctggtcttgaactcctggccttcaaagcaattctctcatctcggcctctcaaagcgctaggattccaggcatgagccaccacgcccggccccagacttacttagaacagaaattagaaatgccatattctttgtccaaaacaccaaataactaataactcaacagttgttttaaaagtattagaaaacttggaattttaaaaatgagtggggactcataaactctcctcccttcatattcccatcaaagaagttgaccgaggaacacagtggaccccagagcaacacaggctcagggaaggcacttgggtccgggtgcagagcccccctcactcaccgaaagaacacaccgtgtggctggatggaccctacatagcccctcagaagctgcccttccttaatgtcctggatggagttaatctctggatcttctactttgcttttcgtctccgggtttgttctaaaggaataaaaggcttacatgcacacctttaacctccactgtcccatgccacccccaatacacctgcaaccatcatacttagtaaataagaatatgactctggacctgtcagcaggatataacctttagagcccaactctactctctcctaacatcttgccaggccagaagcaggtgcctggggcccagctatgtagaaatggggagaggcggaccaagccagagaggtcaaacctaaagccttggcctcattaacattgatgtctaaccatacagcaagctgacctcaagccaactccatacatggcacgctcacccctacaatggaaccctggaggctaaagcatctcccctcaccaggactaccatctgcaaccttggacacccacatctggatatctgaccctttccatggaaaacaagagcctgagcagacaggattcttgcagcaatctgaacagcctcagcttttctgggtaaaagaggttcaggataaaaagtgatgagcagagaaggtgggaagcccaaaattctgtgtcagatacacgtagcctccccttgatcctgagtgggtcttcctcctttctttttccaacaacacagaaacccacctggatgatcgcagcgacaaagtcaatacgttgtctgcagtggacaggatgtaacatctgaatgaaggcaaaagagaaggaaacgctcaattttcagcatctgtgaacagcaaagggtctcagcttcctctcctccaggctgacgaataggcaggagtgaggagacaggagactctggtcatgtttcttcattctgttgaaaacctgctgagggactctggacaagtcacgtcacctctgtgggcttcagtttactagtctattaaatagaaataacactaccgggctgggcacggtggctcacgcctgtaatcccagcactttgggaggctgaggtaggcggatcacaaggtcaggagattgagaccatcctggctaacacggtgaaaccccatctctactaaaaatacaaaaaaaatagccgggcgtggtggcgggcgcctgtagtcccaactactggggaggttgaggcaggagaatggcgtgaacccaggaggcagaggttgcagtgagccgagatcgtgccactgcactccagcctgggcgacagagcaagactccatctcaaaataaataaataaataaataaataacactacctactcttcttacctaacaagggtgttggggccaggtgtagtggctcacatctgtaatctcaacactttgggaggccgaggcaggagaactgctagaagccaggagctcaagaccagtctgggcagcaaagcgagaccctgtctctataaaaaaacttttttaaaaagccaggtgtggtggcacacacctgtagtcccagccacttgggaggctgaggacagaggattgtttgagcccaagaatttgaggttgcagtgagctacgatcacaccactgccctctagcctgggcaactaagtaagaccctgagaaagaaagaaaggggagggagagagggaagaagaaaaggaagtctcacagaggcatacagtatgtccttaaaagaagaaccagctctgtgttagatcctgagaacgtttgatctcagcagagagacacactaaccccaggagatcatgcccaaggcatcagctaggtactactgcagacacacaagagcagttcagaggaggcgggtcagcgcttccaggagggacagcagggttgcatctctaaacatttcatctaaaatggcaattagtagtccaaaaccataatatacagattcttagaggtagaaaggatctcagcaaaaatccagtccaaaattttcccacgacagatgtctgcctttggtaacgtggcatcatagccatcagagctggacagaacctcaagggaccgtctacctttaggcaagtaatttatcgtaggtttggccacaataaaacacatttaaaaccacaacctcattatctaagcctcaagagaaaccagagatgatcctggctgtctctaggactcattctttgtcttctcccaggccctgggcatgtgtgtgccgtgcagtggttgtgagtggttgagaatttaggcaggtaggtgctggtggctgggacagctgagacaggagagggcagttactattttccagtctctgcctccaagggcatctactgtactgtcagttgactactggatgcagctgaaatctgtctcctcaagtttagtttattcaggctattaaaacagtcttaaaactccaattggctgggtgcggaggctcactttgagaggccaaggcaggcagatcacttaagcccaggagcttgagaccagcctggccaacatggtgaaaccctgtctctactaaaaacagaaaaattagccaggcatggtgacacaacgcctgtaatcccaggtacttgggtggctgaggcacaagaatcgcttgaacccaggaggcagaggttgcagtgagccaagattgcgccactgcactccagcctgggtgacagagcaagactctgtctcaaaacaaaacaaaacaagagccaagattgtgccactgcactccagcctgggcaacagagcgagactctatctcaaaaaaaaaaaaaaagaaaaaaacaagagaccaatttttgctgaaccaatggctaagacacaaatttaaaatatccagtgccaatagtggtgtgagaaatggacagtcatatttactgttaatggggacataaattagcacagtcattttggagggtatgtaacccatcaatttcacttctaggaatttatttaccaaacatacctgcattagtatccaaatatatgcaaaagggccaggcaccgtggctcatgcctgtaatcccaccactttgggaggccaggatgggcagatcacctgaggtcaggagttcgagaccaacctgaccgacatggcgaaacctagtctctactaaaagtacaaaaattagccaggcgtcatggcgcatgcctataatcctagctacttgggaggctgaggcaggagaattgcttgaacttgggaggagactgcagtgagctgagatcgcgccactgcactccagcctacgcactgcactccagccagactgcctcagttaaaaaaaggctgtgtctcgcgccactgcactccagactctgtctcacgccactgcactccagccagactctgtctcaattaaaaaaaaacaaaaaacccaaatatatgtacaaagatacttcaacattattgtctatcaaaaaaagtattgtctatcaacagagaattggttacacaaatttcaattaaaaaaaccccagaatactaaacaaacgttttaaaataaggtaaaaggacaaaatagattttgatatattagcatagaaaaggaaaaaaattcatgataaactatgagaaaaaaacagtatatcaaatgatattctattatttatataaagaaaaactatatatatatgcattaaagtctagaaagatagaaatcaaagtacataatggcaaaaagtggtagagaaacagaggggttacagaaattttcattttctatttcatatacctgtttttctgataaaaagtcatgtattacaacaacgtttttttttaaatataccaattccacagacaggtgaaaagaggaagaacacttcgcttacctgacaaccttctgggggacgaagtcttccaggggcgtctcggagtaggagtcactcatgtgaaatatactgactgttcctatcttcccaaaggggaaggagacggtcagcccctcgttgggagtcaccttcaccactcggcccatggccacttccccttcctcaagcttgtgaggacctggtggaagaaccaacctgattcagggaagaggaaatgagctaagggaggagcgggaatgccagccacacacaggctggggaaggtggaggctgcccagacttggggtatctgggctgagtgatccagaaccatctagactgagatcaccctgccatgtagccaaggacctcagggccaagtggtggacaactctttcccagggacttgagaaaaacacctgtgtaggtaagggtaacctgtataggtaaaggtaactcagagagcagtggagtaactgggccagagcaaagcccaagagaaaaactgttccaagaaggttttttaccaggctttctgaggattccataccgaagggtcctccaactcaagcaatagctgaaaacccatcccaccccttcctgccgctccccttccccgaccaggcactgtttcatccccacacctgtgagggacagacataagagggtcttggaggaatctgggccaacaacggtggccctcagggcctggccaacccggaacttcttatctggatgcttcagaacctggaaggataaaaaaactcctgtgatgcttgaagaaaggctgtcatttatccaaaaccacagcatttaagtctccaaagcaagtatctcccaaagcaacccttaaataaagaacaagctttctcaaatccactgtaaacccacacaccaggcactgggccaagcttagggaacttgggtcccctctccaggcatctcaagcacactgaccttcaagctcacacaagtgagcaataagggaattctcccccggatgtctggggcaatctccacctcaagccatttcttcaccacattgtactgagggaaaaaaaggaaccagagtagggcaaatacaaatacaaggtttcccgccattaaaactttcctaaaaccacaaggtggaaagggccccagtacacttttccaagagacaggaatccacccttccatcccactgcccttgcccaacctccacttctcaccagcttccctcagactccagctcagaacctttgctagcctagcagaatgtgcatctcttccagggtctcagctgaccaggaggcaaaagagactccagagatgtcctcaaactggagaaccaatcccacagacctctgtagcctcctccaagctcagctgtgcccagcgattgttaaccatctccagaggccaatttttaatttctaaaccaatttggatttggatccttcactgtttatgcagtgtcttgccctaaatatgcactccaattttctcctttttttttgagacagagtctcgctctgtctcctaggctggagtgtgtggcggcaatctcggctcactgcaatctccacctcctgggttccagtgattctcctgcctcagcctccagggtagctgggattacaggcgcgcacgccccaggcccggctaaatttttgtatttttagtagagatggggtttcaccatgttggccaggctggtctcaaactcctgacctgaagtgatctgcccacctcggcctcccaaagtgctgggattacaggcgtgaaccaccacacctggccgtaaatacatactccaattttctagtcaacttaacaaatcatttatcgagcagctactatgcacatggcatcataatgataaataaaagccagagcctgccttcaaggagattacagcctacaagcagtaagtcaaatcagtgtgcaaataactacaacagcaagcaacatgtaggaagtacaacatgctacaggaactagtaacgagggaaggttatctgtgctgaaccttgatgggcagtaggcaattggaatagaaggtactccagatgtagaaaccagcatgaataaagacaggaagggaaaaagacagaaaagcttttcagaatgactgccacacaaggtgcacggaaggtcagattatgaagagccttatctgccacgctaaggcatctggggtgtatgaatgtctatagacaataggtaactgaagggatcaagcatcagagacgatcatgctcaaagatgctcatcgaagaggaatctggcaacaatggagaggtattattcttcaaggtcaaacccaatccagccgcctctcctacatgtttcaaccagtacaggctgctttccttcctttttgaactcctgttccagttggggttggaacacataatctggcacccaatttcatgttgttttacagtgcacctgaacttcatgaaaagcatgaatctaaaatccaaattatatacatttatattctaaatcttgccatgtattttactttccatttctacaattaacctaccaacaatgaattacgagctgcttgctaattgtgtgtaagccatattttagctccctaattagaccagaagttctctagtggcagaggccacgtactgtctcccacaaacccagcatggtagcacagactcaaatgcctttctctgctaatggcttttctctccaacgtcatgaccttttttctgaaagaagaatgacatctcattgccgagtggcaaaactacttactttctttaagaagcaagtaacagtctggccggcctggtactgtttaatcttct

SEQ ID NO: 10834 - DNA, 152 bp, Homo sapiens; identical to SEQ ID NO: 8280

SEQ ID NO: 10835 - DNA, 130 bp, Homo sapiens; identical to SEQ ID NO: 7216

SEQ ID NO: 10836 - DNA, 143 bp, Homo sapiens; identical to SEQ ID NO: 7217

SEQ ID NO: 10837 - DNA, 116 bp, Homo sapiens; identical to SEQ ID NO: 7991

SEQ ID NO: 10838 - DNA, 151 bp, Homo sapiens; identical to SEQ ID NO: 7218

SEQ ID NO: 10839 - DNA, 202 bp, Homo sapiens; identical to SEQ ID NO: 7316

SEQ ID NO: 10840 - DNA, 158 bp, Homo sapiens; identical to SEQ ID NO: 7318

SEQ ID NO: 10841 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 10842 - DNA, 118 bp, Homo sapiens; identical to SEQ ID NO: 7220

SEQ ID NO: 10843 - DNA, 77 bp, Homo sapiens; identical to SEQ ID NO: 7322

SEQ ID NO: 10844 - DNA, 15017 bp, Homo sapiens
ggtggttggttctagctattgccatggtacgtttttatatggaaaaaggaacacacagaggtttatataaaagtattcagaagacacttaaatttttccagacatttgccttgcttgaggtaagttttccatcatgctgtttttctattgctgtaatatttatgtgaacattttttgttgtgcaaaatcaatatgattttgctgattacataccacctatggatttgctgaatgccaatgttgacagtggtttatttaatgttttctattattgacgtaatgatttttttctatttgcttacagatagttcactgtttaattggtgagtttttgcttcaattttatacttttattataaattgcctttagggcaatagttcacttgtttttctttttaaggaattgtacctacttctgtgattgtgactggggtccaagtgagttcaagaatctttatggtgtggctcattactcacagtataaaaccagtaagtgacacaaacatgttgtctacttgagcctgcaggaaagctttccattcataggaatctaaaatattaacatttgtatatttcaggaggtggaagtgttggacaaaaaggagttgggtttgagttttagatgttgtgcattgacttagtgccttagcagaatgactttgatacacaaacaaacccaaatattggcatcttagatccgtaatatattctcctttgatattttccagtttttgaaatcagtattcaggttctgtcaaataacctgcagaaaatgttcttttctatagaagtttcttttcaatccaagttgtcctctttgattatgtaatcgaagttgtcagtatacaatttattatttctggccagccgcagtggcccacacctgtaatcccagcactttgggaggccaaggcgggtggatcacctgaggtcaggagtttgagaccagcctggccaacatggtgaaaccctgttcctactaaaaatacaaaaattaaccaggcgtgggggcgagcacctggaatcccagctactcaggaggccgaggcagaagaatcgcttgaacccgagaggcaaaggttgcattgagctgagattgtgccactgcactccagcctgggcgacagagcgagactccgtctgaaaaaaaaaaaaattatatcttatttagcattgagtattacagcaacagacataaaaagtaaatgcagttctgtagatctgaacaaacggaaaagactgaaagttagaaggggtcaaaggataaaaattttagttaggaggaattaagttcaagagatctattatgcaacgtagtgactatagttaatagcaatgtattgtatatttgaaaattgctaagagaatagtgatcttaccacaaataaataagtacataaggtaatacataggttcgttagcttgatttagccatttcacaatgcgtacatatttcagaacatcatgttgtacaccataaatatatgcaatttaaattttcaattaaaaataattgtcaaaaaattgctaaggagctttaggaaaaataaacaatttttattgaggcatgacaggagacagacctaattattgaatctaattaatgattcaaacctttcaggcgagatagacaccatgctgctatgtcaagatattgggcattttaaacccatgacagggccgggcgaggtggcacaagcctgtaatcccagcactttgggaggccaaggtgggtgaaccacctgagggtcaggagttcgcgaccagcctggctaacgtggtgaaacctcatctctaccaaaaatacaaaaatcagccagatgtggtggcgggcgcctgccatcccagctacacgggaggctgaggcaggagaattgcttgaacctgggaggtggagggtgcagtgagctgagatcgcaccactgcactccagtttgggtgacagagtgaggctccatctcaaaaaaaaaaaaaaattaaacccatgacaggaacatttcctatgtcaacccttctgaccttcttgacagcctttagagcctcctgtctactcgaggacagatctctggcctcctttccatttctcacatgcctttcttagatgcttggggactgacacctgacctcttctctgttcctcttagcttcactggccccctgtctgcatggggacagctcactgacctcctgctctttatactttatccctcttgactagtatctttcactcaacttgcatgatttacctgcaccctaaacagcgactgccatgcagatagtgcagatagcagtgagcacatgcaatgggagaggcaaactattaattaactttgcctactagtttaaaagcaggaggacagcattaacagactagaagacagactcttccaggcagtgagggaatataatagctgagttaggaccaccatgagtctgaagaatgaagaagaaagacaacattaactagacattaactagagagatggaggtaaagggaagcttgagagtcgcgagttccaaaaataaaacaggacccgtctgccccgtttatcctccagaggatctctgccttaatattcctatttattttttgctgacgatagtttcccactggtacctattcagcactcgttaattaattcaaccaatattattgaatgcgttctctacacctggtgctgtgcaaatttctggatttacagaaatgaataaggtgggcgggtggggtggctcacgcctataatcccagcactttgggaggctgaggcaggtggatcacttgaggtcaggagttcgagaccagcctggccaacatggtgaaaccctgtctctactaaaaattcaaaaattagccaggtgtggtggtgcgcacctgtagtcccagctactcgggaggctgaggcagaagaatcacttgaacccaagaggcagaggttgcagtgagctgagatcgcatcactgcactccagcctgggtgacagagcgagattctgtctcaaaaaaaaaaaaaaagaacaaggcaatcccagctgtccagtgtactggctgttgggaagtggggtacacttaacgttaaatcacgcacaatgctaatcatgcacctcatctgtgcccggcagtgtgctgggatatggctgttgataaaacaaacatggttctcgcctggtggagcctatacttgggagagaagctaaacaaatatttaatcatatacgtgttaagtgctttgaagcaagagctcggtatgcgttgcagtatacctaaggacttagtctgacgtagggagtgcaagaaggcttcccttaaggagggatacagatgttgaatgctgacatgtacaagagttagccagacaactcttagtacagattggcaaatgccacaacacagatatgaacaaagtacagtagaagaagggtgctgggctgggcatggtggctcatgcctgtaatcctagcactttgggaggctgaggcaagcagattacatgagatcaggaattcgagaccagcctggccaacacggtgaaaccccgtctctactaaaaatacaaaaattagcagggcatgtaatcccagctactccggaggctgaggcatgagactcatttgaacctaggacgtggaggttgcagtgagccgagatcatgccactgcactccagcccgggtgacacagcaagactccgtctcacataaataaataaataagctaaataaataaataaataaaggtggtgagcaaataactgctcagggtgagaggagagggttggagtcagttttctagagggcgagatgttttagctgaatcttgaaagataggaaaagattttttatggaataagagagtaacattccagtgagagtgaatagcatgtgttaaattgcacaagttcagagcatattctggaaataacaacatctagtgtcaccagagagagaagtaggtagaagggttgaataattgtagatgaagttggagagatttccgagcaaggattgcaaagaaccttgaatatggtgcccaggtattagggctcatccttttattctgttaagaagtgtgggaccagtgaaacttttaaatcacaggacttagctgattccaatttgttttttatgtatttgcttctttgacttctttttaaaagacaacttgcattcatgaggacaataaagggaggaaagactatttaggaaacagttacagtagtcaagatgagagatgataaacccctgaattaaaatagtagtaaaagggccaaagatgagtgagcaattcaagcgttggtcctacagtagaacaggtgtgattcaatgattactagaagtaggagggtcagattttggtttcagcaaggtaacattgtcctctgatgatagcgttatttcctgaagtgaaggacgagggaagaaaaacgagtctatgctcaactattcctgtgcataagatacgtttaagttccacgtttataattaattatgttaatggtgactgcattaagttttctatattgcatttgcctaaccctaacattccattataaataaaaggcaataaataagtaaagtaagtaccttcactgaaaagtaagttctaggttgaatgacactgggtttctctgtaattctgcagatccagaatgaagagagtgtggtgctttttctggtcgcgtggactgtgacagagatcactcgctattccttctacacattcagccttcttgaccacttgccatacttcattaaatgggccaggtggcgatatcttgcagtttagtttctccttgtcctgtgcatgcttattttgtgtgctaacgccagagaattaaaattcgtgtttcagccccacgatgccagaatgctgttataggaggtataactggtataactaataattatacaagttatgatttgtattctaaaagcttaatgatgagagaggaatcgtattaataaatattttgagtgaaatcaatgtgagacaaattgtggtatccttaacctcagaattagtcattcatttttttttggaaagcacaatatacatttttggaattagcttacataagcagtaccaaaaatatgttttttttttgtctgtgatgtaaattattttaatagtcaatctagcagccacaatttataccatttacacaatgcgattggtttttttctttgctttaagttgcagagacatttttaaaagtcacacttacttaaaattgtattatttggaatgtggataaaatttatatttgaagggctccaaatatatcctaaagcaacagtttttaaaggaaaagatatctgttcttcttgaagtttgaattctttgagcaattgacgttttagaaagttattataaaagcaaaactgctctttggagaacaagtcacaaatcagtatagacttgttcattttattctttgtattgtactttatggtagcaataacaatgacaaatggtgtgtgcctactgcatgcctgagatgtaggtatgaacaaaacaaattctctgtcttatgatgaagacaaaacataaactaataatatgtgatatgtcaggtggtgataaatgctgggattataggtgtgagccaccatgcctggtcaattactattttttaatcccaagtattatacatgttcaaatataataaatgagaatatataaaccaaaaagaaggaaaaccacttttaaattacttataatctctctaaccaaggataaccactgttaattgtgttttatgggtttttttctcttttttttttttttttttttgagacagggtctcattctgtcacccaggctggaggatagtggcacgatctcggctcacttcaatatccaccacctgggctcaagcgattctcctgcctcagcctcccaagtagctgggagtacaggtgcaggccaccacacctggctaatttttgtattttttgtagagatggggttttaccatgttgcccaggctggtctcgaacacctgagctcaagtgatccacccacctcggcctccctaagtgctaggattacaggtgtgagccactgcgcctggccatgttatatactctttgtgactttttaatattctctagctcttttttagacacttgcggcttaccactttgtatatgatgagatactttgaaattataatttgagcttaagtgtcttgtctgtcataagaaggttgtactaccatttatatggatttggttggttttaatcttactgtacatgaaaatgtgtttacctttagtgactgagctttttaaaggttggcagttttgaatgtagctggactctaatcctagaacacatcaatatcatttcgcatgacaatgttctggacctctggcacctttgaaaatactaacttaccatatagtctcttttcatgtgctgaatttacaaaatttgtctgaagaggatagcagaatgtacattgcatattttcctgaggttggcacattagacttgatggctttgtgtgtctgtcttttggaatgcatttgcatgtcttgagtgtctggaaaagataaaaactctgccatcgtatgtttaaatttgctgtttagaaagtgtttatccattgcaggctgggcgtggtggctcatgcctgtaatcccaacactttgggaggccaaggtgggcggatcacttgaggtcaggagttccagatcagcctggccaacatggtgaaaccccatctctactaaaaaattaaaaaattagccacatgtgcctgtaatcccagctacttgggaggccgaggcaggagaattgcttgaactaggaggtggaggttgcagtgatctgagatcacaccactgcactccagcttggtgacacagcgtgactctgtctcaaaagaagaaagtgtttatccattgccttaatgttaaacaagttatacagtctttcagctttgaaatcatatgttacataatactttgtcagttgatcataatcataaataattatgtttcatgtcaaaaagatcttaaaaatcccagccatctaaatatgtttcccaactccattaagtaaggtaaaataatatttgtatttatgttcagatgttgaagctgtcattctcgaataaaactacactttagaaatggcttcttagttataagtagtttggcctattgttacagtttgaatatactttgattctatttatgtgtcataagtgttcttggaaaagtcctcagaataggtaattgtatatattaagttaggtttttcatattgatttaaaatgcactcccttcaaaaaaattttagatagtaattgggaaccttcaaagaagcattgtatctttttttttaatgtggtctatccatagttaaatctcccatactgccctcagaacttagagaagtagtaacatgcaatctttttgaagtgcaagtaaagtcaaattatataatttgttcccatttcattagaaattttcattgcccttaagactttcaactagcttattgtaggagtgttaattttttcttctattgaagaacaatcctgccaaaaaaaaaaaaaatcttttgaaaaccacataaagtaaaaattgcaacttaatcagtttgggtattttactgagacaggtatataaaatgtccagttatgggatttaataaattgaggaatagggaaagattgatttaaatgatacacaaataactacccaaaactggtaagaaagcagggagtttctccaaggccaagaagggattaacaggtacagtgaaggaatcattcttctttcttgaatagctcatctattttggcaaataattctgcccttctccccatctcttatcttcgcatatccttgacatacaggaataatgcaatttttaatttgtctccaagcttcttcaatactgacaactttgacttttctttatagatatttcctaatgccaacaaaatgattaaataaaatacagattaatttgatttctttttccatcaaaatgttgaccttttgttttaaattaaaaacatttttctttttttaaattaaatttattttttttgagacagggtctcgctgtgtcacccaggctggagtacagtggtgcggtcttggctcactgcccccttgacctcctaggctcaagcaatcctcctgccttagcctcccaagtagctggggcgacaggcatgcaccactgtggtctgctcattaaatttttttttgtgagacggggtcttactatatcgcccagagtggtcttgcactctggcctcttaagttttctgtggtaactgttatatagtgactgagtcagagaaaaatgatttttttttttaatgaagaaatatgatcatcttggatcctttaggcccctcttattggagaccagccagtagaacacagagtgtttcctaattggaagcatacaggatgcctggcctactgtgtgttccagaccttgccacagaccaaatgaacacatgatgactttggatttagagtagaactttcttaactctactttaaacaagctcactcttcttttaatgtgggaattcaggaactaacttgtcaatttattttgttacggtagcagttttagacaatataatatactcattagtagctactcatgcttcaggtggtattatcagttttctgcaataattggttttcattagtaaccacaaagactttttcaaatgcctcttaaaaataactaccttggtaatttcaaggtttagatataaaatttaggataatcactggtctttttaaacgcagtgtttgatcaataaattactagctgccgcggacaaaagcagtcatttgtgattttatgcaccaaagaagttaccattacaatactttttttaaagctacataggccgggcatggtggctcatgtctgtaatcccagcactttgggaggctgaggcgggtggatcacctgaaggcaggagttcaagaccagcctgaccaacatggtgaaaccctgtctctactaaaaatacaaaaattaaccgggcgtggtggcgggcgcctgtagtcccagctacccaggaggctgaggcaggagaattgcttgaacccgggaggtggaggttgcagtgacccaagattgtgccactgcactccagtctaggcgacagagtaagactccatctcaaaaaaaaacaaaaaacaaaaaaaaaaaacaccaaaaattagctgggtatggtggcacacacctgtaatcccagctacttgggaggctgaggcaggagaattacttgaacccaggaggtggaggttgcagtgagccaagactgtgccgctgcactccagcctggtgacaagagcgaactccatctcaaaacaaaaacaagaaaaactacatatacattttttaatacataaaagtattttggtactctaaaataagttgatactattttattaaaaagacattgcctattatggaaactggtattaggaaaaaaaggatgataatcaataagcaaatgattaaagtagaactattaaccttacgtaaggttattgtaaatatgtaaagaaaagagaattttgaagtttaaatttagtagtagcaatagacctgcaatgtaaagtctaataattattgtagaaaaataattctctgaggtttttctttctccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatataccttgtaagtatatacttattagtactttgatttgacatatgatgtggaaatttttgaaaggatataataatatgcaaggggaaataattagaaataattgcttacaaatacattaaaacttcggtttaactccatatttactgataatttgggaaaagtgaagggagatagaggcagaagacagttcattagctatgagaataaaggcaggtaaattaacgcatggattattgctttctcaaaatcatttaaacatcagcttagtatgatttttttaaagaaagataaaaacaaatcatgtttaaagcattagtgcactttttacaagcatttagaattatatgtctgagtataaacactgtgtccaagaaaatttcagatcatttctatctattcattaagcatatacttggaaaaatcatctaggagtagttttgagtcttatttgtgttgctctatgtacttgcaaataataaagcctcttttcttaaaggattttgaataagtcagcctcttcactaatttctcatcatctttcagcagttgaagtgaattggtaaggctttactccatttcagtgctgctaatagtgaggcagggctccgtggctcatgcctataatcccagcactttgggaggccgaggcaggtggatcacctgaggtcaggagttcgagaccaggctggccaacatggcaaaaccctgtctctactaaaatacagaaattaactgggcatggtggcgcatgcctgtaatctcagctactcaggaggctgaggcaggagaatcgtttgaacctgagaggcagaagttgcagtgaactgacatgatgccattgcattccagcctgggcaataagagtgagactctgtctcaaaaaaaaaaaggcgtgggggctaatagtgatatatttttaagtcaaatattgatagctctaaaatctacatcgacatgatacaaattatttcatctaaaggagatgcgcataaaacttggccagccccttgaggtctccaacttttttttgttgttttttttgagacagagtcttgcgcttttgcccaggctggagtgcagtggcgccatctcagctcactccaatcgctgcctctcaggttcatgggattacaagcgcctgccacagtgcccacctaatttttgtatttttagtagagacgaggtttcaccatattggccaggctggtctcaaactcctgacctcaagggatccacccaccttggtctcccaaagtgctgggattacaggcatgagcccctgcccccggcagatgtctccaacttgtatctttcccaaagtcaaaattgacttagtggtgaaagatatgttttccccttgtcttctaccacttcagcctgattctgtatctgattttctaccccagccagttcgggagagctaaggaggggatgcctactctattggttcacatccctctcttttcccaatggcaggttaatggtagcattacttgaacagaaccagagcttgcttcggtgtctgtctgacagttacaggttcaaacagtgggttctcttcctcctcatggcttttgaggcatctccatggaaatggagagcctgaagcacctttttcagttgtcctgggagatgtagactctggcctgtaccagtagcagcttcccagttcaccatgctgccagctactgagtcccactggccagagaatcactcagcccagaacatgttttccactgcatttttttttaattccctcctccccctgcattcttaatgttagtaataaatcaattaattttacttattaaatcctttgctaattaaaagtactttttgagtacttagtattcaaaagtagtagtattatttctcatttacattaagatgaaagaggttaagtgagttgcttaaaaatcactagcttgtggcctggtgtggtggctcacacctgtaatcgcagcactttgggaggccaaggtgggaggattgcttgaggtcaggagttcaagaccagcctgaccaccatggtgaaaccccgtctctactaaaaatacaaaaattagccagacatggtagtgggcacctgtagtcccagctactcaggaggctgatgcaggaaaatcactgaaaccggggaggcagaggttgcagtgagccaagattacaccactgcactccagcctgagtgacagagtgagactccatctcaaaaaaaaaaaaaaaaaaaaaaatcagtagctggtgagttaaggcagggtttgaactcaagcccataccttctgttcagctactcggaattttatggaagtatttacaataattggtcagtgagtttaagtaattatgacctgagtaaatttagccccctaggtatatataatgtgatggtaacctttcttaagttaggaagaacctaaatagaaagactttttatccaaagttgcctaagcaggatattcaaagcttgttttgtgataaggttcattggtttgattattctgatcatcatattcagaaatatttttacactggcattgtttatagctgatattaatttgtttatccaccaacatttatactatgaaacactggtttgaaacactggttcaaattggttcaaaatattcttcaaatttgactggacagatgacaatttgtccaactgacctaataacgtatgtatttatgtgttattatataatggattaaatacccttacacccagccaggaggagcttctgctttaggctctgttaagaggaccttgctgtagctcttctgtggtcactccacacagcaccccactgccttctagatcacattctagaaacctgagaccatggaatttgctacccagagggcaatgagcatgcatctgggccctaaccaggcttcttcgttgatccatggtcctgagggttaaccatgtatcagtatacgcacccctgagaaaacaggatagccagggggcagctgtttgtgaggggtatggatgaagcttagatgtatgcacccgggtatcctcacacatgtgcaggagaccccttgcagtacaggatacagccagtagaatggagaagaggaggctgggtggggccagttttccctgtgctggaatgttctggcgcagcattccaaagagttcagaattctaaactcaaacatggtcttccaggtcattatgaaggtatttttatcaaggtatttaagtttgttaaaaacaagcaaaaataggccgggcgcagtggttcatgcctgtaatcccagcactttgggaggccgaggcaggcggatcacttgaggccaggagttcaagaccaggctgaccaacctggtgaaatcccatctctactaaaaacagaaaaattagtcaggtgtggtggtgatgcatgcctgtaatctcagctactcgggagactgaggcaggagaactgcttgaacctgggaggcagaggttgcagtgagctgagatcatgctactgcactctagctggggcaatagagtgagactctgtctcaggaaaaaaaataaataagcaaaagtaaaaacaaaacctcaacagttacagcattagaatatttaggcatgtggtatgtgggcttccatttgcactcttatagtcttgagctctgtaaatatccagggaacagcagtggtatgggatgtatttactctctaacattgccacatttaacaggtttcaagtataaataattttaaagcaatagcttgtttttctttgttttctttttcaatgaagtgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaacttgttaataatgtattggtatttttgaacccacaatctattttttcaggaataaggcagcattatgactaataacagtgtttggaagcgtggatataatttgctaaagtaagacttttgatgtagataaagtagcagcataaaaacacacaaatattcaagtagatgtcacagttggaaaatattctttggaaatatttctaggcagctgaaattacttatactgctaaggaaatctgctttttatttaaattagccacttaaggacaaggttttcaactgtgaaggttttaaggggttaggaagagcataagtatttgccccactattaaaaaaaaaacatgacatctgactataatgttgtattcaggctgggagtggtagctcatgcctgtaatcccagcactttggaagactgaggcaggaggatcgtttgagcccagaagttcaaggccagtctgggcaacatagcaagaccccatccctaaaaaaattacaaacaaaaaaaattaaccaggcatggtgacacatgcctgtagttccagctgcttgggaggctgaggtgggaggatcacttgagcccaggaattcaaggttacaatgagctatgatggtaccactgtacttaagcctgggtgacagagcaagaccctgtctctgaaaaatagtgatgatgatgatgatgatgataacgatgatgaggaagatgatcatgctgtactcagaactttggttgagaaagtcttctctatactgtagaattatcttgtaacaattgttatgataatccctttgtggtacttaggtaactaaacattttggggtatgatctttggacagactcctttcattctgaattccattgaatagcaaaaggtcttgtaataaagttcctgtccttgtgtttaataaaaaaaatacaccaga

SEQ ID NO: 10845 - DNA, 8737 bp, Homo sapiens
ttttgtttttgtttttttttttttgagacggagtcttgctctatcacccagctggagtgcagtggggagatctcggctcactgcaagttccgcctcccggattctcgccattctcctgcctcagtctcctgagtagctgggactactggcgcccgccaccacgcccggctaattttttttggatttttagtagatacgggatttcaccgtgttggccaggttggtcttgatctcctgacatcgtgatccgcccgcctcgccctcccaaagtgctgggattacaggcatgagccaccgcgcccggccccctcttccaagtttttactcaaaacttcattctcaaggaggccttacctggtcatcttaatttgaatagtgaaacacatactccttatctcccttgcctgtttatttttctccatcccactttctttcatatgattgtacaatatattttacttattcgcaatgcttattgtctgtcatctccattagagtgtaaactccaagaagtactcaataaatatttgaatgaatgaatgagtgaatgtattacagcattgctgttataatatctgctgtattgtatatttttccattttcacttaatagtctgtcaggttttcatctgtttttcataattatactttttgacagttacatttgagtgtatagaattaattatacaataatggattaaatcatgcgcctaacgacattttgcttttatttgtttctgttcaattcgtggcttagtgtaataaattcctggaagaagaattacacctttaaaggatgtaaggattttttagggtttttttttttttttttttttttttgagatggagtttagctttgttgcctaggctggcgtcaaactcctgggctcaagtgacttcctgcattagcctcatgagtagctgggattacaggtgagtgctaccatgcctggcagatgtaaggatttttttttttttcaagacagagtctcgctctgtcacccaggctggagtgcagtggtgcgatctcagctcactgcaagctccgcctcccgggttcatgccattctcctgcctcagcctcccgagtagctgggactacaggcaccccccaccacgcctggctaatttttttgtatttttagtagagacggggtttcaccgtgttagccaggatggtctcgatctcctaacctcgtgatctgcctgcctcggcctcccaaagtgctgggattataggcgtgagccaccacacctggccagatgtaaggatttttatggcacttgctcataatagggaagtgagcatttctctccctccctctctctttctttctgacaaatacttttgtgcccgtatatataaatgcattgtccttcaaatactttaggccctgtccttgaagcagggtaacctggggcattaatatataaacaacaattgcaataaaataatgagataagtgctaagcagatgtgtcagaggacagacaggtagggagaattagagaaagttttctgtgagagatcacagcatttaaactgagcggtgaaggacttaagtaggcataagtggggaaacagcatgagttagaggacagagatctgaaattgcaagacatctgttgaggcatcaagaagagggcttgggccgggcgcggtggctcatgcctgtaatcccagcacttgaggctgaagcaggcggatcacgaggtcaggagatcgagaccatcctggtctaacacagtgaaaccctgtctctactaaaaatacaaaaaattagctgggtgtggtggcgtgcacctgtagtcccagctactcgggagactgaggcaggaaatctcttgaacccgggaggcagaggttgcaggatccgagaccatgccactgcactccagcctgggcaacagagcgagactgtctcaaaaaaaaaaaaaaaaaaaaagaagaggacctgaagtgtagagtgggaaatgaaggcggacaggtagcttggggcattgcactgggcctcagatgctttgctaacatgtttggattttagtctgtacacaatacacaaaggtgttgtttaaaggttgtgtctcattcctttgtagctgggtaacctcagataagctacttaacctctctgactcttagttttctcatctgtaaagttggaacagcacaactacttagctagattataaaggaataaagagataatggatatgaagttcttagcaggatgcctgatgcacagtggatgtttacaaatgttcatttttattcctagtggtttatttaaaattgtacttttttttttttttgagacagagtctggctctggagtgcagtagcaccagctcagctcactgctcagcctcccaggctcaagtgatcctcccacctcagcctcccgagtagctgggactacagtcacgtgccaccacacctggctaatttttaaattttttgtagaaacaaggtcttgccatgttgcccaggctggtcttgaactcctgggcccaagcaatccacccaccttggcctcccaaaatcctgggattacaggtgtgagccactgcgcctggcctaaaattgcacttcttgcagaaagagaaagtaagatattttcacagtatacttagtatgatttaatagaacaagaaacccaaggttcatttcccagaatgttaagtaagagccatatcttttattgctgcgtagaatctattttgttgctgaggacagatccgcaaatggacctaccacaaattgttcatccatccatttgttgatggacatttgggctctcttcagtttttgctattacaaatcaagctataagcatgcatgtacatgtctatgtacgaacatatgcttttgttttgcttgggtaaatacctaggagtggaggggctgggtcataggatagttaagtgtttaatttctttcgttcttttttttttttttttttgagatggagtctcactgtgccacctacgctggagtgcagtggtgcatcctcggctcactgcaacctctgcctgcggattcaaacgattctcctgcctcagcttcctgtgtggctgggactccaggcgtgcaccaccatgcctggctaattttttttctatttttagtagagacggggtttcaccaggttggccagcctggtctcaaactcctgacctcaaatgatccaaccgccttggcctcccaaagcgtaatttcttatgaaaccgccaaactggtttccaaagtggttatacccttttatcttccctctcgcaatgaatgggacttcccattggtgcacatccttgccaacccttggtgtggtcagtcattgtaattttagacattccgagaagtacattctgttatctcattgggattttgattttgttttccctagtagctaacgatactgagtatcttttcatgtgcttcacttgccaatcatatatcttcttgggtatctgcttcaaatcttttgcccatttttagctgggcacggtggctcacacttgtaatcccagcactttaggagggcgaggcgagtggatcatgaggtcaggagatcgagaccattctggctaacacggtgaaaccccatttctattaaaaatacaacaaattagccgggcgtggtggcgggcgcctatagtctcagctactacggaggctgaggcaggagaatggtatgaacccggaggtggagcttgcagtgagccgagatcgcgccactgcacttcagcctgggtgacagagcaagactctgtctcaaaaaaaaaaaaaaaaaccttttgcacattttttttctttaatgggctgtttgatttcctattatagggttttgaaagttctttatacaatctggacacaagtgctttaccagatatgtgatttgcaaatattttcttccagtttgggcttgattttttattctcttaacagtgcctttcaaagagcaggtgtcttaatcttagtgaaattcagtttctcaagcgtttgttttttcttttatgaatctttcagcttgactcgttattggcatgagtgctggtgtacaatcagttgaagcactcacatattggctgctaaacaaaagtataacttttatctagaaaaggcagtttagaggtgtcaatgaacaatatatgaaagtatgggccagacgtggcggctcacgtctgtaaccccagtactttgggaggctgaggcaggcagatcgcttgaggtcaggagttcgagaccagcctggccaacatgttgaaaccccatctctactaaaaatacaaaaattagctgggtatggtggcaggtacctgtaatcccagccacttgggaggctaaggcacgagaatcactggaacctgggaggttgaggttgcagtgagctgaaatcacaccagactgggtgacagagcaagactccatttcaaaaaaaaaggagacaaagtgtggagtatatgaaagttgaagactatcttcggtccaagcctccaaatggctaaaggaggtatacaaaggaaatagcaagctagaatattgtttttcaatgattgttgaaataatggatctagccaatgatcatcagtaactgctagcatcacaaaagagagagtctggccaggcgcagtggctcacaccggtaatcccattactttgggagactgaggcaggcagatggcttgagcccaggagttcaagattagcctgggcaacatagggagaccccatctctactaaaaaaaaccccacaacagcaagaacaataatgagccaggtatggtggtacacccctgtggtcccagctactcgagaggctgaggtgggaagattgctgaagcctgggaacccaaggctgccatgagccatgggcacaccactcactccagcctgcgggacagagcgagaatctgtctaaaaaaaaaaatcctaattgcagaaattccagttgcttttgaaatattttctgtttgttttattatagttactaaaccgatagatgaaggaagttcaaaactagttcaatataggacccttaaagagactttctttgactgtcaccctttctgatggagggcttaggaagtgaaccctgattcaattggctcctggccttacttaggaaaaacagacaagaggttagaatagatgtttcgatgggtcctttcaaatccctgagcctgtcaatttcttttatttcccacagtttagtgagtggcacgatcatgatactatgctaggtggtacaatactgccacctatggagcaacagtagaacttgttataatgttaacgatgcatggatttttatacaatgctgtttaaaaatgtagaaaacttgccatccaaatgactcctttgattggtaggttaataactgcctctcaaacttatcttttgtggacatctgatttgggttcacctaaaaaagacaagtgtatggaaaatgtgaatgaaaatatcttaataaactttttgttttcttagtagaagaaatatggggactttgaattgaagataatgaaatcataatactttagttgtggaaggtacctaaagcatgattccgatgagtgctgtaggatcagtccagttcagtgttggcgctcacatgagatggatccatcagttgtagccacagtgaagctggggtagagtggaaaggggtcaggactagggagtctagagactgcagaggttctattacagactcagtcatgaacttactctaagactcagggtaagtaactgaatgttctggaagatgattatctcatctaaaagagtggccttcaaactttttggatagcatgctactatcaattaaaatatttgagcatagactctccatataactttaaaaatatatttataatgtaaatatgaattgctatcattaactggtatctcagggcacagtatatacttagagccagaccgacacagcatagtggcttaagagcatatactccgagcttagtggtggctgtgtgaccctctctgcctatttcctcagtagtgaaataggataatagaagaccctcgcctcatagggttattgtgaggatttgaggttaatatgttatgaattgaaaacagtgtctaagacatagaaagcactctgacaatacacttattattgtcattgttattatcatgaatatgtctgcatttcaaaggtccttgtggtcctttcagatatttacttgacttcttgccaatctgataaacaagtcattgcttttaccttattatgttctaagaatagaagtgtcattctgccatcttattattctcttgagaatgcattttcatcagattcagttagtagattctttgcaggaatcttttcaagccatttgtccactgtatgagtgttctttgattaaaaaagttaaaactgcatgataattttatatttcataaatctacttactagactctttggagactatctaaaagactagggtagctcctcatttccctgggtgagttattagagcttttaaaaagttacagatgaggtaagttgcttaaacttaaacgtgcttttggaattgcaggggaaactggaaaaaaataaacttcttattggtgactttaggaagagtaagaagtagtatgagaaagctggtctccacaactctagcttatatttaaagcacgattattattcacagaacataagctatatttatatgcaaacgtaagtttaaaagcgagggcatatagtatttttttctttcttttttctttctctctctcttgttttttttgagacagggtctttgttgcacagcctggactgcagtggcacaaacatagcttactgcaaccagcgcctctgtgctcaagtgatcctcccacctcagccttccaagtagctggaaccacaggcatgtgccgccatgcctctaaaattttttttttttgtagagacgggatcttgccatgttgcccaggctgtttttttcttttcttttcttttttttgagacagagtctcactctgtcacccaggctggagtgcagtggcaccatctcagctcactgcaacctccgcctcatgggttcaaacaattctcctgcctcagcctcccgagtagctggcactataggtgcccaccggcacacccggctaagttttgtatttttaatagagatggggttttgctatgttggccaggctggtctcaaactccggacctcaggtgatccacccacctcaaccttccaaggtgttgggattacaggggtgagccactatgcctggcctcttcttttgtttttttttttttaaacaacctttttgaaagcaggcccatggctgatcttctatctgtggctcagcaattgttgttgttgttgtttttagtgaaaattaagtaaatattaattgatgactttttttttttttttcccgagatggagtcttgctctgtcacccaggctggaatgcagtggcgtgatcttggctcactgcaacctccacttcccaggttggagcaattctcctgcctcagcctccggagtagctgggactacaggtgtgcgccaccatgcttggctaattttcgtatttttagtagagacagggtttcaccatgttggccagactggtctcaaacctctggcctcaggtgatccacctgcctcggcctcccaaagtgctgggattgcaggtgtgagccactgcacccggcccatcttaactttttaaagtgtaagttcagtggcattaagtacattcacatttttgtgtaaccattacttccttctgtctccataacttttcatcttgcaaaactgtaaactctgcacccagtgaacgctaactcctcattgccccatctgtccccagcccctagccaccactatcctactttctgtctctatgaatttgactaccctgtgtatacctcatataaattaaatcatacaggctgggcatggtggctcactccatgtaatcccagcactttgggaggctgaggtggatggatcacttgagttcaggagtttgagaccagcctgggcaacatggcgaaaacccatatctacaaaaaatacaaaaattagctggatatgatggcgcacacctgtagacccagctatggggaaggctgagatgggaggatcgcttgagccctggacgtcaaggcagcagtgaggcaagactgcgccactgcccttcagccagggtgacagagcgagaccctgtctcaatcaatcagccaataattgttctttgttaaagatgacagcaacacataatgcaaaaaaagaaattttttaaagaaaaaaatgatcatacagtattagtccttttgtgcctagcttatttcacatagcataaggtcttcaaggtttatccgtgttgcatgatatgtcagaatttctttttctttttaaggctaatattctattgtctgtatagaccacatttcttttttttttttttttttttgagacggacagctctgtcgcccaggctagagtgcagtggcgtgatcttgcctcactgcaagctccgcctcccaggttcacaccattctcctgcctcagcctcctgagtagctgggactcaggcgcccgccaccacacccggctaattttttgtatttttagtagagacggggtttcaccgtgttagccaggatggtctcgatctcctgacctcgtgatccgcccgtcttggcctcccaaagtgcggggattacaggcatgagccaccgtgcc

SEQ ID NO: 10846 - DNA, 8774 bp, Homo sapiens
agaacttgctctcttcctgcacccagggctttaggaatcagcccgttgcttctctgtagcaagcatgaggagcctctgatgatcccagtcttgggtgactcactgtctctctgttgtgtctcaaggaagggaggtgcagcagcatcctggcagtcagtggtgacatgcggagagcccacgggtccaggcgtcctggtggtattttggaagggccaaatctctggctttagcactttggaaacttgttgatcttccttggtcttctacggctattcattgcttctggggaatggtgacttgtgaatttttagcagccttttcctatccccaaaacccatttgtataagatgggtttgcttctgctgatgcaactacgtctctaaaatgtccatcttacactccctattgcaattgaagatccaatatgtaagagggtggaggaggaagtgaacatttgtgaccttttgatttgatattctggccatatgtttaaatgggggtatgcttctgattttaaatccagccttcccttgtttgatttcttttaaatgttatctctctttcaactgtgttgtcttatttctatttactgctttccccctctcctccttcccaaataacccctcatgcctgttatttgggatgctcttcccaggctttttgttatttttgtttctagaccttattgcgggaagagaatcgtgattgtttggttgccttctcttcatagcttactccatttttgttttgcttgtggcagtttcttacttattggagttcctgagccattatgttcactgattgagaaagattcataaaggctatttttatgtgttttttttttccttccctcctgctttgcctggagctccccatggctgagagttttctcctgtggccgtggtgctggctgtcacgtcaggtgccatgggagcctgctttgacacacagacccgagtcagaccttaaaaatcagggcaaaccatcttgccttgttcctctagtcaccatcacttttgtactctggatttgtcctgcctacctttaatctgtgtctccagcatttatttttttgtttgtgtcatcgggttcctggttttcttttaagacatagtcaactgtgtggacctgtaggtttggggcagcaaccaattccattgttttcctttttgtcaaatccaagagaaaatataccataaggagctagaagattctagttcacagccttttgaatcttcatggcctttgaatcctcatggcctctgaaatctgaatcagttttctcccaggaggtctctgggggctgagctgctacaggggcagagggtggggtggggttgggtgggagaatcatcccggcacttcatcgtgcatgctatttcgggcagcatcttttttttttattttattattattttttttcctgatgcttgagttatgaatgaggatgacctctgcaatcatgatgtctcccatagactctgttccttgttcctttgccagctttctcatgcatggtcctaacacttccatgatttaatctgctgcagaccatagtcttcagccacctcagcaataacttgttagaacattaaaaggaagtaaattgagaacaacttgttgccatcccattttcattagaaatcagacatcttagagatgtcaagaaagcagctagcagctagggggtatggggacctgtcctgctcacactgctgtgtgtcagaccagacctgatcctggagctcaggaccctagagagccctgatctctggaactcttgccacgttgttgctgaggcagctgaagtccccatctcccaccataacaatcacaaatagacagtagtggagccagcatccccaggcccctttttgtgtaagcagaaagggagctgtgagccttgccctgtttgcaggtttcaagtgcctctccctgcctgtacttctccccttcctctgagcagagctttggtagctgttgccaatgcaaagaaatgtaaagcagcaaaagaagacagcaggttctgacctgaggagggaaaccaaatttatcccacaaaggcccattaccccacccccctcgcctcccacccccagactggatccactactggcccaagaatactgatgagaaacctagtctggattgggtcggaagctggaatttggtgctctgcagaccagtgctcaaaattgtggttatttttgaggactcgccttcaatccagaacatttgcgtttcaccttcctcgcccagatccagttaacaaggtagctcatcacttcttgcatctgttgagtgacatgctggattttaatttttattgtggttgtacttggatgcaaggaatatgttttgttcctcccaatttagcgcaccatcctgggaagtgcatgtctcagaccaactccaccttcaccttcaccacctgtcgcatcctgcatccttcagatgagctcactcgggtcacaccaaggtaagggaccctggctttggggtgggcaggggtggggtgaagtcagggcactcccttccctgcaaggcttaatgttgaggaaagccaagtagagaggctcatagaaaaaccaactgaagccagtgtaagcatctcagcatttgcaggcacttgttttgggtcccatccttccttttgttgttgttatgtgtttttttttttttttttttttttttttgaggcagagttttgctctgttgcccaggctggagtgtagtggcgtgatctcggttaattgaaacctccacctcctgggttaaagcccatttttctttttgagtggaggctattatttatttggatctggctcaaataaagagacctggaccgacccacctttagttgcccttttagttggctatttagttagaaatggattcctaggccgctccttaaccagctgaagttgacactacccaggccctatggctaaagtctgttggattttttgcccccaagtttgtcagtagagcacagagttcttttatttatggatggagttactgagccctgtggaaccccttgtgcctctggaataggccccaggaaccatgcagcacagccaaacggtaatgaccaaaatgagaagactccaaaattgagccatgtgcccagcatggtccatttctctctggagcaccatctatggggaggacttgtctggggtgagttggtctgtttggcctgatttcaggcctttcactgctgccagcaaaagagaaaatgctctcccctaacagagtagaacgaccccctcagctgtttcctctgtggtgtaagatgctgggttgctggaaggtaaagcagaaggggtgggaacagtcagccagggagcaccttaaactatgaataattctccgcaggtcatgtgaggaggacgacgaagcagccatatgccccgttgagctgagaggagatatagggcagagagtctgagcccacgggcgaggcagggggtgagcacaccgccagcagtgcctgccctggcagggccctgtggaaggagctgtgtgtgcacgcgtggccgccactaacccggggacttaggcttggatgtgtctctgtggttgtgcctggctaactcggccttgatggtcgatgcccctaacccagctaaacacccccagtcaagccgagtgccagcactaataaaggcctaaccctaagttctcaccagacggggatcataaatattagctttgtctcctccgtctctctgcccctggagaacttggcttcctcatcctgtggctttatgttgggaagagattgttttcaaaaccatggaaccaagcttctccctatgagaggctggtgccctgggtaactagatggcactcctgactgtagccataggactcaaaccaaacacaggttttcatgtggctgtgtcagggccgaacaaagcctgggaagtcagtagcaagagaaggctcttttttttttttttttttttttggcttgagtttgaaagaaaggctgcttgaaataaaatggaaacaaatcaattgaatcttttttaaatggaaacaaaatctccctagggatggccacatcaacatgattttaagtctagagcatttttgccctttactgagggtacatcaacatttgtaaaactccacaaatgccttctgaaaaaatccatgtttaaccttaggaatttgttgtggtttctaatcatgcttttccgagtcccccagcccaccagcatccccacccctgagcttgtgtgagatgggcctgttctgggatccccaccctgtgctgacctcccagggctgaggtcacctgaatgtggggccagttggttcccctagcttgtacgttgctttgaacctcgtgtttcccacgagggagggggccccttctctggtcatcgcaaagacctgctccagaatgggcccttttccttcccattccctcctttggtgcctttctcagagtacatggacttccttctgccagactggggagagaagtctccatccccagctcctagggaccatgcagctgacctgctccaaggcacactggcagccccagcaaaatcctggagccggcaccagggcatgtcccacgagactgttaggagggctgtgcatctttgccccttggttgctcattgagaagcagtatagggcttccatgcctgtttggcctcccctggatccctgtagcagctgttaaaagagaacctttccaagctttgcacagtggcagtatcatagccaatgaggtttattactagttgaaaattttccccaataccccgccgtgacgacttgagatagaggcagcattggcaatttttgacagtttttagggatactgaattattaggttggtgcaaaagtaattgcaattataaaaaaaaaaaagaacctttcctgctttttaagcagacaacaatgcattcccctctgctgcccttctggaaacttttctgtcctaatggactccacgactggatcccaactgctggaacctagcaagtccctagtgagcacaacacgagtgaatgaacaaatctttctgctttccttccgtaactcaggccccacacatttcagtgggcctttccctgggtagcaccgttgatgtagatctcttcatatgtgacatgtctccccgcgaccctctaactccactggttagaatggatttgggcaaggatataaagagggttaagggcagcacggtgcagaggaaagggctctgcacccaggattcaggagctcacggccacaactgactggatgggcacagcctggcctcagtccatgcactgtggccaaccttacccttcctaagataaggagtatctcatctcccagagtcctggttcacgtcttgcttcagggagaagtaggtactaagaaggaatgctggaatctgggtaaatttggtggagaaagaatgcctctttgccaaagggcttcctttcccgttctctaacagatttagagtccctcaacttgggttgtccacttaacagccagatgtgacaccaagtaaacccttagctctgagcctgtttcttcatctgcaaaggggacaactgtacccaccaaccagggatgggcaaaggggatcatgtgcagcttcctgttaacttaaaccatgcttcccttgaagggtgagagggaggagcagacgtggacagagcctttgggggcctcagctggtggaaccctctcatcgtgtcctgggtcgtccctaccccccctgcaggaaactggccactgaccctttctctggagctcatgggcatttctggtgaataacctgtcatttcttctttcagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacactggtattctgatttgtattttgtttttatcttttcatcaaggagacgatctctttatgtaagacttgaaagtgtttagctctttgcaaaattaaatgaaaggcatatacttca

SEQ ID NO: 10847 - DNA, 38771 bp, Homo sapiens; identical to SEQ ID NO: 6652
  misc_feature (7892)..(9416): n equals a,t,g, or c

SEQ ID NO: 10848 - DNA, 1524 bp, Homo sapiens
gcaaaattgccttcaaaggctaagtctcttgtattctgcccttactgagagtctgtactctcctaaggttaattggcttatcatattctgcttttgtgctccctagtttaccatgatgcttggggtttttgcccctacgcttttcactttgtcttcctgtaatttattacaaccaacccttgtgtttttttttttttaacagttttggatctgcattaattttttagtccccagaggaacactatgttcccaaacattatgttctgcactctcatgctcatatcactttgtgtagtgccagacacctcctgggatctcaagaaatgttgtttctttttaaaagatgggtgattactctaggaggctcataaaagatctttctcagttgagttactttcactgtttatgtatcccaagtggcttaggtcaaaatattggttaatagaaagactccaagtctttggagaagctttactagtgtctcctcatctctgtaaaagcaaagatgagtattgaatggtcttacaggagtgttggagagaaatgatgaaaagcattagaaatgagaaggcctttgttgaaaatatgaaatgccagagtgaagacagtatcattattcccaagcaggcctcagtgtaagcggagctctctccaccaattgaagctgttcatcactacaaagaatggctgtcctgcaggatcctttctgctgctggctcctactgcagagaatagaaacttctttctaaatactgtatccaaaatgtttcctcttctctcaacttctcagctctatccaggacacttcactgctttcctccaaggcaaacttgaaccttcctctaaattccttccctgaaggctgttttgaggcagagggataggaccatggacagaggcttagcctaccaatcactcacacagcaggaaagtcaattctcttcctaccaggaatccctgggagagggtgtttacatgaatagactcttctttaactataggtcacttttcccttctctaacttcctttggagtgatgctgtgtcttctagaaacactgactccttccagcaactctctgctccttagacatataagaaatactcattcttgcaaatgcagttcttaaaatatttcaaaacatcttcattataaaatatttcaggcaaacagaaaactatgaaaaatagtttaacaaacatctatgtgtaaaacagctaccttagctgggcgcagtggctcacgcctgtaatcccagcactttgggaggccgaggagggtggatcacctgaggttgggagttcgagaccagcctgaccaacatggagaaaccccatctctactaaaaatacaaaattagccgggcatgatggtgcatgcctgtaatcccagctactcctgaggctgaggcaggagaattgctggaacccgggaggcggaggttgcggtgagccgagatcgcaccattgtactccagcctgggcaacaagagcaaaactccgtctcaaaaaaaaaaaacaaaaaa

SEQ ID NO: 10849 - DNA, 1524 bp, Homo sapiens; identical to SEQ ID NO: 10848

SEQ ID NO: 10850 - DNA, 102 bp, Homo sapiens; identical to SEQ ID NO: 8430

SEQ ID NO: 10851 - DNA, 5775 bp, Homo sapiens; identical to SEQ ID NO: 6656

SEQ ID NO: 10852 - DNA, 738 bp, Homo sapiens; identical to SEQ ID NO: 6657

SEQ ID NO: 10853 - DNA, 156 bp, Homo sapiens
ctgcctcagcctcccgagtagctgggattacaggcatgcagcaccacgcccggctaattttgtatttttagtagagacggggtttctccatgttggtcaggctggtctcaaactccctacctcaggtgatccgcctgcctcgacctcccaaagtgt

SEQ ID NO: 10854 - DNA, 217 bp, Homo sapiens
  misc_feature (198)..(198): n equals a,t,g, or c
ttttttttttttttttttgggtggagcttcgctcttgttgcccaggctggagtgcaatggcgcgatcccggctcactgcaacctctacctcccgggttcaagcagttctcctgcctcagcctcccgagtagctgggattacaggcatgcaccaccatgcccggctaattttgtatttttagtagagacggggtttctnccatgttggtcaggctggt

SEQ ID NO: 10855 - DNA, 3104 bp, Homo sapiens
ggcgtaatggtgtgatatatgcttaccacaacctctggctcccggttcaagcgattctcctgtctcagcctcccaagtatctgggattacaggcatgcaccaccatgcctggctaattttgtatttttagtagagacggggtttcttcatgttggtcaggctggtatcaaactcccgacctcaggtgatccgcctgccttggcctccaaagtgttgggattataggcgtgagccactgcgcccgctatccacatccttctagagtcagaatggtagggtccgttgacttcagcttttgattttgcaggatggccctgtgtcctcctctgccccattccctggttcattaaccagtttgaagtgtatgtagattgttgccccgtctttcccagttcacatgtgtgagatgcctgggtgctgcttcagaaatcaagatgatctcctttaatttgcatgaaactacaccatgctgcgttccccaggcagacagttctgctttgacacaccaaagaatcctgtaggctagcagagccgccagcacaaaccaagggcgctgggtgtcgagactcagaggggtcagctgtgtccctcggcatcagcgtctaccaaggtgctgctaggtacagagccagccagtgttgggcagcaggctcacagcctcaatagggagaaaagacaaaggcctcaaaatgacaggcagcctgacagaggaaggagtctgacacctcagcttgaggcgtctttggaattcctagctcatctcagaattatatcttagagtgataatatgggtggtagccagtggccaaacagcaagaactaagagtggcccttgcaaaaaaaggttgggaaagctgggcccatattgcctgtaaacccttgagcctgatgctcatacagctgtcccttgttttagccaggtcttgacagaagggttaccagcactgtcactgctctacagaatgctctccccgtgcctctctgttgatttataacagttgggtaaccagatagcaatatagtggcaattgagtagccatatagtaatacaggggcagttggttaaacatatagcaatatcacataatgatatgtttaatttaacctcagttttttaaaccagaatgcttctaccataaaagaattgtgatttcagttgtacttccatcaaggaatatgtgggaagatacacatattgtcaaaatggttgggatgggatagttacaaaggacacttttgtatgttgtatgggatcacttgcctgatagtataaggaacattgtatgaaaagatgaaaagatacttcatttttagaaactgatcagagatgtcactggtctttaagtgatgtcttgaaaatccagtatgtatttgcccaaaagttttagcctacatctagctagcttacacttagcagccaaaccatcattgtgtaggttctgttttggaggaagctcatgggggatctgtgtatttcttaggtttctccctgttctccaatgttttatccatttcgtagcttttttactgtctccagaaagtagtgtgggacctgcacttaggggaataccagaatcatagcgtggttctgccttcttgatgagtgattgtgaaaaacacctgcataagggtgctaattggttgtgtattttttcatttatttgaaatcaaactgagaacacctcttttcggtttacagcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttagatgttttctcacttttgtgacattaatttatcactgagtctcattcaaccaagtaatctaaaatactgtgcaaattctagcagtatgtcttcgataacttggatgttaggatagccaatatgtacaaaaaattaaatcaagtattttgtcctatgtataacacaaattaattttacacagagaaagatgtttctaggcaagtgaaattctggtaattcatactatttctttgtatgaacaaataaaatatattttgccaaca

SEQ ID NO: 10856 - DNA, 226 bp, Homo sapiens
ttttttcctgagatggagttttgctcttgtcgcccaggctggagtgcaatggcgcaatctcggctcaccgcaacctccgcctcctgggttcaagcgattctcctgcctcagcctcccgagtagctgggattacaggcatgcaccaccatgcctggctaattttgtatttttagtagagacggggtttctccatgttggtcaggctggtcttgaactccgacctctg

SEQ ID NO: 10857 - DNA, 119 bp, Homo sapiens
ctgcctcagcctcttaagtagctgggattacaggcatgtgccaccatgcctggctaattttgtatttttagtagagatggggtttctccatgttggtcaggctggtctcaaactcttga

SEQ ID NO: 10858 - DNA, 707 bp, Homo sapiens
tttgcttgcgtttctcagggacctgatgcccagaaccctggacgggcagatcaccatggagaagacgcccagttacttcgtcacgcgggaggcccctgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatgtatgtaaaatgta

SEQ ID NO: 10859 - DNA, 5142 bp, Homo sapiens
aaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatattctagctcagctttactcttcttccacactaggctgggccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagatcttttagactctgacatttatagcatcaccttcaggaacacagttctggggatgtcatcatgagacacactgacagctgtggagatagtccctactctcagctttccttgctagtcaagtccaaaaggccttagaagctgactcaccttctcagccagagtcctgctgctcaagtgtggacctccactttgactctcacccagcctgccagccatcacaaaggctttcataaacttcctgtggtctgggctagcctggcactgatgaaattccattctaaagaaagaaaactcatattcctcccccccacaaattgttcccccaaatgctctgggattacctatttcaccactcatttgagtctccgaaaaatgaactccctgagaatggctggatgggaatcagatagtctgcttccattcaggagagggacagaacaggagctgctgtgtttaggaggatttacctggtgccctagaaagggctatgcaatcaaattctcaagggctccttcaaatcagctatcagtcctcaaaatgggggttgctgatgttaaatgatggatttgcagtgaaacgcatgcatgtactgacgttttctttcagcattagtggttgcttaagaaaatagtaacctatattttctgctacacttggaatatgaagaaatctgaacaagaaccccattaagacacctaacctaatctaaaccctaaaattcaaaatattgtccaagtcaaaagtctagactctgaggacattaaaaatgtaaatatcatcatccttagcaaatatttattgggagcttagtaatagtgcactgggtaccttagcactcccaaatcattcaagagtctagtgaaaaagggggagggatggcagcaaataaaacacccccataaacaaccaggagcaaggttgagaaccattaagttgccaaac

SEQ ID NO: 10860 - DNA, 1123 bp, Homo sapiens
gagacactcgggtatttgagaactttgcttgatttagaaaactggaaagtggcaactaggctagaatagtggcaactaggttcggaggtttcgtgtggtcataattggtttggtgaagtgtgagatctctgcaaatgagccaggtaagatcagtattccatagtgcttgaaaaggggattttagagacttctgtcatcacaaagcagattaactcctagttaatgatgaagcagtaggcccaagataaactgttcaattcaagataaattgttcttgtcagtgtttggcatatgataatcacatttggctaaaattggatgggacagtcatttgtctacacaggccttccattcctgcatgaagagatactggggagcatacaattattttgtccagtattagagtgggagaagttctcagtaagtccagtcccaccaggatttatttgggccacattctaccacggccagtccaatctgatgaccacatgaattggggttaagtgttgctaagactatgattttagacatgtctggcaggaaggtcagctcaaaatgtggcatgacaaagaatatgtgctctactaccaaaacctttcctagcaaaacaaggccagaagagggagcaagcatctttccaagcatggagaggagggggcaatggtggaagggtgattgcctgaaatcagtgccagtacagatagcataaaattggggccaccacagattggctggctactgtgtagatcatttagtaatcttgaggtacattaataatgcagagattacttttctgtgagggtaagggggacgtagctaaatataagaagcttacaaggtccatagccatgtattttactggataaatcacaatgctttgcaataacttaatgtcatagtactttctggcttataattctgcaaagtaaagcactttttcaaaggagtctattggaaagccacatgatttcagctgtgttttaagctctacaaatacgtttccaaagacataatcaagatgtaattctattcattacaaatataaatattaaaactatccatagagacatttaagtaattaaaacagatttttatgctttaaaaataaatactctaataaatg

SEQ ID NO: 10861 - DNA, 27382 bp, Homo sapiens; identical to SEQ ID NO: 8115

SEQ ID NO: 10862 - DNA, 88 bp, Homo sapiens; identical to SEQ ID NO: 8116

SEQ ID NO: 10863 - DNA, 2208 bp, Homo sapiens
cagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaa

SEQ ID NO: 10864 - DNA, 419 bp, Homo sapiens
ccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatga

SEQ ID NO: 10865 - DNA, 1905 bp, Homo sapiens
atggaaatatggttatgagaaatggaaaatgctagatggaaaacctcaaatacctttacaggttaaaaatatctttactaaattttcccatgaaaacattttgtgataaaatgacaagggactaaaatgaagatcattgatacaatagagttactttccttgttacaatgcaattgtcttataagtcattattcattttaaggaaaatcaaaaaaattagatcttactaaaaatgtagcatttgattttaagtagcaagatgcaattttgtgttccctttttctttgttacattaacataatatagtagatagagggtttattgtatagacatacacaaaaaaatagtattcttaggccaaattcacacatatctcctcactaagtagttcaattagataatttctggaaaaacatgtttttgacattaattgctatccaaaactatattttaaagcagtcttattggaggtgtccttaacatgatgtaactataaatttgatgcagaaaggttttacatgctgtggttaaatagctttagaagacatttttaagtcaccaccagcctttattcttagaaaacaatttattctaaatgatgatgcatatagaaaaccagtgtattcttttatttcttttaatactggtggcaaaataggacgtgtctggaaaaccataaggctacttgggatactgtcccattagcattgctgtttccatgacaaaccctattttcagatggtttgatttgcctattttttttttaaaccagctataaattggggtcaatttcccccctcacagtgtacttaatttagcttttggagtaaatatataagtagtatgaaagacttctgaagctcttctttctaaaaaagcagttttccacttaagctttgtggggacagagagtcatatttttaatttcagagccagccagtgtcaaacacgtgcaaaagagccgggccggattttttcagcttgtcctatggtagtcacttgtcagcctgagtttactggcctggtccttttgtctccactgtaagtactgaagccttctggtgtagttgtatcaccttaatgtccagcatttaactaggaaaggagactacaatgaagagttggtggccaattaagaaaaataatagactacatcataaatcatttcaggacttgagtggccgcagatcactgtccctgatagcatgtttcaaccttggtatacattttttttaagatgcatatttactgtgtgtgcttttgctttctaatccatctattgactattggccacaatttatataatgcacatgcaattaattgaaacctgtgtcatggcattggatatctctgattcatttcttattataatagtctgtgtaactggggcctgagagattagaagcaaaatgtagtcgtacgtatgtctagaggtggacgctggtgatattgtcattgaatactttgcagaatacactaatgtcaaaggcttgcaggattaatgtgtaggaaccaacataagacatggaatatatataagaattatctagttacatgactaaaaaggaattgcaatactatcttaaattgaaggcttttatttcaatgtccttacatttaaaatgggatcttacaagggaagtaccaaaaaagtaaagtttattttgatgactctcaagatatatatgtttgttttgaatgttggcagatgccaatagcccttaacatttgaaaaatggtacttgaacatcaattatgtctcagagttcccttaaactttttgggcttaaatatttttattcattttggtcatacctttgacaatggatatgttaaactttaacaattatagtgacaaaacagcttgcttagaacctggaaattaaaacacaatttctagagtaa

SEQ ID NO: 10866 - DNA, 2827 bp, Homo sapiens
tttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactggctatgtgttcataaacattttaaacagc

SEQ ID NO: 10867 - DNA, 738 bp, Homo sapiens
gtcataattgctgccataattcctgtttgtctatctctctctcccctaggctcagaattccttgccaacagtggctgtgtctgatatgtctttgaatcttcagtatcgaactcagtgcttggcatatttgatgttcataaaatgtctgttaaaagaataaatgaatccaggactcatgtttctaataagtatagaaattgctctcttaccccacataagtcttgcatatccttggtcattggcaatactagataaggatatgctatttaagtagcctaaacttaaacaatgataaagctacattactgcatgtttactgaatgtcaaacagacttctaagtgctttgtgtttactaactcatttaattctcacaaatttataaccatttggtaggagaggaaaccaaggcatggagaggttaagtattttgctcaaggccacacagctagtaaatggtggaactgggatttaaactccaacaatctaacttcagagcaatacagccttagtaaagcagtctcacatccatcatctgactcaattaatgtatcacaagatagtaatacctacgtatttattataatgaaagaaatcaagagccaaataaatcaagttgttagctatagtctccaaagaagggatacccaagatgcaacccttccagccacttcctgcagccatgcttggttcctgtatatgcctaaagacccctcatttaaaaaaaaaaaaaaaaaagg

SEQ ID NO: 10868 - DNA, 49642 bp, Homo sapiens
ggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaaggtagcgcatcccacctggcgggccaggggtccagccgcgccggggtggtgggggtgggctgcgtgaagaggcggtttctgaagcttaggccgcccaactcggcttataagtggtaacgcgtgctgcgcttgcagtgagcctactgggctttctgcagctgggggattggtatgggtagagcttgcgagggcgagtctgtgtgtgtcggggagggtggaggtgatggtgcgggtggaagttgcctggcgtgttcaggtgagaatgtctgtatttgagggctctgaatgagttctgggccggctgtccagagagagctcccagcatgtcacttgcaaagctggggatgaactgcattgcgtgcgtgcgtgcgtgcgtgtgtgtgtgtgtgtgtgtgtgtgtgtgagagagagagagagagaatgacgaggaggaggaggagggaagtgagatggcggaaaggaaaactgcttaaatgatttttaaaggtggtgatttttgcttcctgctatttggttagcaactcctgtcattttgcagccttgctaagatctgacaagagtgcttaggtgactttattcttctggatgtgtgcagtgggaaactgccttatgcagtgacacagtgcggatttctaggcagtgtagccctggcttgtagagtgcgttggaggcctatgtatgagtggtggcagaaactagccgattatgcctgtagtgcaggatccgtttaatcagtggagagagaaagatgaattcgatgaattcattgcttccatggcgattacacttctaaaggtgaaatatgatcattgtaaattggcagaaccatttagtctttgttttctgtgccctagaagattcatgatttgatacaattaaaagtcagtacaataggaaatcttggttattagtgaaatgttggcacttgacatttatacaagcttctatgaatctttttttcctgtattttctaattcttttggcatataattggaggattgggaaaattattttccctttggttgggtcgaaatggatagttatattttgggggcgacaatttacttttgttcataatgcagtggatttgccatggttgtttgccgtacagcgtagtgggcatatactataaaacaaagattcagttatattcgtatttatctattttgagaaaggaaggacatatttaattgatgctttcacttaattaccttttatttttgaagaataaggttataaaaggagaacaggggagggatacatagacacctagtaatgtattttagtgacctctaccaacagataaatggaatgtgccattaggaaaacaaattcctagacttctttcctgaatttttgcattagcaataattcattttaaaaagtattttagaatcaatttatgttgagtaggttagcttcttgattcttgttacatcttctgttaggtctattggaagatttggtttattttaggagtgtatcttggctttattcaaattcccttatgtcctcatttgacagatcttgagtcacagtgaagcaacccactggagtgagcattgctgcatttggagagtcagatgccattttggtgactagaacccccccccccatttctcatattacccttatacttactcatattccaataaaatacagcacatggaagagagaggctgattcactacttcttcctccaaatttccattgctttttatttattttattttttatttttattttttgagacagtttcgctttgtcgcccaggctggagtgcaatggtgcaatctcggctcactgcaacctctgcctcccgggttcaagtgattctcctgcctcagcctcccgagtacctgggattacaggcgcccgccaccatgcccagctgatttttgtatttttagtagagacagggtttcaccatgttggccaggctggtcttgaactcctgacctcaggtgatccacccgcctcagccttccaaagtgctgggattacaggtgtgagccaccatgcccagcccgaaatttccgttgctttttattaataagcttactggggatcaggttatgaaatatcagttaattcttaatgagaactagtaactgctggcttgtaaactttattaactactgttgatggtagaatcctggatcctcaatttcttttcagaagttcgttttacattttaccaggtggcttcagggacttggtcattgtattaaaaatgagatgacaatgggtcagtcatctttagattatgacaaataggcatttgttgaggcctctgtttatccaatttatgaattacctatcccattccacccctccaagccctctcactctttttcccctgctgttttctaattttggttgtcataatgatcatttggacaactatcagattgttgaaggaaaagacgtttggatcaataaattgttacctgttagcgctgataaaaaatacatttcattggaggaggaatttaaaaagtgttggctaaaatgagaattgggtttcagtttatttacctgtattcctgtgtcctttcctaaaaaattggaagttaactgtacaggatatggtgagtgattgctcatctattaatatccagttagatgatgtggcatagactatcgacctatgagcaggtatttttgcaatgttccaaaatataactctttggcaatgacttttatttttaaattcttatacttatttaggaacatttattagttgactttcaaggtatgtgatttaaacttcggaatagaggctgggtgtggtggctcaaacctgtaatcccagcactttgagaggccaaggagggaggatcacttgagtccaggagttcaagaccagcctgggcaacatagtgtgaccttgtctctacaaatagttaaaaaattagctgggtgtggtgttgtgcatctgtggtcccagctactcaggaggctgaggcaggaggatcacctgggcaactgagcccaggaggtcgaagctgcagtgggccatgattgagtgccactgcgctgcagcctgggtcagagagcaagaccctgtctctaaaacaaaacacaacaaataaacatcagaatagagaacaagcttgtgttctttttacttcgtacaagttttgttgatcctggggtttttaactgtcctgggcacgagtcttaccagtttctgggaccactaaaccattccagtaatttcagtgtgggaaaggaaactgctttggggctgcctatttaagaaatgctatgattctctctaggctcaagatgtgatttcttcattacccaaagccctggggttaatgtgacttttagggtgaacttttggactaacttaggtagtgatagaacagaggacaaaactactgaaaattccagatatgtcaatggtaactctggctgattgaggctgggttccatttttgggtatgggtcatacttcctttgtacttggggtcatactggtccaagttttaacttctagctcagcagttccagattttatcagtgtgtcaggaataattgctaagccaccccgtcagagactgtgttttaaactggacactatcttatttaccatgaaaggatctacagttgtcctttggtatccaggggggattggttccaggaaccttctggggtactaaaatccacagatgctcaagtccctgatataaatgttgtagtgcttgcatataacttatacacatcctcccttatactttaaatcatctctagattacttataatatctaatacaatgttaatgctatgccagtagttgttactctgtataatttagggaataatgagaaggaaaaaagtctgcacatgttctgtacagatgcaaccattcattttttactgaatattttctttcctttttattttttttagagacggggtcttgctctgccacccaggctggagtgcagtggtgcgattatagctcactgtagcctcagactcctgggctcaagctgtcctcccacttagcctcccaaagtgctgggactacaggcgtgtgccacggggcccagccattttttcgaatattttcaatctgcagttgtttgaatccacagatgcagaacccatttctaatggagggctgactatacctttctgatgacctaaatatttgtgtccactattgggacactcctttcttagtgtcaaggtttgtgagaaattgagggctgtttgatgggcaaagatttatttatttatttactggcttatctacaattgagacagggtctcactatgtttctcaggctagttctaactcctgggctgaagcagtcctcccatctcagcctcccagagtgctgggattacaggtgtgacacaccatacccggcagagcaaagagttaagagtacaagacatttgatcatcttgaggagtatttacttcagactgaaacaccacatgaaattctagagtccaacagaaagtgtaataattttttgcttttcccttcttctgctacatcctatctctgaaatgtttcaccccacccaaccactgcctctgttccaactcctatatttttaaatctacatttaaatgtactttttgaaaaaggtagcactttcatgtagttcaaaatccaaaaggtccaaaggggaatatgtacggtataaaatcattctgctgtccctcatctctgagccaccattttcactccgtggaagtaacaattgttggcaatttcttttcttttcttttctttttttttttttttgagacagagtttcgctcttgttgcccaggctggcgtgcgatggcaagatcttggttcactgcaacctctccctcctgggttcaagtgattctcctgcctcagcctctcgagtagctgggcgcccaccaccacgcccagctaatatttgtatttttagtagagatggggtttcaccatgttggtcaggctggcctcgaactcctggcctcgggtgatccaccaacctcagcctcccaaagtgcttggattacaggtgtgagccaccacacctagcccattgtcggcaatttcttacgtgacttttaagagataatgtatgcatagacaaacaattacatttaaatatattcctttgcagtgcttttatgcaaatggtagcatattacccacagctcttgacatctgtatttttcaatcaacagaacatggagagcatacactttccatgcacattgaggagtgctttgttctttgaaggtattttctaaggctgtgaccaagttatcttgactaagtagaaagctattcttaaatgatttggaagacactgttgtctctcttttttttttttttttttttttttgaggcggagtcttgctatgtacagtggtgcagtcttggctcactgcaaactccccctcccgggttcaagttctcctgcctcagcctcctgagtagcagggattacaggcacctgactaatttttatatttttagcagagagaaggtttcaccatgttgtccaggctggtctggaactcctgacctcaagtgatctgcccaccttggcctcccaaaatgctgggattacaggcatgagccaccatgcccagcagacactgctctctttgaaggcatcttagaaagtgtcctaggcccatagacacatataagcctactgttaagatggcagagaggcagagtaatggaagagtctgtagacttggtattggaacagccagttaaattcctttactttgcttattgcagcttggtgacctgattccacataccacctaactttctcagtttagttttcctagtttgaaaaatgaaagtgccttgtaaactaatgtgttacacaaatgtctgcattatttacttttaccattgctaatcataaattttttaatcttgattttattagttttacttttgactttattcccttttaagatagtctggttactgggagccacagttagaatgactcacccagtaattccctagtctttaagccaaaaccatttcctatatatggagttctggcatttttgcaaatgtgctttatggtacccttgaggatggtctctggatgtttcccgatttcaaacttgtatgaaagattagaccagggaatttctttgtgtagaaattttctcatagttgtcttaagttttaactcatgtacattaatctttagctttgctttacatttgttttctgttgatagccaagtcattgcttgttaaatattccttagaaatgaactttcctatcaatttaaaattattttagctgtatctgtggcactttttttttttctcttttgagatggagtctcgctctgttgcccaggctggagtgcagtggtgtggtcttggctcactgcaacctccacttcccgggttcaagccattctcctgcctcagcctcccgagtggctgggattagagacgcctgccaccacacctggctaatattttgtatttttagtagagaggggtttcatcatgttggccaggctggtctcgaactcctgacctcaggtgatcgcccaccttagcctcccaaagtgctgggattataggtgtgagccgccgcacccagcctgtggtaccttttaaaaagtaaaaaattcaatggcgtgaaacaacagaaggagttctgcttccatttctagttgttaaacgcctttctctagccaagatcacatatatttctggttttttatagctagtgcactataactctgacagtcatggttagattgatagttttactgaaagtaatttatcaaaatccccattagattgtcttttaatgtcaacatattaaacctgttccctgagagatactttcctatttgttctccttgccctttaaatatcatttggtgccagtgagatgaagaatagaaaatgtatatcttttaggggaacttcgcaagcctgagatcccccactacatatagtcattcagaaaatgtttcttaagcacttactacctactttttctcagacattgtaccgggacatatagattaaaagaaagagtctttagtctcaaggattttacagtctaatggggaagcagatgtgtacaaatataaatgatgcaatacagaaattattgtggcatggtatacagggagaaatgaaagcattgaagaaggcaaagaagtcttcctcgggaagtcatggcttcaaagagaaaagtaggctgtgtcttaaaggataagtatgactttgccaagctaatttagggaactttgtattctaggaagagggaacagaatgtgcaaagcctcgaaggtgcactgttttgtgtgtgtgtgtgtgcgtgtggggattctttagtatattttgactgcatgttgaggagtgatgaggagtagagtttgacaggtagtcaggatactgtaaggttaaaacctgagctctgtggttgacttgcttcgtggcattgagattttgaatatgcactgtgctttagacttcctgttgtgtaagaagcccatagtattgtaggtccacctgctattcacatggggttataaatattgcaggcatgaaacgcttcctgatcgctgaatagtaagaaaggtctgagcatggtgccgattaaattctccattgaaatgtacctttgtgggtacattaaattattttagcataagtctagtgaagtgccagcagtagatactatgttatttctggagctcttgatgttgatttttgaggctgaacatgctcttagcctcaagcaggtcatatttggaatacctgatgtgtgctcctggttgctcagtgcttaggatgcataaacaggtagctgcagtctcatctctcagtatatatacttttcagcaaatcttttttttctagataaattggaaaactaccttttttctgcatttttcatctgatgtcattatggtatgtaggtggcagctttcttgggcacagttgtctatataactgttcatcacatgagtcattgtctgtttctgttcttctgcctgaaaattccatcttggaaatcgtgtcatgcaatcggtgactgcgacattctacttgttatgtacactgccactggctttgtatgttatgttgatggactctacctgtgctacagtgaagggataaagtgacttattaaattgagtcagactcagttcctccaaatggtatttcctgtaaaaatgatgccaagcaagattctgcataaaacatgcatatgctttacactgtaagcatacagtgcctaccttttgttattgtgtctgcttaaatccttaccacagttgtactcctgtttgatcaagtggccagtttaactagatactagctttgaagaagttctgtattggcccctggaatgtgacagttcataccacattgaaaaggtaagaaccaagtctttgtagagtagaacaccttaaagttaatccacttttaccaaattcctctattgttaaagcaacagtcctatattggctaatttttaaaatcataatgtgccacactttacacatccctagaatgtaagctagggggcaggggcctatgcctgttttgttcactgtagtgttcccagcacctagaacagtgcttggcacagaccaggctctcagtaaatatttgtttgaatgcatgaattgattttatcatctgtaaatgttttgtttcatattagaagagaccttttctaggttatctgaataattgttttaattcttaggaaagctattaattttctgaaaaataagttttaaaatatgtttggaaggccctatgtcagtcaaggaccagtcagaggaacagaagccactgttggtcttataagcagagggaatttaaaatagggagtaggttacaaggctgctagaagagccaagaagctgaacaggggctggtgaggcacccattcgattagcaatgcctgggaactactatgcctgcaaggaaaatagtgcactggtgtcaccaagggctggaagtccgagtggtctggtgtgagcggaagcatggaaagaggagcagtctggtggcagctggaagtaggccgagtgagagagcgtattaccctggctgctccctgctcctgcctcttatcctcctcagtgcctcccattgatggaacttatcctgaaatcagttggcaaagggagcctgggagatgtagttccctgtgatcaagcggagcaagggagggatcccagcgcaaacaggcaaagacacaaaggcactgaattctccaagatgtaatttctttccccttatagtatttgaattattttggacaagagaacggaagggttttccggcagatataacattgcgtgcttctaaaggatcttgactgttgctgaaacaattattagtcccaggaagtaatgtaacaactcagtcatagtttatatacttagggggtatgactaggcaaattggctcctgtattgaatatgtatttgactgttggctgctgccaggagcaacttatcgtttggttactcagaaaataagttcccaccctgtcaattctgggaagtcttaggtatggtgtatccacattgagtatatctacaactggacagcttgagttagtcacacagaagccatacacagaaaatgttgaggattgcagcgttaaaacatggtacagctcactcttttttttttctttcgtttttctggagacagagtcttgctctgttgcccaggctggagtgctttgatgcgatctcagctcactgcctcctctggctcccgggttcaagtgattctcatgcctcagccttccaagtagctgggattataggtgtgtacctccatgcccagctaattatttgtatttttagtagacacagggtctcaccacattggccaggctggtctcaaactcctggcctcaagtgagctacctaccctccttggcctcccaaagtgctgggattgcagatgtgagccaccaaggccgggcctcagctcagtgttttctttacagttaaggtaactgcagtgtggctgttttatcttgtgctgcatgttagtttaactagtcttattgatttgtttgttttaccccacaacttcagataagtttgcactgggtgagggaggcaagatcactgggtctgttttcttctaccctgacctgaaaaaaatattttgtcttgtaaggaatgttgctgctgctccatttaagggcagagctttccaagttgtggctacttgttttctacgtgattataaaagtgtctaatgagttatatgagacaagttcagccctttctagaagtgctttttttgtcaatcaggtcacctgcatttgggcccttgctatattaatggaattggtggaactaggccagcagagttttcagtgcagtgtgagtatgtttgcttttaggctgttacttcccacagaggccacagataaaggactctcgttgtttgagtgaagttaccaactgtaacaattgcataggtttccttgtttctttcttttctccaaaaaactcatttcctcttggcaggtgttactataattcacaggtgtaatgaaaatgtaatttgggatttgaaaaagcatatcagactgcttcccagagtaccagttcttttcagctggtccatttcaacttaagaggtccatctatgcatttttgaagcttcatatttaataaatataatatttcactgctgtgtttgactattccgtttcccacactttctccttccctaccccactcttctggatcctgtgtttccccacaggctttgtgaatgccggtccactgatggctgaactgcaggtctctccccagtggaaagccccagagatgagccagatctgcctcagctgtggccatccgtcagcgtaaggttgctctggtggtcgtcttcagtttgtccagctcttccccttatcccccatcctccctcatgtgtggctgaagcttgccctggaatcccacctttgtagcatgtcactcggtagtagtagaattttattattgttgctttttttcattttcaattaatgttaagtgattctctgacaaattttgttgaccatagccctcttttcccctcagttcatagatttcctataggaattctggtttgcttttaaatacatatagaatacagtttatttaagttctggatttcataagcttacttggaaaatacttttttaaaaaaaacatttcaggtcaaagcttccaaaaagaaatttcttaatctgaaacaatgagaactgggttcctcaggcctcatgtcatttcccctcacccacaaatcaaatgtgtaatgctctcattttatgatgtattgaaacagtgaagcaaatgcgagagggagagagacctactctcagctgtagctgataagtgtgtcctagcatggtgatttgagcaaatagagcaccttttcttttccttttcttcaaatagccatgctgtcttttgcagcagttgctggtgacggaataccataaatccccaggcctctaccacagagcttacatctttagatgtgggtttacatgttaatcctacaatgttatttcacctcagtggtctgaagtgcgcacacagtacattttgttctttaacttcctcttttcttgtctaactggaagtccccaaatgtgtggatttagaaatgagttctctagtgtttctagttttgagttaaggaagttttgtcttgatattgtttaggtggttgtttttgttctgtgccttcaaaaataatttcttacagaattttctgtgtgaactggtgacatcatatgctgtagtgtaaagcttgtagagaagggggcattggtgtctttttgttgttgttgacactttatcactccttataactgacacaaaccctgagaagagaaacaggaaggaaactccctgttcttaccatgatgcttttgttcaaaatagctgaaaacagcagagctgacggaaaccaatttgagtgtgacagctgatttgagaaagaatgaattaagagattcaggctcttctgctatgttgaaatcatttttactgaaagattagctgtttggaacagggattgactttgtctctctgaaagtaggcatgaagagttcggttagaggaaccgttacagatggaggagaaacttgaggaaaggtctttcctgtagtgtgactacagtattaacattcccagattatatgaaagagaaaggaagcttcattaaatgaaacattggaatcaggaagactccggcttggctccctgagcattctaacttgttctgagcctagtctcgacagaagtagcctgacacaagtggctcagatcaagggtccatattacgggcagagtaaaaataggtcccagtttcattagacttctcatacatttaaggaaaaaaagatttgttgccataggaacagaccagttgttttctgtcttgtgggattttaggagctggggagataggaggatccctgtgcttataatctaaacatcagtaaatgctggttttttttaaaacaacaacaactttatcttttatgattctgaaacctatccacgataaaaatcattggaaagtatgaaaaatataatgatgctgaaggtatttttcataattcttttttttttttttttttggagacaaggtctctcgctccgtcgcccaagctggagtacagtggcacgatctcagctcactgcagcctctatcaggcttaagcagttcttctgtctcagccttcatagtagctgggactacaggtgcacaccaccacgtccagctaatttttgtatttttagtacagacagggttttgccatgttgcccaggctagtctcgaactcctgagctcacatcatctgcctgcctcggcctgccggagtgccaggattacaggcatcaaccaccatgcccggccttatttttcataattcttatcacccatttacttgagcttataccataatgattttatatcattcttttttgcttaacatttattataagcttatttcatgacattaaaaacgtgtaaatacctttattgtatcccagcattggaatatgtcattattatctcttgcccaattgttaatatttgaattttcaattttttaacaatacaaataaggaagtataaatttttgtgttgttgttagagtgatgggttatttatgtgttcagatttgagtagtcaagtgggccctctaatttaaaaagttaccaaggggattctctgggttgagcccacgtagagatggctttgctatgggcattatcattctgaactgcttcattgcagtagatgtctgctgaggcaaggaatggggaattcgggagaaccctggtttccccataagggacctaaggaacataagggacataaggaacagctttatgggtcataccacagcaagatgggccggcactttcacattgagaggtgacagcgtgctggcagccctcacagccctcgctcgctctcggtgcctcctcggccttggcacccactctggccgcacttgaggagcccttcagcccactgctgcactgtgggagccccttcctgggctggccgaggccggagctggctccctcggcttgcggggaggtgtggagggagccagctccgggaaccggggctgtgtgccgcacttgtgggccagctggagttccgggtgggcatgggcttggcgggccccgcacttggagcagccggccagccctgctggccctgggcaatgaggggcttagcacctgggccagcggctgcagagggtgtgctgggtcccccagcagtgccggcccaccggcgctgcgctggatttctcaccgggccttagctgccttcccacggggcagggctcgggacctgcagcccgccatgcctgagcctccccccacctctgtgggctcctgtgcagcctgagcctccccaacgagaccgccccctgctccacggcacccggtcccatcaaccacccaagggctgaggtgtgtgggcgcacagcgcgggactggcgggcagctccacctgcagccccagtgcgagatccactggatgaagccagctgggctcctgagtctggtggggccttggagaacctttatgtctagctcagggattgtaaatacaccagtcggcactctgtatctagctcaaggtttgtaaacacaccaatcagcaccctgtgtctagctcagggtttgtgaatgcaccaatcgacactctgtatctagctactctggtggggacttggagaacctttgtgtggacactctgtatctagctactcttggtggggatttggagaacctttgtgtccacactctgtatctagctaatctggtggggatgtggagaacctttgtgtctagctcagggattgtaaacgcaccaatcagcaccctgtcaaaacagaccgctccgctctaccaatcagcaggatgtgattggatggggccagataagagaataaaagcaggctgcccgagccagcagtggcagcctgttcgggtcctcttccacagtgtggaaactttgttcttttgctctttgcaataaatcttactgctactcactctttgggtccacactgcctttatgagctgcaacactcaccgcgaaggtctgcagcttcactcctgaagccagcgagaccacgaacccaccgggaggaacgaacaattccagacgcgctgccttaagagctttaacactcaccgcgagggtccacagcttcactcctgagccagcgagaccacgaaccccaccagaaggaagaaactccgaacacatccgaacatcagaaggaacaaactccggacacgccgcctttaagaactgtaacactcactgcgagggtccacggcttcattcttgaagtcagtgaaaccaagaacccaccaattccggacacaacattatatacctgatgtgcggaaatacccttgcgccattgactagcatcttatgttgttcatacagtcctcattcacttaaacttagtcctctaaggaggtggattagaggtcctacattagtagaaaggaggtaacagctactgcattattattttttttttgaagaagggccctcagactggagatgaggacagggactgtgttttcatgtctatctgcatacttaatgcacggtgtctggcacatagtgtctatgtccctattatgagcagcattattctgttaatgtgtgttcaggtcatatgctttgttttgttttttgatagtcttcctcatactgttagcccagatagctgaagatctgtgacaccaggaagctgagcaggtgaatctcatggttgctttgtggtaattgcttctttgtgccatttcatttctgtgcttctgccacctgtgctgctttggaagctggagctagacatgaagcgaatcctctgccctctcagtaggaggttttggtgtgacacatcatcctggggaaaaatgtagcatgaagtgtgaaacaggaggctgaaatagcagtcctttagcccttttgtgggatgggagtaaatatttagacgtggttctcaggtgctgtagaatttaataaccttgcagcagttttagaaactccttgtgcccactggaacaggttcgtttaaagaatcttacttgggctcttttgaaattgtgatgcccccacctccacccactcccctcccccgcccacccccagacctgccctgagttcatctgcctaatgttccctttgcaggatctttgtactcacatggctggtatctttgccccacccccttatgccatatattttgacctcattgtgttctattctgaaacgcctgggttttgaaacatcgtggtgaatgttttctttttcaaagggcaaatctccatcttttgctctcctcccttaagccagggctgttttgatgactgatattctgcacaccactggactaaccaaccatctgtactttgatcccagaattcattttgattctgctgtttgtttagaactgaaagctttctagcttgtttggatgtggttgtgattcagtgaaactggcactgattttccatctgtttgccattggttgggacttctccaatgtgttaggaaagctgctgtgctgagttgcgaagagaaattcacatgtccatggtcttgcacaagggctcatttgctcacttagaaggttttatgtagagcctctgcctgggtgaaagacatgagcttccctggaaacaattgaaaaacatcttctgcctggccactcagtcttgagctctagtaggttacactgtttttcccttctgggcttctttttgaggaaggggagtgtggatgggaagaaatcttcacaatcagtctcagattcccagcagcagagagtgaattgtatgttgtaataataaaaaaaagaatacctaaagaacaagatatcaatttagtgaccattattgagcatttactatgtataacacacatttgggtgtgtaaaggtgattctaatttcagtccagctgatcctttcttctgtgaacttgggcaaatgacttgacctctctaggccttagtttctccaactgtgcttagactagatcattcctaaggtttgttacaattttagaattttgtactctaaacgtgtatctgtttgttacagaacaagagaggcttttccacaaaattgacatattcttatgtctcacttcaaactaaatggcttaaaaatggttcctctagagcaggatttctcaacctcagactattgacattttgggtgattccttgttgtgggcactgtccagggcattttagaatgtttaggagccagcattcctgtcctctgcccactagatgccagtagctcttccctacccctctgcccgttgtgacaaccaaaaatgtctctagacatcagcattgccccttgaggggaaatcgtttctgttgggagccattggtctagaggaacaaagatgggactatttgaatatgggctgtttttaatatcagttttcatgttattccactattgcttattacctgtttaatcagtaagcatgcattaagtgtatactatacacagatgaatgccgacgcttgattatgagggactttaatgaccatgtcaagttttcaaatgttgagtccacctggccaactttgaaatgattgcccagctgttagcgcagcagtccctacacgcctacacccaccagcctgctattagccttggtcagggtaatgattgaaatgtatgaaagcattcactcacaaaggctatcagatagcaacctaggaaggccctgggattgtgagttatggatcgggactgggtcttgtgcatccagaatctagtattatgatagttatcccttcagcttcctaggggaaaaaaattcctcgtcaaagtggtggggtgaggaatctatcctagggatggaggatgaagagcaatctcattggacaatgaccatatcaccctttttagtagcttcttctaaacataggccctttccctcccgcagtgggcaggctcactttgcagctttagttttttgttttgttttgttttgtttttgtttttaaatatatgagtagatactggttgttgcaaagaggaagttaaactgaagtaacctaaaaatgtaaagaactgaatgtccccaggagatgaagacagtaacttgagaaccaagtttgcttatattacctgaagtgaggtcactaggaaattggtttaattatagtatcaagttttgaaatatcaggtccacctggctgactttgaaatgatttgcccagctattagctcagcagtccctccctgcacaccaactccacccagcctattgttagccattgaagtggtgattgaaatgcattagattgcccaagaaatctaatctttggacttgctacatttgctataaaatatcagtttaggtttaataactttgaatttgctcccagtacccccagattttctcatctgttttaaattcacattctgcacttggtcgggtgcagaatggtgcttctcgctgattggggtagagtgtgttctgtgagcatctttgctgggatgctctgggattccaaagccatgattcagacacttaagcctgtgtcagtccctatccttaggtcctggcaggctccgtgttccattccagctgagcctttgctggagtaattacccacatggagtcttcaagccaaacaattgtttgtactgagatagtctcactgtttggctcctaatgaaataatctctttcctgccctcaatgaaagcagctattttttgtgtcctccctcccctattcagagaagccatgtctcatccaccactcttccagcttattcataaatgctttaagcagggtctttgtgtaaaggaaattggctggagctgaaatatcataggctaaccaggagacaaggagcattaaggacacccttttccttgactttctatttagggtatttaaattacctttctgtgattttctgtaataagcaatctaaaacttaaatccacataagcaaaatagtcatactaggtttttaaaaagtatactaaattaggccgggctcagtggctcatgcctgtaatcgcagcacgttgggaggccgaggcaggtgcatcactaggtcaggagatcgagaccatcctgactaacatggtgaaaccccgctgtctctactaaagacacaaaaaattagccaggcgtggtggcatgcacctgtagtcccaggtattcgggaagctgaggcaggggaatagcttgaacccgggaggcggaggttgcagtgagccaagatcacaccactgcactccagcctgggtgacagagcgtgaatccatctcaaaaaaaaaaaaagtatactaaattagtataattttattgttgttgttacctaaaggagctctcaaaaataaaagctggccaggcgtggtagcacatgcctgtagtcccagctactcaagaagctgaggtgggaggattgcttgagcataggagattgaggctgcactgcactctagcttgggcaacaaagcaacaaaccctatcttagaagaacaaacaaaaaacccaacaacagaacaaccacaaatgagtgagtgcagcaggagaggcagcagagcgccgtgggagttggaataggaaggagaaaaggcttcatggggaaagtgggcagagcaagatttgcacaaaaagatgttttgcaaatagaggaaataggccctgtaaagctatttgtgagagactgtaagttgatcaacaaagtgtaagtagttcttctaacttttttttttttttttttttttgtgacagagtcttgctctgtcgcccaggctggagtacagtggctcaatcttggctcactgcaacctccacctcccaggttcaagcgattcccctgcctcagcctcctgaatagttagtattacaggcgtgagccacaatgcctggctaatttttgtatttttagtagagatggggtttcagcatgttggccaggctggtcttgaacccctgacctcaggtgatccaccggccttagcatcccaaagtgctgggattaaggcgtgaggcaccgcgcccggccacttctaacctttttaaggagtatttgcgtgaacagaatcaatgagtttcttcaaattaacttctgacaataatctaaatggtctccattttctgattcacccttttttccaattccaagttgccattatccatgtaattggctctaaagagagcaaggaaatctatcttctccaggagtttcagtcatagatttttagctggctctctttatcatttgcaactgagttcattcatatgcttgttttcaagaattttttcctttagttccagaactctttgcttccatcctatggtttcttgggaggacagttctaagctttcttaagataagtgtttcaatcacaccatctaccatttccctcagaagttgttctcctcttatgcggtgtgtttaggtgtttggggcgccaatcactagggattggaaggattttgatgaatcttcaagtaaccatgtcttgaaggttagccatcatcagttcactccatgaaatgaaaacttacggggatccacttttgctcttttttgaagaagtctattgtcctcaaaggaagaggtggacctgttcagatttttaagttttatcttattcagtgtttgtagcatcaagggactggcctctaacggaagcaactgggggcttcattggcttatgcaatcagtctcatctcactgactttacaaggttcttcaatactggcagaaaatctcttggctagctctttctccctccttaaaatatgttggctctttactataaaaacaatcatagcagcacataccagaatctcctagggaaacccccaaagacttgggccttgtctcagctctcagacactaccaccaagagcactgcatagctttcccaggaccaactggaaagaattcttttttacgacgatgtaattgacaatgaaaattgtatatgtttacagtatacaatgtggtgttttgatatatgtgtacattgatttttgtggcagtcaggaggtcctctagttggaacagagactcaccacacccaagagtccctctgtctgtatcccatccccaaatcagaaaaaggcctgtgcgtctctgtgggtagtattcactctctcagattcctctgtgagtcaggaacatgacaagtggcatctatatacacagttttaagaggaagtgatgtcactcttggtgtatagaagtgagaagaggagtaatgagaattaaagacccagatcacaggagaatttaagccatacttagaagtttggagttcagttgatggtggggggtccagtgacatagctttgaatggggtgatgacattatcaggacatatgttggcagaatgtccttttcaaagccaacaaagtccaaactaggatctcattctttccctcctgaagtcacctggggaattgaattgataataatgatacaggatgactgattgatagttctttattcccagaaacatcacctaagtatacactagttaccttccactgctgggagagacaacaaggaagagtcacagtaagtccctacctgttaataataaaccaatggccaggcccagtggctcatgcctgtaatcccagtactttgggaggccaaggtgggaagatcacttgagcccaagagttcaaaaccagcctgggcaacatagcaagacctcacctctacaaaataataataataataataataaaacagggcagtaagattaatgtggagccaaatttacctttccagagtagtttaatgaatttttgagatacagttactatcttttagaagagatatgtttgagataatctggttaaggtatattgacttgtctaaagtcacacaggaaattagtgctgtaatttagataattcgtatctttagctgtgtagataagaagggccagttaaataacatgagaaagatgaagaatgcctccttcctttctcctagtagacctcagtctgctttcctgttgatttctttgtgttacaggctttaatgttttttgagaaaagccattttaagttaactgctgaattagttttagacatagattgactaatcatttcattagtgagtacttagcagtgttctacctcccttaacctcctttttccggttacctggtaggaagataatgttgctttgcttcatctccattggtaatcacagcagtctgtctaattgctatgtctgttctatcattgagctcctggattaaattggttcagcgggcttgtattttggttgagtatataagtggctgctttcttctgctagaatctccaaacctccatctttatctttcatactttgatatattatataagtatggggggagtaaaaagcagcaccaggatatcaaaatggtaggaagagagattaatgggactccgtataaggaaggcctctctaatagtgggtgccgtctaatagacaaaccaactaccttttgaaatggtacgtaactgactcagcattggacaagccaggtgatcacccctagaaggagggtgcattcagtgagaggctggacctaagaggatttctaaagtcctttccacctctgattttctaattttaaatttcttggtgtaggatttacctttattctctaaccagtctcagacatgttttaattttctttgtctcagacatttttaagcttaacttatgctcttttttcaacagtacaaatgtggacagtgtttctttttgacaaacggaaacaacattcttgcaagatggcccagatggaaagggacttgtcttgcaagtgttctgaaagcagaggttgattgcataagcctttattttggtctcatggttccttaaaatgtttgtacttacagaagttcaaagttactgtttattgttattttggaataaggaacttgatgaactctcttttgtgtggatgaaaacatagaggtaaacatacctctcagcagccctacacaatttttccaagatcccactggtgtttctgtgtattcttccttttcagtgaatcagagaatggagggatataatgagtggaactgaggtaactggcactagatttgttcttaaaacaaatactgctgctttttttactttgacttccaaattttgggtcagagttaatgacaagttatgtcacgtagaattaatctcttataaaatctgagtttgttgatttaggtttttccttatatgtatgttgcatttaaccagttttcagtgcctggtataggctccatgaaccaaatttgattccgtgttttaggttcctcaagacctaacatcttcatagattgtttgtttcattttacgttttcagaaccattgaacggtaagcaggaagggacctaaaaattactgcaaatcatctactgtagtagtaggactgtagtagtagaaagaactgtagggctcattgttcacccaattcaccacatggggatcatttctctaccatccctgagaactgattaccaaacctctgtttgaacactgcactaactgagattttacaatttctggatatgctgcattggtttttacacaaccttaattgttagaaaatttttctctagagtgtgctaaaatcaacttctactccttggtgccagttctgcttttgaagcctttccaaagtaacctaatccgttttctgtgttacagctatcctttaaggcatttgaaaacttctcccttcattttgcaaaacaggaaaaatatatacatttatgttgcttattgacgaattcatttaacacacatttattgtgtaccatcttctgtttgctagcattgtgtcaagtgtttgtgataaatgatgaaggaacatggtcattgccttccagagctcatagtctatttaggacaagagagacctgtaagcaactcgaacaagatattaagtattagaagaacaaagcataccctgggctattagcaatagagaaagttagggtttattccattggagggcatcacagatgaactggatttttaagtttgtcaagcagggaatgagggagaaagccattccaggtagaaagaatggtgtagtcaaagagatttgagtgtgctgcatatttcacaattatgacttcctcagcatgtgtaaagtacaaggctctcaacagactttatatattatgttaaggagtttcaacttaccctgcagccagtaaggagccctggatgcttacgttgttttgtttttacgatatctgtactggtttttcccattgcaaaattaatagaaagctcattgcaaacaattcagagaggatatatagagaagaaaatagatgtttcattatcccattatcccgatatagtaataatttacatatagtcttctagattttttttctgtgcatacgcgtacatttatttatttatttattttttgacaaggtctcactctgttccctaggatgaagtgccatggtgcaatcatagctcattgcagcctttgaatccttgggctcaagcagtactcccgctcagcctcccaagtagctaggactacagaggcatatcaccacaccgagctcatttattcatattttaaaaaaaatggaattgtttcatgtgtactcttttaatactggatttttaaaattactatatcatggagatacttttatatgaaatagaggctccaaaatttttccccgttaaatggtgataccataattccttaatgtaacctattaatgtttctaattttcataaagatgtaataatgaacattcttaacgtatttctttgtgtacttgacctgttttttccctgatgaattcttacaagtggggtcaaaggatttacttagttcttttgtttttttgagatagggtgtcaatatgttgcccaggctggcctcaaactcctgggctcaagtgatcctccaacctcagcctcctgaatagctgggactacagacatgtgccactgcacctagaatacttagttttaattaatctttaagcaaatgttgcttccctgctatgttcaaggaaccatgctatgccgtgagtatatgatagtgaatgttacaggtctggtgacagctcttgtggcacacatagttaagcgggaaagacatcttaaacaatcaaataattagatagtaacaaaatatggtatgatttagaaaaagtaaagggtggccaggcacagtggctcactcctgtaatctcagtgctttgggaggccaaagtaggaaaatcacttgaggccaggagttcaagaccagcctgagcaacatagtgagaccctgtctcttttttatttcattgatttatttttatttttatttttttcagacagagccttgctctgttgcccaggctggagtgcagtggtgggatctcggcccactgcaacctccgcctcctgggctcacgtgattctcctgccttagcctcccaagtagctgggactacaggcatgtgccactacgtgtggctatttttttttttttttttttttgtatttttagtagagatggggtttcaccatgttggccaggcttgtctcaaactcctgacctcaggtcatctgtccacctctgcctcccaaagtgttgggattacaggcgtgagccaccgtgcctggcccatttcttttttttttcttttctttctttctcttttttttttttcctgactcttaacaccactcaatgacccatctttacaaaaataaaaaattcagctgagcgtggtggctcatgcatctagtcccagctacttgggagactgaggtgggaggattgcctgagcctgacagcccaaggctgctgtgagctatgatcgcaccactgcactccagcctgggtgagagagtaagaccctgtctcaaaaaaaaaaaaagaaaagaaaagaaagagtgaaaaaaagagtaaagggtaaatgaaagttcataacctttaaaaaaaaagtccttatcttttagagatatatgctgaagtatatacagatgaaatggtatgatatttaggatttgcttcagaataatccaggttggagttgaggggcagtgggtgggagtatagctgaaacaaaattggctaggagttgataattgctgaagctcatggttaattatgctctgctttcgtttgtttgaaattttctgtaaggtaaaaaccaaaagaaagggtagaagagatgttacagtcgggtttagactggggagccaaggaaagactcctttgaggaagaaacatttcagctgagacccttgtgatgtataggagttggccaggctgcaagtggcatttggcagttagggaaagagtttttttaggcagcaggagcagcatgtacaaagtccagcaagccctgaggaaggaacatgttggtcccttgaggaaatgaaagaaggctgctaccataggaattgagaggctgcggaaggaggcatgggctagacctttaagaccttggaaactatgttaaggattttgttatttaatccaatagtaatagaagaattttaagcagcacaatgtggctttgcttctttaagagctcaagttggctgtttggtggagaatggttttggtttgggctcaagggagaagagaatgtaaaagtggagagagagctattaggaggttattgcagtggtccgaaagagtctggtggctttagattacagaaatagtgatacagatggagagaagagatactgatttgacagatatttttgtcttggtgatgtgggggctgaaggagagaggtttcatgatgcataattttctgactgacgcaatggaatggatggaggtgtagttgactaagatgaagaaaaaaggaagagattttgtagcaagagattgagagcttagtttggaatatgctattcagaaaatgtgcaccaatttacatatttacctttgtgtatgagactacatggaaggtttatatttagaggtgtgatctgtacagatttgtgttttagaaagattattctggtggtgggattctggagactaattgcttgttagtctgtgagctttttgaattgaggaatctcatccttattttctctgcctttgtatccccagtacttagcaggcaaattgcttggcacataggtacacaataaataatgttaagagaaccaatgctggttgggcgcggtggctcacacctgtaatcccagcactctgggaggccgagaagggcggatcactaggtcaggagatcgagaccatcctggctaccaaggtgaaaccccgtctctactaaaaatacaaaaacaaaattagccgggcgtgatcgcgggcgcctgtagtctcagctactcgggaggctgaggcaggagaatggcgtgaactcgggaggcggaacttgcagtgagccgagatcgcgccactgcactccagcctgggtgacagagcgagattccgtctcaaaacaaacaaacacacacaaaaaagaacgaatgcttataggtgagacatgaggtctaggtagaaatggatagattctggaaaagtttccaagatagattccacaggatttggatggaagatgggaaagttctctcccttcgcgtagcctgcccgttgaactttttgacaggtccgttatgccagcaggtctaaatataggtagccatcaatttatcaatgttttttcctcctcaatatttatttgtttggaactccatagattagaactcaatgatataattattataatattagtagtagcttgaagtcctccatcacgctagttccccttttctgtctgctgagttgtcaatcccagagcccctctaatcctggcagctttggtggtgggggaagtttcagcagcaagaggaatttgcagcagtagttactccgtatgtagaagctgtccagatgttgaatataagttggatattacgtatatgcttttcattttacaaatggagacataagccctagagaaacttgtcaaaatacatgcaacaggtccgtgtaaacccagatttttccgatactgaactggtacttaggacagttgatttcttgactgatcaaccaaatccatctccatctacttttttcattttccctgatcccttattgcagagtgattctatgttagttttagtattgcttgatgctgcccacgcctgctcttaggctcctgttgaatatgtgcacttatgtgtgaccttgttcttgtgttgtgccgatcactaccagtttacatcacttgtctatcctctttgctttcaaaattgtttggcatattgcctctcagcatttcttttcattttaaatttcaaaatggcatcttttatatttttttccttgattgccatgaccaatgtgtattaaacaattggtttatctctttttattgatacataatagatgtacatgttttcagggtacaagtgatattttgatacattcacataatgtgtaataaccaaatcatgataatgctatatccgtcaccttagacatttatcttttctttatgctgggaatatttgaattattctcttctacctattttgagatatatggtagattattatttactatagtcactgtactgatttattgaacactagatcttatttcttctaactgtatttttgtatttttgttttttttttgagacaaggtctcgctgtcatctaggctggagtgcagtggtgtgatctcggctcattgcaacctctgactcctggattcaagcaattctcctgcctcagcctccccagtagctgggattacaggcacgtgccaccatgcctggctaattttttgtatttttagtagagatggggtttcaccgtgttggccaggctgactaactgtatttttgtacccattaatcaacctcatttcttcctccatccgcctacccttcctggcttctagaacaccgatttactctctcttcatgagatccactattttttaactcactaacatttgcagcaacatggatggaattggaggtcattatgttaagtgaaacaattggtttcacttgcatttttgcaagtttaccagattaaagtaggctggccttatagcagcaataccaggtactgtggaatccaagtacccaccacttaggttgacagccttgggccttctttctttgcctgtgtagtgggggcatatgcaagcacaagggcagggtgggggtgtgtagcagagaaagggaacaggtgagggtttaaaaagtgcattttcaagaaatattttaagagaaataaaggaagctgcttaaattttcatgttgcctagaagactttgaaattgggtctagggtaaatttcttctctctgtattcagttcattttggttctgatattttaggaccagaactcatattcctttttaaaaaagaagcactctggctgagcgcggtggctcacgcctgtaatcccaggcctttgagaggccaaggcgggtacatcaccagaggtctggagtttgagaccagcctggccaacaaggcgaaaccccgtctctactaaaatacaaaaattagtggggtgtggtagcacgcgcctatagtcccagctactcgggaagctgaggcacgagagttgcttgcacctaggagacggaggttgcagtgagccaaaatcacgccgctgcactccagcctggacgacagagcgagactctgtctcaaaaaaataaaataaaaagaagcactccgtggtgttgcatagagtgttggtatatattacatatatgaatgagttaactggcccttatcaggaagatggatgggaagtgggttctggaaaccttattctataccacatccttatatatagtcctcagttattgtccctctgtgttctagggcactgtgaggtgaatgctattgtacacgttttatagatgaggaaactaaggctcaggaaatgtaagtatctctcagaaggtcacacaggtaatcactgaaggagctgtgctcaaacctaagtcctacaactggcagagtgtggttgctcccacctgtaatcccagtgctttgggaggctgaggcgagaggattccttgaggccaggagttcacaaccagcctaagcaacatagggagaccttgtctttaaaaaaattaaaaaattagctgggcatggtgttgcatgcctgtagtcccagctacatgggaggctgaggtgggagaatcgcttgaggcgaggagtttgaggttacagtgaaccatgatcttgcctctgcattccagcctgggcaacagagtgagagaccctgtctgtaaagaataaaatgaaataaaagtaactacaccatttccccatgttttcagccatataagtaacatttgtctcttttatttttcttttctctaatttcagaatattttatggaacatgtagttattcactaataaatctagtggctcaaaactaaaagagattgagtatctgggatataactatcactatattcactgggaaaaggtttcacaagggatgtcaggtagggatttggtggggagaagaggctgttctttggcttttcatgaaaatacagttgcctgtatttctgtactgaggccttgtcagtggcttcagagtcaccccaaggctccaagtcttagccttgcattcctcagaagcaaaaagactttaagtacgctggagtgggagctgtgacagtggcttagatgattgggaattgccttttcccatcttaaggccaggaagcaaacagtgtaacatttcacagctgacttttaatttttaatgaatgtgtttggcttctgactttgttagcaaacaaatacatcttaacttgtcttatgagttctagactctggaatctagagcaaaggaaaagtgctttaagaaacatgaaatattaacttggtgccattttaaatcttatataacttagatcttattggagttcctttatgaaaactgtaacctaaaatggatataccacatgttaagaaaccccatttacatcagtttagggttttcattttgtgtttgacgtgacactctcccacatgaaacaagtgtgcgaatcatttttgtgtttattagatacatggcggaccaactatgtaaatccatctaggaatgtgaagggactaaatatctttttagaaggtaaatcggagcttgtgatagcaataaggtattgggataaaatttcaggcggagagcaccacctggtggtaataaggagaatgtgagccttctgttgcagtatttgcgatagtaaataagtgatatctttgtcaaaaaattacattcttatttgtaataatcatgaattcaaatttctaaaactaattttctgccacacaattctagcattccttcattaaaactgctgtcaaaaccttcaggctggccaggcacaatggctcacacctgtaatcccagcacttcgggaggccaaagtgggagaattgtttgaggacaggagttcaagaccagcctgggcaacatagtgagacctagtctctacagtaaataaaaatattagccaggcagggtggcacacgcctatagtcccagctactccagaggctgaggcaggaggatcgcttgagcccaggaagacgaggctgcagtgagctatgatcgtgccacagcactccctgtccgggtgacagcgagactgcctctaaaaataaaaattaaaaaattaaaaacctgctagctaaccaaataattgtctgtgtcctaaagaactgaagtcttgtgctcgttgtcgttccaagcgtaggccctgtttatctctgtagaaaatcagtgtcttttcacctctttattgcatcctctaatttttatatcacacttattttatgtggtaaatttctgccaagtgggataatggagaaggaagtatttctgattttttagtaagtttttggcaggtttcatataagtcatttttctttcctgggtaaaaattatgaagaggagtatgataatttttcagagtgattattaggatgagtaacactggcaggggatgggagattctgtaacagttttgaattaaaattcatatttgagatttcttttttgttgctataagcatctttattatttggcaatcttgaaacaagatacttcagtagttgagtaaagtaggaacatcagcctaaggggaaaagatcctattaagttaatgcgaatgcatattttataggcctggggttggggggaagataaacacagtttcaattacaggttgagccatggacaagcatgccatatctatcttttttcctggtaggaaaaccgaatacaggccaccactaaaaagtggtgaatacaggcccatcaccactaaaacgtctcttgggagaggactgtttatgtaaggtgctcggccaaatagaatatgacatggctttgcactcctgggatttttcttaatataagtaacagtcttataacatctgcgtttcaacactcatattagcagacactgtaaaaaaattgtaccatgcacaaatgcccacttattatataattctttttatattaaatgcccagaattggcaatccatagagataaaaagtagattcatagttgccaggggctgggaggaagagctgggagaaaatgggtagtgcctgctaatgggtttgtgatttcttttggactaatgaaaatgttctggaattagatagtagtaatcattgcacaactgtgtgaatatattaaaaaccactgtattgtacacttaaatttaaactaaagaaaagctgacacatggaggaatgagcagagtcaataaacaggtggttatggtaaaaattatttcacttatgttctagcagaaatgtctgataatctaatattgtagtttaggccttgaatgttgtaatttgtactttattgccctgttcctgactttcacagggccgcgatgggcctcttggaacattggtgtgttcatctgcattcgatgtgctggaatccacaggaatctgggggtgcacatatccagggtaaagtcagttaacctcgaccagtggactcaagaacagattcaggtacttagcccaagagtgagtcagctgcttccatatatctatgtaaaaggaattccagatgaatttcagtcaaacctggcacaaaggtgaagataaaggaaaatttagttgttaaacacttaacatcagattcttgtaccctaacagaaatttttattctttctatttaagatacaagttattctacctatattttacctccttaaaaacagaaatagtctacggtctaggattccatgggcccacgaaagtattaagagggatctttgggtgattttctaagactcttagcatttgcaggtctaaaatttatagtttcaaatattcacttttggtcgggcacggtggctcatgcctgtaatcccagcactttgtaaggccgaggtgggtggatctcttgagtctaggagttcaagaccagcctgggcaacagagtgagacacctgtctctacaaaataaagaattaaaaaattagctgggcctggtggtacgtacctgtaatcccagcagtttgggaagctgaggtgggaggattgcttgagcccagaagttgaagctgcggttagtcatgatcatgccattgcactctagcctgagcaatagagtgagaccctgtctcaaaaaaataaataaataaaaattcactttttaaaaaaacctccaaatcatagacttatgggaaaattttattactaaaatgcatacatgaatcttttttttaagacagagaaaatattttaatggtacataatattaaaatgtatccatttttgtaaactcatcatttctgatatttttagacacatacaaatgtggaattagataacatttaaaatttcaaaaattttaaataaatttaaacataattaaccttaaaagtatattaaataggacaatgtgtatattagatttattgttatcatctttaaaaagctgtaacagctggaatgcatacatgaatcttgcatgctgttagcttggtgggcttggagtgagactcctaagttaatgagtctggctggcctaagagctgtaccttgatatagcttcattattttttattctcttcctacattgaaacgctttaatttcaattttttctttcttgggagtaaaagggaagccccccgccccccaaatccagttgctaaagttggtaatggaaatcagaggttacgcttaaccagaaaatggctttagaaattgctttagattgtatttatagatgtattaaaggtctaaaaaggtgagttacatttttcagttacacttcactctgttttatgaaggaaattatatgccatggagatagtcgggaatttggagatttaaaaagctcttgggatttatccctcacaagtgttaaggagtctacttaaaagcctaatgggaaacacatttattggaattgattaatagtataaactcagaatgataacactgatcattgcctgccaagtagacattttaattggtagctgtgtatctaagagtttcaaatgagatcttgatttattactgaattgaatgtatcttggtacacaaatatttcagtaaaaggaacctatggagtgggggaaagacagcttggggcaaatgattgggaaatcctagtaaggtagagggaatcatgaattggaaatcagaatacacaagtttaaatgttggttctgacactctctaggttggttcttcaattgtacagtagtggaattgggtgagaagtttttcagttctttcttgatctgacgttccatgtttctacattctctttggtcacagtgcatgcaagagatgggaaatggaaaggcaaaccgactttatgaagcctatcttcctgagacctttcggcgacctcagatagacccgtatcttttctggagcaacttagaaggctgagtggtattttgatgcttggggagagtcagacaagactccagtcctgtaatgtgactgggtcatctctatgtggattagtcagtgtccttgcttgtcctctgtcctgcaatcaaggtgcacaaaaagcacatgtatttgtgaatgtcggaattgtcatacggtgtcacttgaagaagactcactctggaattaagactgcagtgatttcactgtgaattcttctataaagttacatctccactagtttattttggatctctgaaactattgtttgattaaaaagagtagttcattgtgctctgttaaccctggcagtcagcaaaattgccattcatttttatcatctttttatgtcttgggtgaaagaattaactgttgtttaccagtttgtcaataaccaataactttcttccaccatctgttcaacagagcatagcacctaggacacaaaaccaaatcccttaaaggcagtgcttctcaaaatgtagtttgtagatcatcttgttaaggttcttttttttttaatgggttcaggtggaacctgttaaatgcagatttggggccttgcagaagacccactggtcagaatttggcagtggggcacaagagtttatgtttttaaggggcacttacgtgcctttgtttgaggcctattgacctaagtgctttaaaatagacatttgactgctttacctatattctagaacagccacatacagcctctaatgtcagtttgaaggttaattccacttgctgctatcatcacgctgaagggaaagcataggaagtaatgattccctgctttaactgtgaaagaggcattttaaggttttggtcagagaaattgcatatgaagaggcaggagccatgtggggaaaccaggcaagagggaaggaggagaacaatgctccgtggaacacaattgatcttttatcttcttgctgtttgagaggcttgttggattcatccttaataagctttttgcagagctgttgaaggatttattcgagacaaatatgagaagaagaaatacatggaccgaagtctggacatcaatgcctttagggttggttatacatctttcaagttttgtccacaataagtaatgtgcttattaaatcaggccagagaacacgttgaagaactgctaccaaaacactccaaaaccatcttttaaaaaatgcaaaagtagaccaggtgtggtggctcatcccctaatcccatcactttgggaggctgaggtgggaggatcacttgaacctagaagtttaagaccagcctgggcaacaaagaaagacccccatctctacaaaaaatttaaaaattagccaggcatggtggtatacatgcctgtaataaccagctacttgggaggctgaggtcggaggattacgtgagccagggaggttgaggctgcagtgagctgtgattgcaccacttcattccagtctaggcaacggagtttgaccctgtctcaatataaatttttaagcaaaagtaaaaagtgccagttactgagtcaagaccatgaggcagaaacaaacttctgcctatcggtgaattcttgccttaatctgtagttagaaggtgttagtgatgattcccagttttgaattatttcttgggatggacatgttgcatatactagatcaaataaaacagtatatgtgtatatgtactacagctatatctatctacatagatatatacacacatatatacttttttcctgtaaatgaaatcaacaaaagtaggtgtaattaaatcaccagagtttccttcagtttgaccaatgtatatttccagcattacctgctgataaccagtgtgttggactgattgccaatgggacccttgtttctgagaagggtttcagagggagactggctaccagttgccaagaacacattccatcctaggcatgtttagaatctgcaatacagtatatgataactaggacaaatataacacacagggggacagacagcatgatttctgaaagaggaaaatatgcctaactaatgacagctaatggagaaccaatagatatgactatttatacctttaaataacctttgacaagattctacagaaaattctcttaggaataattggctatttatctagtcacagaagtattgagagtaagggattctccacttccagcgcaggtcctacctatctatcatctattctagttatgtaataatgatataatagccagtgaaatcactgtttgcactgagctccaagcccttctgggtaattaaaagttaagctaattggaatccacttcaggctgatcttatgaagctgtgtgaaaggggcattaactggtaggtgaatttcaacacaggcaagtaagtgtaatacatatagttaggtaaaaatgattccttctcaactgtgtatgaaggactcttaccttgcagttatccagaaaagggacttgtcaatatcatatctgtgccaagaaagaacccagtgtgcagctacagcttgcatggcatcatcaaaaacagtttagaacccaagcatacacatttcgttttatttgtagaaaactgtggtctgtctgcccagctctgttcattgtgcctaaagatatgaactcagatgaggtcagaaaagggtatctgagataattcagatgacgaaggagtagagttgctatttgtacacagctattgtggaaacagcagctctgccctcagggtattcatgatttcattgctggtatactgtacccatgaaagcaagcccggttaccggatgtttctcttaggaaggaaataacctcccatttaccaaaaagctatttcagaatttgttatttaatgtacttagatttttttcatattttgtgaagatttttatgccaataattagtatttgctaagtgaagacgtttaatatcaaatgaaaagaaactggctttgttaaaaactattctttttataatggacagataaaacatttttaacttaaatgaaatgtcgtgttaaagacatacactttgtatgagaaaaacagctgcatgtattgattataaaattattttagagaaaatgaaaattaaagtgaaatatccatacatactctcactatctttgctaataattatcttcttggtgtgttcccctttttttctaaatagtttctttttggaggcataattataatacagttatgtagacttctcgtgccttcattccacttaacatatatttctgtgttgcttatatagtgtttataatttttaattgttgcatcatctttcagtgagtagctaaatcactgaaagtaataatttatttaccatttcccttctgtggcataaatgttatttaattttttttagcataaataattctggggtgaacttggtgcatttaacctttttcatattttggactattttcgtaagatacattacaagatatggtatcatctaggtcaaaggatttcaacatttgtctcttcctagttttgccaatatactttccagaatttgtaccattttactctctcttctcagcattgtataagagtactggtttcacttcatccctcccaccattatagaaagatctttctccctgcataaagtgcattttaaattgcattttttatcactggcaagaccaaacatgtttttcatatgtatgctatactctgtattcttaaggttactttgtggttttgttttacatttagatgtttatttgattttaaaacttaatttttgttcttctaatctgtaaacttgaaattaaggtttattttctgactgttaaaaaaatgaatattgagaggacctatgattgaatttatgatatcacaaaggacataagctgagtaagatgaacttattcactagtatactgatatgaggggagacctctcaaagcatgggcaaattaaatttggggcacaggtgggcagcatactggtaaaatgttttagcgtctgtacatagcctcgactgcaaatgtcaacagtcatgagtgggttaggagggcgggcgcctaaggtgtttggaagacgcctcgtacagcattgaggccaatgtggaagaggtcaactctcatgctccacaccaagacaccgccccccaagcttgtcagacacttacgtcagaatcaatagggattggaggtgtccttttcggacacttggaattatgatttatccaactattagtcaccttgggccctgtgttctttgtcttgttaaatcattatagaaagaaaaagatgacaagtggaaaagagggagcgaaccagttccagaaaaaaaattggaacctgttgtttttgagaaggtgaaaatggtaagttgggaagtatttgcactgtatggacagcctcaggtatgtgtatatttgtgaaagggaaagtaggaggtctcgtggtgagtaccattgcaccatcacagctggggctaaagggttctgcatctggattggactgcctgctatcatttctgctctctcgttaccagttgctgcctaaatctgctctgtaagggcttcgctttggggccagatgagaactcaggaaatgcatctgttccatctaagcaagaggcacattccaagccagaatgccaaggctgagggacaccatctgagcagatgctatttccacattagtccttctcttgttagaccttctgtatcccattttctgatttcaatgaagaacagtccagaagtgaggccatattagtccattttaagtgatcccttcttatgttcttgctttgtcatgttgaaacagacacccttctttttccacaggacatattgtggctgtagtagtagaatctctaacataaaaacttggaatcttgggagagaggactttacttactattgcttaaggaagagtcttttatcatcgttctgaatcacattgtctgtggacacaatcactagtgatactggcagagtgaattaggtaatctttaaaccaacctcccttttggtgttaaagtaaaaggttttctaaccactgggagatttgttggctcttggctcttgtaccatcagatacctacctttattcttggcttttcctgggaccaaaaactgctgcttctgttggatcccctgttctgtggttgtcttggtttcagaaagatctgtctctttaggacaccagacaatcacaggcgatatctttgtttttcattttaggtttggtttatgcacttctgcctcctgacttgattctttcacctaatacttcctgagttttgtttctttggtaactctctttgaataacagcagccctacccacaagaacaccgtggctttacagtggagatgggaaaagagttcaaaaccacctgcttatttcttgctataacatattttcaccttagccacagaaaaaagaagacccacagctacctcggaaaagctccccgaaatccacagcgcctgtcatggatttgttgggccttggtaagagttggacttttcagcttccatgttcttacaaattttgataaattctcagtgaccctggaagataggtagagatggggttctccagttttgtcttcattgccaagactgttctctcacattcttcctgatctgttttacatctgagcagttgctctaaggaagtgtttactgtgacacttttcagagcgacagtgtggtgtagtggttaagagcatggcctttggagccagtgtcgctctgtgttacttactgtctgtgtgaccatgggtagtttacttaacctctgaatgttgctttcataatccgtgcagtgagaatgagtctctacttcaaaggtgttgttggaaggattaaatgagataatgcctctaaagctcttagccccatgcctggcacatactgagccctccataaatgttagcagttttgctaaacagcacctttgagcctcatgtcaattccctgtactccactccctgcccccattcctttcatttttcagatgcaacctgtttctgagatggcctgtggtcatttttctccaaacctttgaaatcctgaactagtgattctgccctttcagaaagaaagcctgttgtctgcctttcacagcactgatggttgcactttgtttccatccgcttctgctgattgaggttattggctacttaggcttctaatttctgtacctttccttgctctctgaaaatgaaccctcctccataccttgcccttcaaatagccagaagggagccagccagccccccactgtggtgctgaaatacccttcaggcctgggcgtctgctgccctgtgcctgatagctgggctacaggcttccccagagcactctgggaatgtggggtgaagcctcttttgagaagccccgtccatgctagatggttccagaagtctagatttctaggtccatgagcttatgggccacctttgctttttgtctagaatagaaggaaggcatgggcttaataagcagtgctgcatcttaacttcgatctctctttctagatgctcctgtggcctgctccattgcaaatagtaagaccagcaataccctagagaaggatttagatctgttggcctctgttccatccccttcttcttccggttccagaaaggtgagtcttgtgggctcctcaggattaaagaacattctgaaatgggtgattttgatatcttaatcatggaaccacgtcatgcttccttggtggagttggactttggttttcttgattcttcattcttcccttaacattgtgtcatttctgtcacagtctaagattgctgttcatgcctttttttctcctgctcaaaaagggtgggccatttgagttgcttctctggaaagtgtgtgatactgtgaaggctgatacttgaggctagctcctcggcctgagttactgccagaaaattgtaggtaggaaagacttgaaacctttaatggctaccattcgtgaaacgcctgctatgtctcaggcacagtgtgaggtggtttttgtatatcattttgtatatttcattaataatttcactccttcaccacaaacctgcaaagtggaaattttacagatgtggagacattagtttgtaaaagttatgtgactagcctgtggttatactagtaaatggctacactggggtctaaactcagttccctctgctgcatcatttgtgggttgttttgtttgtttgttcctaccaaatcacatgttttggtgaaaggaaagaattgtaacagagcttaattatcaggtgtgttcagatagttgaatggtaaaaatgttaggaagctattaacttgagccatgaattcttattgcagatgttaggagcagcagagagggaagggagacccttaaagagacccccatgagaaccatttcaattctccccccgccctctttgccctaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaaggtagatttcatgggtgtcatggccatgtgccaggtagagacatgagggcttccatgcaggaattatttattgtgacagaggacagttgctttgggggccaggatgtcatacaccaaacaaacctgaacatgaccaacgtatcagcagatggaaattaatgtaactcagagtcatacttctgtggagtctggggtcacaattcggtgaagtctagctcaaggtctggatctggaccctaaagggaaaatggctcggtcagcagcccattggtaagctatagcaggcctcgtagggactctaactactttgctgtgtaaagagcattgtgagtagagtaatcctgagaaattccagctggaaagggttagccagggagagttcgggctgactttatgtttttccctctttaaccaacctgtatgtgtgttttcttggcagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcaggtaagctaccccattttacttgcagcaagagttttgagccttcctcaagtttttctcggtttgtacctctccactatcctttgaatcctttccatgtagatgagataatgtaagagacattgttaggtttgctttttttttttttttttttcctagaaggtctgtctaaagtcagactttctgaggagttctgggctcctgtagaataagcccaactgcctaaatctgaatctctccacacattctcaaaagcaaaaacaaacacacaaagaaaccctgtacaaacaatgaatgcagatattctcacaacaatctcatttggtagacagaatactgcaaggttcaaatggcatggcaatgggcatataaacaccaaatccagcggagccagcatcacagaggagactgtaaaaagagaagatggagcaggggcctagcaataataccacagataaagtaaccccccagaaggagaaggacctaccctcatcaaagacatactgagaacaggtctgagatgtggtagattagaactctgtttacttggaggatcaaaaataagagacttcagatatataggagtataggtagtaaccttgggaaagcattgcttctcggggagatgggcatggcctaaaaggaggaggtaccctttagaggactggtggtgaaggaaagaaagacacgagaaatgggaatgagaatcacaaaatcaaatatacaccttcttccctcttccaaaataaccacttcactaataaaagatggtgctcttaatctaagaaatttagtaagcctccccaaaccttcacacctattattgctgattgagaaaaaataagaccttacaaaaatgaaccaaacatggaagctgacatttgtacacaactactacaggaagaaaatagaaaatgaaaatcaaaacatttcacgtaatgaatattctccctcaaaaaacagtcatgaagcagaagaaaattgttacacaatctaccaatctgaattaaatgtccttaaacatttgcagataagacaaaacaccttaaatcagaaattcaaaaacttaaagccaaaatggataaaaaactgcatgctgtgaaatgaaagtttactaaactcagaaaagaaattgaagaaaaagccaaaattttcgtataaagactcaattacaagttagctaaagaacaatagattgagctgaaaatatattcggcattgaggaaaggcatgaaacagctaagagaatgaaaactaaatatagaaagtagtaaaaagaattagatggaaattaatatggaagttaggcaaagaaaacttacatatatttggagatgcccaaagaaataaagacaaaataaataaaatatgggacagtattaatgtgtttaacaccagaaaacattctagaaataaaagacttggatataatatggaaagagcccactgtgtgtctgggaaaattgacccagaacagtcaactttaaaacatatcccagcaaatctacagactttaaagaacattcaaaatgtttaggggtccaaccttttccatacctcctacccacaaaaatctgttacttagaacaaacaaaaaatacccaggttgacatcagacttcctagcagcaaaatacaaaaagaataacaaggagagtagtattttaaagacactcaagtgtatgcaagacacaacaagtattttacaaccaagccagccaagctatccttcaggtatcaaggctgtaaaaaataaatatgcaagaactcagagaatatcacacttacaagactttcctggggaatctaacagaagataagcttcatccacctaagagatgactggggtcattttcatttttggcaaaagaactgatggtgagaattgaatgtttaattgagaatctaagactaaaacaaaggtggtgacaagcgttgcagaatatacattatattctgacaaacaaatacaactgaaaatgaaggaggagggagaaaagttgaataataaatattgtatgggaaagaagtagaaatcgaaggatgcaataagctgacaaaccaaatcacggaagcttgaataaggaaaaaggagaccaaggacattgctaaaaagtattactatgaaggtaatcactagaacaaacacgtgaaatgttctgaataccaagataattttcttcctttcttttttttttttttttttgagacaaagtctcactctgtcacccaggctggaatgcagtggcacaatctcggctcactgcaacctccgcctcctgggttcaagtgattcttctgcgtcagcctcccgagtagctgggattacaggcacccgccaccacacccggttaattttttttgtattttttagtagagacggggtttcaccatgttggccaggctagtctcaaactcctgacctcaggtgatccacccaccttggcctcccaaagtgctgggattacaggcatgagccactgcgcccagctgagaatttttaaaaacagactacaaagtgcagcaaatacaataaacacagtaaaaatctaatatgatggagttgagaccaaacataccagtcataccagtaggcaactcttctatcaaaagaaaatgatgttcaaattggctaacaaagcaacactagttttgcactaggtacaaagaaatacaaagtgatttaatgtgaaaaccaagagacaggcaaaggaaccccagagaggtggtatggtgcatgtgtactgcacatgtgcatgtatagctatctttatcagggttatacttatttataagaagtacttttatgtttttgtttctctgtggtccagaataatttatgtagctctggtctttgaaggttttgtggaattcccatgtgaagtttgtgggcactattgctttttttgtagcaaatctttgatacttttctctgtttcttctatggaagtcaattttggaaaactgtatttacctagattttccatttcgccaaggttttcaaatttatcaaaagttatgcctagcagtctcattaatttttttcaaagaaccaggatttcgatttattggtgctacatttttccgttttctacctcaatttccgtaggctttctatgggtttactttgttattttctagctttcatagtggagattttaattcacttattttcattgtttcgtttttatttatataagtaatggaatgctataagtctgatgggaatatgtcagagggacgcatgagccaacttccagtggctctgactggccaaatgtgagacaatttgaacatcaaaaagagtaacaacagtaatggattatgacacactgaatggaaaaaacaaaacaaaaccatgagtccacggtgatattttttaaaaaccaggtgtggaatggagggaggaaaagccttctttacagaagaatgacagtagttgtaaaaagagcaaaggattgacacatttgcaaagaaatgcccttcagattatttattaattataatgaaagaaatatagtcactacctcagccaagtgatcaaacataaaattactgacagaggaacaaagtaatgtcatatgcttcctgatattttgtactaagaaagacatgtgtcacctccatagaatcttgccaaaaatattgaacctcgatccaattatgagaaaacatgagatgaatccaaattgaggggtatgctacaaaataactgtcctgggttcttaaaaatgtcagtgtcaggaagaaatggaaggaagtgttagggaaactggtctagcttaaaggagactacagagatctgaaaatgaaatgccatgtacattagaatatggtgttaatgttaaaattcttgagcgtgttcattgttttgtggttctgttaaagtgttcattcttatgaggtgcctcctgacttaggaatgaaatgtcgtgatagctgcagcttttttttttttttaatctgcaacttttgatactcatcaaaaaaatgtaagtttttttatagggagggagagaaaatatggcaaatgttaacagttggtgaatttaaggaagaagatacatgggttttattgtactattgtttcaacttttatgtcagtttgaaatttactttaaaagttggtacaagaaaataatagtttctcctaaagaaaaataacttatatagaaaatttactaggcttaggaaattcaaggcatttttctccataaagtatttttctgttcactgctaggggccagtctttccatcagattcatgaaggacccccgccccatcctgccccaggccttattccactgactgttttctcccagctccttcccttcttatacactgaagacacattagtcttcccccgcccccgccccgccaccgcctttgttcattctgaacagtccagttcctttttttcccccttgtgcaaacgagcaagcctgctcaagcgctttccctgacactgacagtaatagctgtgctgaagatgaggcgggagcactggggagggggctttcctttcagcttttaggattggccaggcaagttaacaataggccccttctatttaggatgagggactggaaaggaaaaagagaggaactcatgctgattttctgtcgactagatccagatgccaggatgccttctttccctccctgagctttagtctccgtcagcattgcactcccaaaaggtcattcacgtacgtggccttgaaatgatctgactgctaaggtccagggtttactgtccataacagagtttccctttgtctcattctccccatcctggcagagaaagggactctcaccctgccttttgcactaattggcggaatgcccacagcctggtctgaaagtctcctctctccctttcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggactgtttgcttggccatta

SEQ ID NO: 10869 - DNA, 969 bp, Homo sapiens
gacaggtctgagcatggtgccgattaaattctccattgaaatgtacctttgtgggtacattaaattattttagcataagtctagtgaagtgccagcagtagatactatgttatttctggagctcttgatgttgatttttgaggctgaacatgctcttagcctcaagcaggtcatatttggaatacctgatgtgtgctcctggttgctcagtgcttaggatgcataaacaggtagctgcagtctcatctctcagtatatatacttttcagcaaatcttttttttctagataaattggaaaactaccttttttctgcatttttcatctgatgtcattatggtatgtaggtggcagctttcttgggcacagttgtctatataactgttcatcacatgagtcattgtctgtttctgttcttctgcctgaaaattccatcttggaaatcgtgtcatgcaatcggtgactgcgacattctacttgttatgtacactgccactggctttgtatgttatgttgatggactctacctgtgctacagtgaagggataaagtgacttattaaattgagtcagactcagttcctccaaatggtatttcctgtaaaaatgatgccaagcaagattctgcataaaacatgcatatgctttacactgtaagcatacagtgcctaccttttgttattgtgtctgcttaaatccttaccacagttgtactcctgtttgatcaagtggccagtttaactagatactagctttgaagaagttctgtattggcccctggaatgtgacagttcataccacattgaaaaggtaagaaccaagtctttgtagagtagaacaccttaaagttaatccacttttaccaaattcctctattgttaaagcaacagtcctatattggctaatttttaaaatcataatgtgccacactttacacatccctagaatgtaagctagggggcaggggccta

SEQ ID NO: 10870 - DNA, 365 bp, Homo sapiens
ggaagcagatgtgtacaaatataaatgatgcaatacagaaattattgtggcatggtatacagggagaaatgaaagcattgaagaaggcaaagaagtcttcctcgggaagtcatggcttcaaagagaaaagtaggctgtgtcttaaaggataagtatgactttgccaagctaatttagggaactttgtattctaggaagagggaacagaatgtgcaaagcctcgaaggtgcactgttttgtgtgtgtgtgtgtgcgtgtggggattctttagtatattttgactgcatgttgaggagtgatgaggagtagagtttgacaggtagtcaggatactgtaaggttaaaacctgagctctgtggttgact

SEQ ID NO: 10871 - DNA, 208 bp, Homo sapiens
ctaggcaaattggctcctgtattgaatatgtatttgactgttggctgctgccaggagcaacttatcgtttggttactcagaaaataagttcccaccctgtcaattctgggaagtcttaggtatggtgtatccacattgagtatatctacaactggacagcttgagttagtcacacagaagccatacacagaaaatgttgaggattgca

SEQ ID NO: 10872 - DNA, 8473 bp, Homo sapiens; identical to SEQ ID NO: 6429

SEQ ID NO: 10873 - DNA, 438 bp, Homo sapiens; identical to SEQ ID NO: 6430

SEQ ID NO: 10874 - DNA, 6195 bp, Homo sapiens; identical to SEQ ID NO: 6431

SEQ ID NO: 10875 - DNA, 4217 bp, Homo sapiens
gtggacactatatagcctactgccgaaacaatctaaataatctctggtatgaatttgatgatcagagtgtcactgaagtttcagaatctactgtacaaaatgcagaagcttacgttcttttctataggtaatggaaataagtgtagatgcgaaaggacatctctcacattttgggcttatcagtgacttctaagacattctaatggattgctgagtcaagattaggaattgttttcctcctatttcattacagtaaaatacagtgaaaggctgtatatgtagaatgattctttgttcagaaaatgctaaatcatttacttgaagagcaaagggatatattttgttttagaaagattaattttagtgccgggcacagtggctcaggcctgtaatcccagcactttgggaggccaaggcgggtggatcacgaggtcaggagttcaagaccagcctggccaagatggtgaaaccctgtctctactaaaaatacaaaaattagtcaggtgtggtggcaggtgcctgtaatcccagctactggggaggctgaggcaggagaatcgcttgaacccggcgggtgggggttgcagtgagcctagattgcgccactgcactccagcctcggcaacagagtgagacgccatctgaaaaaaaaagaaaaagaaagattaggtttaatttaaaaattaggcattgatggtctgaattaagtaccaaattttctcccaaagtagctaataatgaaagtattactataaaaatatttgtttttttttagcatcttataaaagaagatgctagcttctgaaacagaagcagattaattatttagcttgatcttattaacaaacatttgaatgcttactgtgttccagtagttatgtggatacctgtaggtaagatacagtttcatccctatgagtatataatgtatttggtggataatacaaagtatatttctcttgaaattcccaagacctaataaagatagtgttaatatgtgtgttaagtctaataagaagaaaaatccatctactagtaatgtagtaaaatgcatattgaatttaactaatcattgtccttaataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtaagaactcctgtaatgcaaaccggtagtagaagtttgctgtaaaataatttgcaaattaggagagccaagaattttcctctcccacttatttcccatttccccacctgcattcaaacttaatgtgttttaattccatatggtttcagaaattcacccttcctttttaattgtaggtaatctctagcttctttattgaacatatatttactgagtacatgctttctaaactttttgctagtgcctaaggacactaaaaatcctttttcttctgtgaaagctctaatttcatagtagagtaagatacataaacagctgtttacattacagtgagctcctctattatacatcatttttcctacctgaggcattcctgtgctggtgattttatctatcgactatattggtggttcttaaccccattgtctaaatgaatagctggcttttttcccaagtatggaaatgtatctgggatttaagaaaaaaaagcctcataattaaatataactttggcccttgtgagattggctgtgttaatgtttatttctacaataaataggacctttgtgtgatgccaattaaacttcaaggttgaagatgggatattcatggtaattatgtttgtagtgaaaccagaagggatagggatacctgtattggacatagaaattttaaggtgtatgttcatcttgaggaaacacaatcaccaaaaatgctttataattaccgttcttgggagagagagtgtaagaataatgattgagctgggtgcagtggctcacacctgtaatctcattgtctcaggaggctgaggcaggaggactccttgagccctagagtttgaggttgcagtgagccatggtcatgctgctgcactccagcctgggtgacagagtgagaccttgactcaaaaaaatggccagacacaatggctcatgcctctaagctcagcactttgggaggccaaagcaggaggatcacttgaggtcatgagtttgagaccagcctgggcaacataatgagagcctgtttctacaaaaaaaaaaaaaaaaaaaagaaaagttagctgggtgtgttgaagcatgcctgtagtcccagctactcaggacgctggggtgggaggatgccttgagcccaggaattttgaggctgctgtgagccatgatcatgccactgcactctctggactgggtgacagaacaagacccttccacttaaaaaaacaatgatgattgatctgtcatttagttactgttaaaaaaaaaatgagtttaatgtttgaaaggaatataattaaaagcatgaaacagatatgtttatatatttttttaggtgttcctccaagaaaagctggttatattgaagacctggttttgatgctgcctcagaacatttgggataacctatatagcaggtttgttttttaaatcagaccatacagtgttgtgaaagtcggttaaactggttaaaaggggtttggattatttcagagatgctccttgtgctatgtgtttattcttttcccttacttattcattctaaagtgtgagtaggaagactttgtagctactgtggcatagtctagataattaattttaattttttctaattatctatctgtgaaggtatgctgtggtaatttaagtaccttgtttaaaatactttgcatatccccacactaaaattttacatatgtatatactcacacaattgagtatcttactcttaaattgtaaatttttttttctttttttttgagacaaggtcttgctccatcaaccaggctggagtgcagtggcacgatcttggcttactgcagcgtcgacctcctaggctccagtggtcctctcacttcagcctgcctagtagctgggatcacaggcgtgcatcaccatgtctggctaattttggggtgttttttgtagagatggggttttgccatgttgcctgggctgatcttgaactcctgggctgatcttgaactcctgggctcaagccatgtggctgctttggcctcccaaagtccaaagtattgggattacaggcatgcatcactgggcctggccttaacatcgtaaactttaaaattttaagatggagtctcgctctgtcgcccagtcgggagtgcagtggtgcaatctcagctcactgcaacctctgcctcccagtttcaagcgattttgtgcctcaccctcccaagtacctgggattacaggcacacatcaccatgcctggctaatgtttatatttttaatagagacggggtttcaccacattggccaggttggtctcgcaactcctgacctttattttaaaacattttccaccacagttttcctactaattatgttttctttaattaaatattaaaaataattcatacattgaatgcttcttacttgagaggccaggggaggccttcatctgatgaaaacttgactatgactgtgatgtgtaactaagatttatatgttgtatgatactttttgaaaccacttcttttagtttgttgttggctctaacattttggagcagaaataagggaaagttgaaatatagataaagcaggttaagcaataaactgataaagtcactgaccttaataaacataataacaagtccttatatgatttttgatttttatattactttgagaattttattaagaggatttatttttactgggtatttggccactgacttaaatgttagaaacaaacttcctagaacattaattcttaaatttttcatgctttaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaa

SEQ ID NO: 10876 - DNA, 580 bp, Homo sapiens
tcataaaatcaaaagcatgaacaaccaggttttatgggcaaggactagtacccttccaattattgacgtagcaagaagtctctgcagtactgttgtcagtaacataactccaactatttaagacaattgaaaatttggatcacttgagagacacgtttattcataaatctactgagacactattatggggaggagtaatactgcaagaaaaaaattgggattcttttagtaaaagcagtggagaagatattgagcagatcaaaataagatgtccagtatgttttgtattattcatttcctgcacatgtgtagacacacacacacacctgcttttcctcattgattcagggctttttttgtgcccttgcctaaagtaaagtaaattttacataaaaaagatgcaggtatagatttatttattttacatgggcttcatttgcttcttgaatctaaggaagcaaactttagttgaatattaaaaatagttttttccatcaatgcttaaataatggctaatgactgtgtctgtcaggatttgattaatagtagctattctaagtattttgaatagaatcagaat

SEQ ID NO: 10877 - DNA, 204 bp, Homo sapiens
tccaattactcaggaggctgaggcaagaggatagcttgagcccagaaatttgaggctgcagtgagctgtgatcccttcactgaacgccagcttgggcaacagagcaagactgtgtctattaaaaaataaaaaaatttaaaaaattacatgttctgtcgtcaggtgatgaaggaatggtggcaagcgtgcaaactgaaaaaaaaa

SEQ ID NO: 10878 - DNA, 1288 bp, Homo sapiens
attaaatggttattctagctcctcttaacaatgaaagtgatcactctctggaaccattggaaataggtcattatatcatatgaaatgtattcttgaattctaatgactattattttaaaagtgctcttcattcagatgacaactcagttaaaatatttttcaacaatgatgaattattttgcattaattattttttctgtttggttattggtttaacactctggagatgagcaaagaaaaaatatttaagtctgcctttcggaaaaaccattgtactctcagtgtcttccatcatttcttacctacaaatgttgttttgtttaaggaagggttcttgacatttgccgtgtaaggttatagaataaataaagagtttatttacctacggtagtggtgatttagtttatttttaattcttactgtctattataggtgtaactcattgattttagttacaagtttttaatttaaagtttctatccccaaaactattgccctcgaaagtatcaaattactataaaatatgaaaccttaaatactttgacacttatgtaaactagggtaacatcattttcattacgtatgggaaagtacatatctaaatatatttttgaccaaatatatttgtcaaaatttttaggccagtttattttgtcccaatatttgagcaaagttgagtggatattaagagtgggtttcctcaaattatgaggaacaaaggcataatgcctggcacaaaggagaccctgagtgaatcacattgctttttaaaaatttgttttgatcacttaagaaaaaataagtcatgtttttggtatatgtctcaatgtaagaaataaaactttatacaaatatttgaatttactcacagctaattaggtttttaaaaagcgttaaaatttgtgacatgtatttctatcaaattgtatacacactcattttttaatttaaggaatcaaggatttatagatacagttttgttatgcatattgaacctatgaacaatagctacatttctaagtatcttttgtgaagttagttgttttaatgatactaaagatatggcacttgggcttgtctttaagaatccctccagttatgcatatttttatttataaatagacatttttctctggcaacagcttttattattctctcagaggttcacagccttccaaaatttaagaaccactgtttttttttttgttttttgttttttgtttttgagacggagttttgctcttgttgcccaggctggagtgcagtggcgcgatctctgctcactgca

SEQ ID NO: 10879 - DNA, 1288 bp, Homo sapiens; identical to SEQ ID NO: 10878

SEQ ID NO: 10880 - DNA, 194 bp, Homo sapiens
ccaggttcacgccattctcctgcctcagcctcgcgagtagctgggactacaggcgcccgccaccgcgcccggctaatttttttttgtatttttagtagagacagggtttcaccatgttagccaggatggtctcgatctcctgacttcgtggtctgcccgcctcggcctcccaaagtgctgggattacaggcgtg

SEQ ID NO: 10881 - DNA, 501 bp, Homo sapiens
aaattgggtaaagtattataaacagtagtaggaaaaaaatatactacatgagggatcattgcagtagagaaaaacactttttagttatcttctgcccataatgtacccataaagtgtacccataatgacagaacaatttgggcaaatgtgcttgtactccaggagtcctgaaggcatagttcaatgtgaccctttgagaaatctatgattctttgcagtcttcatttttatcttaagaattcatgcagattttgcatctgctactccataatgtttattttagtataaaaatatttaaatttttaaaattaacatcacttatccccactgctgtataccttgatttggaaagtaaggtggtatgcacaatcacattgaattcatagtaagtgctgagcagattggtatcttatgtttgtcgaatgtttgagttgcacacacaaattaggcttctagaacctatacaggaaaatcatcacttggtcttggacattaaaaaaa

SEQ ID NO: 10882 - DNA, 501 bp, Homo sapiens; identical to SEQ ID NO: 10881

SEQ ID NO: 10883 - DNA, 194 bp, Homo sapiens; identical to SEQ ID NO: 10880

SEQ ID NO: 10884 - DNA, 164 bp, Homo sapiens
ccacctgagtaaagagaagtcggccgggcgcggtggctcacgcctgtaatcccagtactttgggaggccgaggcggcagatcacgaggtcaggagatcgagaccatcgtggctaacacagtgaaaccccgtctctactaaaaatacaaaaaaaaaaaaaaaaaa

SEQ ID NO: 10885 - DNA, 105 bp, Homo sapiens
tgggaggccgaggcaggcgaatcaccaggtcaggagatcgagaccatcctggctaacacagtgaaaccctgtctctactaaaaaaaaaaaaacaaaacaaaaaaa

SEQ ID NO: 10886 - DNA, 148 bp, Homo sapiens
gccaggcgcggtggctcacgcctgtaatcccagcactttgggaggccaaggcgggcagatcacgaggtcaggagatcgagaccatcctggctaacacggtgaaaccccgtctctactaaaaaatacaaaaaaaaaaaaaaaaaaaata

SEQ ID NO: 10887 - DNA, 119 bp, Homo sapiens
cctgtaatccccgcacttggggaggccaaggcgggtggatcacgaggtcaggagatcgagaccatcctggctaacacggtgaaaccccgtctctactaaaaaaaaatataaaaaattag

SEQ ID NO: 10888 - DNA, 142 bp, Homo sapiens
catagtaaatgattccatttttttatttatgacttcatgactaccattaagaaaatataacctgttgggaaactgtttctgccttgatgatgttgtacagacaagagataaacagtgaggaatatgcttagatgtattggga

SEQ ID NO: 10889 - DNA, 131 bp, Homo sapiens
ttttttttttgagatggagtctcgctctgtcgtccaggctggagtgcggtggcgcgatcttggctcactgcaagctccacctcctgggttcccgccattctcctgcctcagcctcccaagtagctgggact

SEQ ID NO: 10890 - DNA, 39969 bp, Homo sapiens
caaccttcagaacaagctagaggttttaaatcaacgctggcaaaatgttttggaaaaaacagaacaaaggaagcagcagctggatggtgccttgcgccaggtgagtaagagaataaattctgaaagtttttatagcattcaagaccaaaatagcatggaattcttttattagttcacagactcctgtttaatttttataccttaaggagaggagtaaaaataagtgaaataaagaacagaacagcagaagagaacacagctttctagttcttagcataatactcttatctactagagctctcctgatgaagaaaggcaaatctaatggtacctggctgttcttaagaatgcatagagaggcttagcaggctgggattgtttgaagcttatttcctgcttgaaactgacagtgtttatggccccaacttaaaactgcctattacttcaggccaaagggttccatggcgaaattgaggatttgcagcagtggctgactgacacggagcgtcatctgttggcatctaaaccgctgggaggtttaccggaaacagccaaggagcagcttaatgtccatatggtaagcaaagtatttcctacagctttagcctcagaataacaaactgaccatgttatatgggccctggcgatacataaatcgtgggagaaggctttaaagatatagtttatggcagaaatcactgtgtatacatgttagaaacacaccatttattgattaaaattttaaagtcagaacccattctttatttctttctttttttaattttattattattatactttaagttttagggtacatgtgcacaatgtgcaggttagttacatatgtatacatgtgccatgctggtgtcctgcacccattaactcgtcatttagcattaggtgtatctcctaatgctatctgtcccccctcccctgaccccacaacagtccccagagtgtgatgttccccttcctgtgtccatgtgttctcattgttcagttcccacctatgagtgagaatatgcagtgtttgggtttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaaaggttagtgtgtcagtatgttttagaattctagacactttttagacacaaaccttcccccacaaaataagcctgtatgggtggtggtaatataacacagtgtaaattattaaattattgtgccttgaagtgtaaagaaaaacctccaaaataatcagaatgacttaaaattattgttataagcatgattgtctcatttggtttcatggaaggttagaaaatatactcttgttccgttaaaaaaaaaaaacttccttgtttgttttaatggtgatagagctttatcttcaacttcatacttacaccaaatacagacacaaagaggaggcttctgtttaactgtccagtctggagtgttgtacctgtgcgctgttcctacctagatcatgtgacacagttggctcctaagaaagatgaggaaaaaatgatgagacttgaaatgtgggctttctttcatagaaatggggactgtgaaattaaatttaggctactttggatttattgacattttaaattcatattccattgtaattcagcactagaagttctgagaggaaacagtgtttcagattttgaaagagtcccctaattttttacttttgtgaatttacatcagaaattttttaaaatattcaaatactgatgattattatcttgggagataaaagtagaagtacttagaaatttggcaaaagaaatagatcagtgtacatcaatatctacactctttaatagagatataatgttgttgtaagatcttaataaaactgctcttatttggaaataattttgaatttagtgatttgaggagggcgtaaccatcatgtagatgttgtaaagaaataaaacagattatgacagtaggtagcatcatatttatttcacaatcaccatcagtagtttaagtaagtcctactaattcggtgtagaattttctagaaatctttatggtatacttattgttttagaaagttatgtatgtggtttttgttgttgtcgttattggtttttagtgccacaggagacctatttgtttcactggaaaagtaatagactaaacttgtaagtgcttatcttcctttttgaaaaaaaacctgagaaacttccagatagctccttactttcctggaaagtacttgcacagctttgacagtgtccattaattataagtttaatgaactcatgaacagatagatgcttgggattattttctaataatataaatatttttaaaatgttaacttagaagaatataagaacttgaaagcaaagaacctacctttaagaatactttacttttagaaaatattccatttcagcgaactgagtttgggcggggtatttaaaatgaatcttttgtaaccctatataataaatcatagaaatctgtttaaataagtttaaatttgtgatttaaagcattctaaagagttgttgatatttgtaatatcatttcaataaagttcttttgattttgttgtgctagaaatgaagaaaagtacaaaacttacaatattagtttcctgagtttttagctatatctgaaagttttgctttaggatttaaagcttttagtagatgatattgtaaatatatttatatagggctttttttaaagcttaagaaataaatttttgaggtgatgaaaatgttctggagttagtggtgattacaaaaccttgtgaatataattttaaaaacactgaattgtatacttataatagtgtattttatattatatgagttatattgcaagttttaaaacgtataaagttgaaaatgtgagacataaaatatataatctttcagtgagaactatgatttaacccacattatagttgaataaataaaatagaactagtcttaattttttaaatgagaagtaactgttgttttgttggtcttaaactttgaatttgtttaagcaatattttatgtcctgtatagaagatacatacaacattctagttagaagctttagaaatgttctaaatgagaataatattcatagtaccacaagtttgattcttataattctgaataatcaacttaaatatattactgtgctggttatttactttctatccattgcatgttttctgagtgcagaattaaatcgtaccaatgaaatactacattcattgtatcatagtacaaggagggatctacgagagcctctcattttacagaggaaggaattgaggctcagagagatgaaattacttgcccaaactcacagaactaattagttactgtacagtgaaagctttcttgacagcatttaaactgttgcttcaaatcttagcatgccagaatgggctgataatgataacaccattttttagatttcccagtagacagggtatgactgtaggtttaattgttgtttcaatgtagtgaaaagtataaatgcgtcaaggttgccctgagagagcaaacagagatgaatatatgatgaggagcttgggactgatgacctagaaaaatagaactcttaaattttactttcttaaagtgatataacttgagggtatctcaatttaggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaagtatgtgctttgattaatataatagaatcagtgttttagttgtttcatgtcttggacttggccttatttctgagtagagctatcaggagtagaactttcaatgatttatgtttaaacattttttgtatatatttggagatttcatggggtagttgaaaataatattctgttttaacatgagaacatatttaaaggggtgggatatattcaaaaatagataaatatatagatcaaatgttacttagttatatttttaaatgttaagaactactcaaattctgggtcattaaataattaattctattttaatctaattaaacaaaagactatatatatgggtgagggagagagggaaagcaagagagtgagatgattgtgtatattcttttaagtacttacatttaaaaattcatgagaatggattaaaatgtatattaaattatgaatatgtctttgttacttttttaaaaccgcaaaactgacaatctaagaaatctcaatattgcatgaaaaaaacaataggcaagaaatacaagattatatgccatcactgatggagcataaagtatgtatttcataatattttgagtccccaaattaattgtatgaatgtcaacttttctttttacagattatatttagtaattgtgttctttggttaatttccaaaaaacatgctttagcgtatattaatttttttttagttacagtgagatgctgcttactaggcttaaagggttttggtttgccagtattttagtgaggcccattacatttataagatatttagttaatatattaatagatatgcataaataaagtggggataggaaaggaatctgccagagaatatttaaactgaaacaaacaaaataaccaaggcccttaaacatcacatactaaacaatctgtccttgcagactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtatgtagtgagtcaaatagataggattctcttttcagacaccaggcttttttttttttttttgagactgagtctcactcctctgtcgtccaggactgtggtggtgtgatcttggcttacttcaacctctgcctcccggttcaagcgattcttgtgcctcagcctccccacaggtagctaggattataggtgcccaccagcatgcctggctaatttttgtatttttagtagagatggggtttcagcatgtttgccaggctagtcttgaactcctgacctcaagtgatccacccacctcagcctccaaaagtgctgatcacaggcgtgagccactgcacccggctgacagcaggcctttttaaagtcaaaagcatgcatttggtatttcgaaagctttcgtttgtcctttaaaataatttcaggtttatgacaccagaagcatttttaagattgatctgattttcatttgtttctacttatttcctttttttctgggaaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcaggtaataaccctttagaaaaattctctgaacttgtcaataaaccacttcttgctgttgaaatatatgttatggatgtacttttatcacaggctgtattaggcataacaatcatggcatggtgccatggtggttctttcctaaaagggctgtggcctcagtttggatgctgacatcactttttgacctggcagcaatttcagcccctggggactaatcttaagaagactgattatagcttgacttcatagacaggctattatcattgaggcccagaaagaagctcagaatttttttttattgggtttgttttctttttctttgtccttttgacctctgttctcataatcagagtgagacatcatacttcattgtattgctaccttttgtttagttcctaagccagactttcttcacaagctatcagtgctgagagccagacatgtagccctcccgacagctttctgaaggggcatattctctgtctgagttggtcggcactccccacctctttgaacacttgttgacagaccttcatttcttctctaatattttgagcagataatagagctccatctcactttgaaattaatttttttgaatcttttggggccactttaaaattttaatctagagattttcacaaatttcacagagaactctcctctccttactccctttacctgttgttaacattccattctagactaaacacaaagaggtaaagttatgcatctctgtgtgtctttgtactccatggaagagagaggtgtacctacctcgcttgacaaatatatatatttttaaacatttgatttttactagaaatttagtgtaatattgtaggaggattttacaattactttttgcctcagtcagctgcaattttctagccttagtgttgtaccccattgttttgaggagttaagctcagttgggtgatgcaaaaagatgtcacgggagtcaggtgtttcaatgtttaatgctaacagtacaaatgtttgaaggcttgagaaatgacaaattgcattgttatagcattacacaccatagaccccattttgaatgggaggtgtgaaatgttcagtgttacaaatgagtcactgggatatactccatctctaatgtttctttaagacagtattaattctcagcctgacagttttctctccacattatgtggtgcaataacatgtgtagtgccggcatttcttgagttatgaacatcagtttataaatgtttcttggatatcagtagccagttgctcatctttttcctcctttctcgatttaatcaattttattttctcattttgtctaattaactttataaatatttgctactgtttttagtgcaaatgtatagcatttcctctatttatatggcttaaaaatagttttgaaagcagaaccagcctcagaacttgtgcgtttgtatcattgaccttaccatccaactgttatagcctgtattatttggagtcaaactacctaacaccttgactagctgtttctactatttatttcttcttcttctaatatctcagtttttggctcagatattgatcatacttctctgactttcacaattcatgtgtctattctagtttccatttttccatgttttaattgattaaagttgtgagagggatatgaaggtttgtaatgagatgatctccagagagcccttacagttttgtgagtctgtgtccttactctgctcttattgttaaatatcttgttgttatttcattattcatgtgctttggtatacaatagatttaattttgattactaaattttttgttaggtatctgttcacttaagcttattgtgacaaataatttataaccaatttcacaattgtatcagaaaatagtacctgctggttcttgatgacaaaccgaaaagaaactgtgctcaaaatcaaatatatatagtaccagaatgtttgcaaggttatagatgccaaagagaataacattgtgttagaacccaaatattgtggctgctcagtcatataaaaccaatatgtgaggcacaggcattgatttgaggatattgatagcagcaataaagatgttgaactatctttgcattaaataggaatgcaatggcctcttttttgtttttgctactttaaaaaatcaatttacaagctttatacttacccctccccatttttgttcctctttcttaacatagggattaaattccctagaagtaaacccagatctgtcaacagacagcagtaaacaacagcaacaacaaaaatacaaaacattttctgagagtttatgttaattattgaacaagaagaaagtataaggaagaagttctttctgtagcttcctaacttttttctaggctcttttagagctgatatgttgaatgaattaaaacaaagtgacagtggggcacagccacaaatgctaagcattatcaagactttttttgtaatttgctgatgaaagcattacttttttcttcttcagtggaaattttgaaataataattttcaggattttcatcactattaatctctgtcttaaaactgtgctagatctcaagtataatatgcttgaaaaattttcagacaaaggtgtgaatttctttctagttccatgaagcttggagtaaacttatggagtggctagaagagtcagaaaagtctttggattctgaactggaaatcgcaaatgatccagacaaaataaaaacacaacttgcacaacataaggtgggtccataattaagaagagcatattgtctcattatatagttcaagatcactttaaaatccttacttcatcacgtgtttattcatcactaaagaaaaaatgtaggtccagtgtgaacctgtattaaatttaaaagctattgctcttcatgttgcttatgttgcaatatcttcactcttcagtgaccatttcactaatgattcccaggttaattgttaaaaagaaaaacatacaaaataaaaatggaaatcctctacaatctaaaacatataaaggatttgtagtggttttaaacattggcatttcagtttttcatgatagctgtcttttcctgtactttctttgacagacaaaatagcaccttgaaggtaattctgtagtaaaaagtaatagatattttgcggtatggattcttttaaacaatagagtgagaaaaattggatgcttgtacctaaattgtaaattaatattttattgtgtttgtgcacgtataaaattccacccaacctcaaaggtacccaaagacatgtttatatagactagaaaagcatgtagaaacattgttttttaaatattttctaccttttctatgcctatcatattttatatcttccacatgacattcaaagagcattccctcccaccctccccagctcttttgaatttggatttttatgtaattctatttataaagttgaccccaccagccatcaggatgaggatgtgggtaaaaggagagtgattcttgcaaagggttttacaattttaggcacgtacatataaattatcgcttgaaacataatttttaaaggctggaaaaattggggtgatataaaatttgtcatcatcaggaggaaatcctggccatcatcttcacataggttggctgcttgcatcagtgggtctaaccttaggaggtcatgattagagggatgggaggaaacatattgagcatctgttccctggccagatgagggctaatgaatggcttgctctgctggcaccctttgcctgtgagctgccacattcaatattgggagcacagtgacagtgaacagcaccttccttccttcccctctgatggcgaaatgagagcttccttctcaaaacagaatgctttatttgaacttgaatgtggatgttgtatcgtgtagtcttatgaaagtatattacatattaaagttagagagtcctataaataagaatatctacctttttaaagtctctatttggcaacagtgacctgtattcaaccataacattttttgtatatctgctttgtgaagaaaatctctgtcaataccatgattctataacactggcattctgtttagcataatatgaaaaaaaatttatggataactgtagaaataatgtgattgtaattgtgttgtctattacttagaaatttccagatgtagttgcctattacccatgacaaattaaataatttagtcatattaaaacactttaaagtatgtagcttttaaaggccgtaaaaacttcttaggtaattataaccttgagattattttagaaaagtgtacatttgcatagcattttactatctagggtaattttaatttgctacaaggattgagaatcactgtattaatgtttccattatattttgtgagtttgtaagcttcccattaagttgacctttctttgttctcattcctgctattgtatattcagtaacagttatctcattctttctactcttcctattgaatatttataaacatctactaggtgtaagatgataatgagaggcctacaaagacaatgtccctgctctataaaagcttatgattgagttgtgtagaaagactatacagatgctcctcaacttacgatgggtttttatccccataaaccctctgtaagttgaaaatacggtaaataaaaaatgcatttaatacacctaacattagcttacaataggacaagatcatctaacccaaaacctgtttctataataaagtgttgaatatcttaggtactttattgaataggtgactgaagtatggtttctactgaatccctatggctttcgtaccatggtaaagtcaaaaaatcctaagtcaagtcattataagtcagaaagcatctataattcatctccatttattagggatgcctctgttaatgcctcttacctgtttattagtcccaagaagaaattcgcatttttttcttgttaaatatttaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaaggtaaaatgttctttaagacagtttggttactctgtagacctctttcaaatacacagtaatggtgctttgcggggacatttcgggaaccttaaatatttcctttgcctgaggaacttctgcttgtcctaagtatcccacacacatagcacttgcattgagaagtctttgctgttcattaatttttaactactcattacaataaaaagtgatatcattgtccaagcttctgccatctcagacttgactacacccactgcttctgactcgtcttcccatgtccacttttatcacttctttgacttaatttctacataactactggatagtcttttaaaaatgtaaatggaatcttgtcattcccctccttcacaccctttggtgacttactactgggcatgcattgaaacacaggcttcttaatgtgacgtgcaaggtaccactgatctggccccagcatttctttccaactccatctacccctttctgatctccctctttctcattacatttccatgaaaacccaagacatatttcaaaaattttaagtatttaattgagtacaatagtagtagagttcaaatatattgtacatgtttccaaattttcccgctgatccttaatcttaatgatttttgtcagtatcaagattaaatagattatattcagttctggggaactcacagtaagtttttgtcatgttagttttgaaaaaatcctttttttttttttttttttttttttgagacggagtctcgctctgtcacccaggctggagtgcagtggcgggatctcggctcactgcgagctctgcctcccgggttcacgccattctcctgcctcagcctcccaagcagctgggaccacaggcgtccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcctggcccttgaaaaaatcttaaattcctcagccacagcatgttacataccttttccagtgttgtatgcatggttttatttacaagatttttgaaaagacaaaaaaataaagtcctgacaaacggatcaatgaatgctaggggtttgaaggcgggggcagggcgtgtctataaagagacagcacgaggaagatttttgggatggttgaactgttctggatcttgattgtggtgatgattacgtgaatctatacatgtgttaaaatgtatagaagtgtataccaaaaaatgtcaagtttactgcctgataatctaaaacaaaattttaaaaatatttaaacagtttaaaaggcttatttttatgaagaaacatgaagggtccatggtttccaaaggtgggaattttcctggaacagatgccatgtatttaaggaataagaaagaaagtttagaaaagttttgtctttttcctaagaagagcaaagaaacaacaatgaataccaacatactgctcttccccttgagtaccactcaaccttcatcaattaattttagatgttcagatatatgagtgacgttttttgttgcaaggatcaatttttctacctttttccctagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtgtccgtttgagcagaacctggaagcaaactttaaaagtgatggggaagtattatttagtgtcagtgaaatacttttgcttttaattaccagatctaaaacctttttagaacttggaaagtgatttcattctctggtgctttaaaacagatttcaagaatgttttactatctttagttatgcacttaaacaattatgtaataaaatttaaaatcattcattcagtgacctgacactaagtcattgcataagtatgtagatttgtgacatgacccatggtggtcatgaccaactgcttttaaaaataccgaaccaaaactgttttaaccttgccccttgaattatagcagtttatgagtcagcagcttatgctataagggatttgattattatttacttcgagaaaactggcttccttgaaatctcctgatatgcatgtaaaactgtcatgtcatgtaaatcaaaggtaatattcaaggtgtccaactaagtgtaaggtccaaaataatgaccaaatgatataaagcaacttagccttggaaacaatatgaagcatagtactaatgtagaatagttgtattggagttgactttatataaaaatgtcttacatcactctacttaaattcatcttgtatttcttctctctagtatctgagttcagaaaacttattccatttataatgttctctttatattggttatgctattttgatcttaccattctttttaaaagtcttattacatatttatttttccttttttctttctattctatcattatacccataagagagtttgttacacctgaaaagtgaaacaaactaaattaaaataaaataaaagaataaataaagaacattggtcaagtctacaaaagttaaaaatttaaaaatcacatggctttgcttatattgaaataaatgttttgtgtatggttaatacaaacttctctatttcctggcatttattcaatgagtaatgaatagcgtaatgttactttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgtaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaaaaaaaaaaaaaaaaaaaaagcaaacccagaagcttttcctctaaggtgaaagacaaggatttaagcctctaaaatttgacattatgagttagtacctaagatattatgaaagaccaaggagtgttataggaataaaagaccatctgccaacttcctatggaattccctgccattatctctaagacatccgtggtacacacatcaagattgcttagtcctctgttaggttcttagatacatctcttagagtagtgccaaagccagcatccacttgacattcacactagtgatttgagagaaattgggacaccatattaaagaatcattaagaaaaggaatttgttgcattgttttatgaaattgaaataatgaaggctggctgccattatttaaatccaatatgtcattttaaaataagataatcttatcttgttttctcatgagaatgtgacaggactgaacaaatttatacaagactcttcttgatggtgctcaaataggagcagtgtgtcatttatcttctgaagatgctgccagaaatatggttattaaactgtaggtcttagatatctttacatgatgttatgtgcacatatatatctcaaacagtatgtgttgctgttttggttttgtaattaaaattaatttttcaaaatatggtcttcttaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggtaaaaaccatgtaaatgagagctgggtgtaatgggaaaagtattgaaacctcaacaagaactattctagtaaaaaattgtgaggccctcgtgtctcaatcaggacagtctgaagaaggaaattctaatagcaacattgccttgatccttctcccaccctccctcatgaatttaaattactgctagagggaggcattctaatcttcacatacaagtgctgcgtgagtaatgtctcagcttggaagtatgatggactgccattcatctaaaatcaagttgttaaagtggtaaatttttcttcatataggctttttttttaatatattaagtgttttcttgtaaaatatgtgtatctctatcttcttaatgggagtaatgaagcaattaaatttaaaactttttttttttcattgaagggatgaatccactatacagttttgtaaattgtgctaacaggcatatttgggaattttgtttggggtgtgtgtgtgtgtgaactcttaggcagaggaattccactcggtggtacatgccctcttggagtggctggctgaggcggagcaaaccctgcgtttccatggtgtcctcccagatgatgaggatgctctccggactctcattgatcagcataaagtgagtaatatataaatgctatgtaaagctaaattagaaaatcaaagcagggaaaatagactcgggattacaaatatcaactgcatgaatattttccttcctgagaaatacttaaacacctgatacatttgagagtgtacttctgtccacattgcttacatatgtatgtccccatgcacccacacacatgtatgtgtacctgtcttttgatgtttccttttcagggaaggtagttactctgtttcctatctcaaggaagcatattgatttatctaggctttttggcttttgaccaaaattggtcaagattgttgcagttatcatgtggatttcaaaaataaaacctctttaacgagcagtttggcatttataaaattatacccgtaggattgtaaattagtaattttgccctttgtaaacaagacacacaggtaatttaataactcatctttgaatctatttttaagcctctgctgcttctgtttttaatcaagagccttttaaatcctttttagaagaaacctatagtatacattaaaaactttaaaaatgaatttcataagccaatattctattgaataactaaccaagtctaaatctggctattgagttttcaaatcaagatctttcctgcggcaatgcatgaaacttgccaaaacccttcagagagtaatccaaatatctcttaacaaatgttttttaacctttgactcaaaaagtcaagaatttgaaatggtaacgctcaatgtagtgttgatgtcagcatttcctattaactttaaaggatcttttaaacaccagtaaataattttgtcttttgaagtcaggctggaaatacatcattaattctagtgtagcatggattacatcatgtgtggagacttgttatgttaattaacaccctctatcaaagatgggttgctgaatctatagcgatgaaatattgccatgtcatttaaaaagtggtacaagcttgcatagcattttctggaagaatgaaatgctatatattatatacaccgtttaaatttgaagctagaatataagaagaagacagttacatcaaatgtattataaatttttgagtcagttcaatattttgaaaatgtagtttatattatattactgtgggcttaccatcagccagcattgagttccattaacatacttaggtttgggtctcagagtagcaataaatatttgctggacaccacttaaagcccattgtgcatatctaacaccctacagaaaggagcctatttgtggtatcaccactctcacaccaggaccaggaaacctccagaaggcacgtatccagagcaggggtagtggtttttacaacaaattatttttaaatagcataaaattacctgtaattttataaaacatttcttaataatattttgcagtaacactattcattcttttccatctcctctgcttcccttcatacattcaccattcaccattcaaagaaaaacagaatatttaatttcttaacaccagaactggagacttcttagcatatccagtttctaaaaatggcaagctttcccacatgagaacaaaccagtaaggtaaggttcagactaggttggaagggcatagaattcagtggaatgttgacagtccagtccaccaaattctaggtataaccttggctcctctaggtgtagaagtgattgaaagtacattatttgtatcagctgttctccaggggaaacacagatgttagattaacctatttttttctcttccttataatgttggagttttaaatttttttcatttaggaggatcctgtattgggaaaatgataatttaagttatgatatttaaaaagtaggtgttatcagagtgtgctgtcaattgaacgttgactccattatagtaaacttgtaaataaaaggtctaaaaagcatttattcagtaaatcacaactcttttgaaccaactaccgggaacacaaaaatgaataaaacacagtcttttaatcttgtggaccgaacagtctaacatagcaaaatgccagagtaggaggtatgtcacagagctgcttcacagaggttaaagacaaaaggccacttaaattagaataaaacatataaacatatcatataaatttaaattcagagagtacatgtacacgtttgctatatgagtatattgagtaatagtagggactggacttgttttataccagtcatccaaatgttaaacacggtacccaataggtaatgtttcaactctcaggcccctgtgatcctccgtgctttttggagtcttcagtgtctattatttccatctttatgtccatgtgcgcccattgtttggctcccatttatacatgagaacgtgtgatatttgattttctgtttgagttacttcacttagggtaatgccttccagctctatgcatgttgctgcaaagtacatgatttcattcttttttatggctgcatagtattccatggtatatatgtaccacatttttttttaatccaatcaactgttgatggacacttatattggttctatgactttggtattgtgaatagtgctggaatgaacatatgagtgctgttgtctttttgatataatgatttcttttcctttgggtagataccgagtagtggaattgctgggtcaaatggtagttctaattttagttttttgaaatattttcatactgtttttcataggcatcgaactaatttatattcccaccaacagtgtataagcacgcccttttctcagcatccacatcatttgttgttttttcactttttagtaatagtcatcctgacttgtgtaatatgatatctcagggtggctttaatttgtgtatctctgataattagtgatgttgagcatttttcatgtgtttgttggctgcttgtatgcttgtatttcttcttttgagaaatgtctgttcatgtgtttttcccagttttcaatggagttgtttgttgttttcttgttgagttgtttgagttccttgcagattctggatattagtcttttttcagaggcatgatttgcaaatattttctcccattctgtaggttaactgtttactctgttgattctatcttttgttgtgcagaagcttttttatttaattaagtcccatttgtctatatttgtttttgtcacatttgcttttgggatctttgtcataaattctttgcctaggccgatgtccagaagagtttttttaggttttcttgtatagtaaaacacctatatttcaaagtgaacacccctgttcacatagtgtgagtagcatgggcatcatcgatctctgcggcctctggcactcattgtgtaatcaagtaatcgctcttggtgcaggggtccagagagactggggtgtttgcagatctctaacattctatatgagattttggaagcgtgtcacatttttaagggcaaagattctcattttgtaatcacattttcagagttctatgatctgtcttatctatggatatagttctgatggtagaaagtacaattaagtatgtgagacatttgtaaaacatttatttgaaagatcatccttgaggatgtcaaggctttgttcattccgcttgctggcagagactggctagaactgccagaacagaggagagtggctcttactggcattttaaagggacagttctcacatgggctgacctgctgtcaggctcactcttccaacctccccttcactttttactgcatagacactttgggccctctctcccatacccccaaacatttatctttccttacccaggcttctctctactttgtacttttttattcatgctgccatatttcctggcatagttaatgctattttaaatattaacctccttaccttatttgttagaacttatttttggtcaatcagtattgtttctatctctagcaatactgtctctcccaatgctattctccattaataacataattatatctaaatttgggagagttatttttttgtataatacagtttttgaagcatgaaatatcctataaagttggccctctgtatccagatattcaaaaataaaatggttaaaaatattcaaaaataaaatggatggttgcatctgtactgaagatatacatacttttttccttgtcattattacctaaacaatacagtataacaactatttacaacaatttacattgtattaggtattattagtaatctagagatgatatgaagcatatggggaggatgtacttaggtcatatgcaaatactacatcattttatatcagggacttgagcatcattggattttattatgcacggtatcctggaaccaactccccttggattccaagggatgactgtacttgtattttgaagtacatgttagaaagtactttgttttctattttgtccccttttcctccccaattagtagatgattttcactgtgaataaaccaattgaagtttttgtttatttgtttaattctggcagtcaaacaaatgccaccagagttttgttttcagccaatgccaacagttaattgaagtctttgtttctgctgtaggaattcatgaagaaactggaagaaaagagagctgaactaaataaagccaccactatgggcgacaccgttttggctatctgccaccccgactccatcactaccattaagcactggataacaatcatccgggcgaggtttgaggaggtcagtgtgtctcagataatcttcagagtagcaatagctttgagagttgaggggtgtgggaaatttcaggaattaagatgcacttatggccatgggaaaatgagacctctacatagaaaacgttcttttaaatacgcttcttgtatgcattacaatctctgcaattcacttttctttaaaagctcaaagaaattttgcagctatgtccctggaaaattagaaggcaaatatttagtacactgtataacattttggcctccttccacattgtttctgttgaataatccagcagttggatggtgtttcggagcagtatatactggtggagtgaattggtatacataaagtgaattaattctgtatttaatatcttagcttttttttttctttcttttgacggagtctcgatttattgcccaggctggagtgcagtagctggatctcggctcactgcaacctctgcctcctaggttcaagcagttcctctgcctcagcctcccgagtagctgggattacaggcgcgtgccaccatgcccagctaatttttttgtatttttagtagagatggtttcaccaggttggtcaggctgatcttgaactgacctcgtgatccgcccacctcggcctcccaaagtgctgggattacaggcgtgagccaccacgccctgccagtatcttagctttttacatttctactctgtgccacatggagtaagcttacctgatccttcagagaatgcatatttgaactcaaattagaaagcaaaaggaagcctgagtgattgacatgcatctttaaattctgaagatgatgaacatcatcgtgggctctcatgtcctcctcaagccagatcttgatgccactaatggaatctaaaaagaccagaagcattatgggtctagctcaggatgatcctaattttcatttaaaatttatttattttacatcactgcaattattttactaagttggaggaaattcagagaaatttctgtttctctgacaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccaggtaaaataaatataatcctaactcctgttaaccattatctcagatattttctttctttcactgctgtacttctcaaaacattgctttgttctcgttattttcacttcttcagactcctcagctccttacaactgtgtttccaactctgcaactgccctaaaacctctctttacaggaaccctctgtgacctttgcaaaactttccttctttgtcctctgtggggttacactcgtggtattgtctcacgttcactcctgccctcccttttgccttctaaatgtcagctctccttactccttaggtgttatcctcagctctctatttctctcactctgttccctcttttggtgatctcacccacctccacctccctggcttcagtgggtacaaggtacccacattaaggtatccacattaaatgtggatgcattatgttcacattgcattaatcaaacaaggtttgattgctctgcatttttatgtctgtgaagatgactgtcatcacttgaaatacatcatatgaaaaagggaacgtgttgtctttcttaggaaaagcagccttcctatatatccttcttgttttaaactcaaatgatgggtgtcacactcactttgatttacttgattgctcacagtttgtttaatatgcatttacaaagagaaatattaagtgttagctcagttggttaagcaattaatgttgccattattttgtgtgtgtgtgtgtgtgtgtgtgtgtgtgtgtgtgtgtgttttaaaagcctaataagacatcaatgtctataatggctctaagtgtaccaggtcatgtttcctgtgatcagaggtattagagttcttcagtgtgacaaatattccagaaaggtgttacttcacttttcccttttgtctgggtctccttttccccatcacttttcacagtctctgcctttccacagcctttgctgcatattccaaatagagggatacctagtaaataataataataagcccaaggagatgagataagcagtggcaagatagttaaaccttttaaatacaatggtagtatactttaacccaaatagtttttaccacccttggaatagcctatttatgaatattttgatatgtccacattaaatgtggatgtattatgtcataatatatcaaagagccatcttttttttttttttttttttttttttgagaggcagggtctcactctgttgcccaggctggaatgcaatggcacagtcgtggctcactgcagcctcaagctcctaggctcaagtgatcctcccacctcagcctcctgtgtagctgggactacaggcacatgccacctggcctaatttttgaattttttgtagagacagggtttcactatgttgcctaatcaaagccatcttaaatatttcaaatatgtaggtgaaatgtgccacagaaaagttcttggaaacatcccagctacctagtttgtttgtagacagatgcttactaaagattcttctgaggagcttggaaacttgagtttggttgatgcacagacaggttattttattcacatgacttctcccatgtgtccatgcaggttattccactaaaacaaattatttttattttcaatttactctctttacaagcattaacattttatttatttatttatttatttttgagacggagcagagtctcactctgttgcctaggctggagtgcagtggcacaatctcggctcactgcaacctctgcctcccaggttcaagcgattctcctgcctcagcctcccaagtagctgggactacaggcgtgcaccaccatgcctggttaatttttgtaattttagtagaaatggggtttcaccatattggtcaggctggtctcaaactcctgacctcaggtgatccacctgccttggcctcccaaagtgctgggattacaggcatgagccactgcacctggccacattttatattctttagaaattagtaaatgcctgcagtatgatggtttagattttttttaccctaaagataaagcatatgatttattcttcttcagaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaatttctttaaaatgtcaataaataagggagctaattttcttttattttgaattatttgaaatttgggggcaattggtgattttacatgagcacttgatatcatgaaatactttctagaaggaatacgtgtgctcaagtattgtagaaacttatttaaaaataaagaaaaaatatacccaggtttctatacgtaactttattgtcttgaagtgtatctttcatattagctagaagaaaattgaaaaaatttacagtaagaatggaaatcatcacaccctttgcattgtctcatttgtcttccattatatatataacattaaagctgaacataacaaaaatgaccatgacgtggataatcttcatgacttagttgttcattggtgaccagcaatctcatagcttttgcccatgttcatgtgacttcaggctctatatacttcttgagctactttaacaacatgacatgacattgaaaacaatcatagttagcttggagaagatttaaaaagaaacacaatttgtgttatatgttttatgcgtttctgaatagaaatgcattttgcgtattacttaattttttaattaaaaagaaatgatgtcggagctattgtaattacttactacacaaggagacaaggtaaactattaagagccctatagccagactccttggctgtctccaacacttaccaaactgagaaacataaccctggacaagttacttaaactcattctgaacctcagtttcctcatctgtagaagggtataattataacttcattggactgcagtgagaattaaatgagctagtacatacaaaatgcttaacctacttccaggcatatagttaaatgctcaagtatttgttgtactataaatcctagctgggacacttaacattctatatgaccctaggctagtaatgtttctaggccgtatttagccatttagtaagatgagaaaaatttgttaaggtcattgttttgtgaagttgttgagacttgtggaaaacagccagaaagcaggaggaaagtttagtaaggcagtaaacttgggtttgagactatgcacaggaaacatgcaatctcagtggaaaatggatgtgggcgaaggctggggtcccatacacatgctgccatattttattggcatttgtgaagtgtcttgctttgactcttgtgactgcccagtgcctgctgccctcatctgctctccctttctgccttattctctaggaaggacagctgggtttgatgtaagtcattgtaaggtagtctcactggcctgggagatttcctttaacaaagtggaggatcacagcatgcttcgttgtcattgaaatggcatgaattttaagctggaagatgttttaagcataattcattgagagaggtttccagtatttaaatgcccctgtccagagatatttctttaaattgcatgaacagtgtgtgatccttaataaggaaaacagatttgggccttgacattatacatcatctaaattaggatacttttacttgcgtaaacacgtaattaagttgatgcagtcttagctagaagcaaaaaaggtcaagccttaacacatttcagcaccctggaaactgccatcctaaccgaagttataccttcacaggaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggaggtttggaaattcataccctcaacaccacattgtcatttgccctcattcctcataacacattgccattgccaaaatcttggtattttttaacttttctgataataagcaaactcttgctatttgagtacatttttaaatttccaaaataaataccacaagtatgtgtgattttgtgaaatattgatatatgggatttggatttagggaatcaatgaagtaaaaaaaatgattatgttttaacaatcagaagctgattccttaagaataaaatctaacttgacataatgtttgctggtgatgctgcctggaaaatataatcttttatatttcagatcttttgattgtgtgtatttgattacctaagatttcaagttttagattctgcaattgggaaatttttagaagccctggggagttaagagagtggctaatagtgcagagggagagagattgaagggttaggtaagtgctgttgatctggacctgctatcccagtgagcatgactagtggtggtacttagagccggaccacctttatgactttggcattaatcagaaatttacagcttaagtttttaggaattttatttgtaaagaaaaatcagtgacagcaatggaatacattttaaaggcaaaatgtttctaagtcccctttgcaagatcatacctctttttgaaatgggaaggatatgtgtactacctagagaatcatttcaaaagttattcatatagtatagtctacaattttagtacagcattaactcaatcaaaatactttttgtccttttagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaagtaagttccaagacagatgactatgactgatacaatttttaaaggaaataagcacattttaaaagtgtgggtctggtaaacttgtgttacaataaagcattgtcttataagttgcctaggaagtcacgacccttaaaaaaatgtttttttggtaaaatttgtggctctggagtcaggaacactcactaactgtgtaatcacagatatgttgttccctccactgaggctgagaacttgttagaataataaagttaataatatatgattcttaaggtgttttctgtgtgtgtgtgtgtgtgtgtgtgtgtgtgtgtgtgtgtgtgttgcctggcatatgtgtaataggaagtcaataaattcaagtccctttttcattctaattcacattctgatctaactttgtcattagtaggaaattagaactctataaaacttcttaagatacttatcacctttttgtttgatggcccaatcatttgtatgtgatttccctgacagatgttactagatgtcattcttaaggtaaatttcatataatttattctttgactagcaattgacccatataaaattgccagtgttaaacattttcaacctaaaaaaacagcattttatatgattcacctaaatagtaattaaagataaattaagattatatataactcttcatttgctgtgatgtaaatcagttttttaaaaaaggattttaatatatttgatcactgatgatttaaccagctacactgagattgaaatgtgcaattgagaatgtcttgagaaagaactaacaagtcactacttaccattgttttcaaaattttagagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtactcattatcttcccattgcgtacaacactgatagtatgttctgccacgatatcatgcacaattcatacaaccattttattttcactctaattgttgtgtcaaagttttaaggattgtactatgtaatattgacattaaagtaaatatttcatcattgtttttggcaggtgacaaggcaggtagctaagtgtaaatgtgcaaagcgatttcaagttgagcagattggtgataataaatacagggtaagttttcaaagtaatgttgtagttcctttaaaggacataaattgaaatctgtatacaatttgatctccattgttttccaggagtcttatttatttacttttttacctcatgtcaaaatttaatggtatatgaaactcttacatttaacattttaatttgtataacggcagcctgcattttgcatattaggaaatatctttgacatctacatcatgcacattacctttaaagaaaaattcacaagaaaatactcaaatctcatatatttaggttgcttcatattattttatattttgttatgattagaggtaagttttcagatttcaaacaagaaagctactctaatccagaaccacaaagttaaaaatatggactcattttaataaatatgaaaagagaggataatgtcttctccacttgtgcagtaatttttgcttttattcaaaatctcaattaactcggttcactctcttcaaaacagaagaacagtgtgacttcattactctttctctatttttttttttctcttttggaacatctcttatatgtagtagctagataagaaatgtgctgagtttccccaatacagtgtgctacttctaaatgaaatattatttttatttttatacttaaaaaaataatcatcaatgtattcaaaattttaacttaaatttgaaatcctaagattttcaaaaatatgtgtacagaaaatagtctgattatttggtttgaaattgggacaactgggtgcctgcacatctctaaactagatactacatccagaagcacagagtgtgagtatgtgtgtatgttctagagtcatacagaaagtttcctgttgaactaattgtgtctttcttccatttttcatttttatcagttcttcctgggaaatcaggtataaaccagtggaatgtattctcaagttcctgatgatttttttttaactttaattcatagtcattaaagcttgccatggccaatctttcccatgctgtctccctagctactacattgttggttggcgtggtgtttctgtaaacgctataagggtccttgatccaggattcctttttgccttgtgtctctcagatgaggagattacttttaagcaaaccagataatgaattgtagcttggcttgctacaatgttacgaatgcaatttttaattcccattttttataatatgagcatatattttatgctagtactcattggaacacaaatttgattctccacacatctctgtgttaggctcattggtgtttaactgtttaggacatacggtctacagtagctgagaaggatcagcctcaggcagtgacacaggaagacagagagccaagaggtctccttggcactcagccacaagtaacaagttctctccaaagaagctatttgccatttgttcaaaatcaccaattttggggcttggcatctctgagtagaaatgttaactcagtaggctttaagtaatattccttttgaggaaagttatcgctataatatatgcagaatcttaaagtcacattttatgccatcttgatcgaatatttatattattggcacttaagtcaatataaaatgtttatgttgacatttaagtcagtataacctgtgtagtggcactacatcatgatcagaattttgaaactaaggagatactctgttttgatttaaacatgttcatgaagcttttattttattttattttattttactttggaaagaaccatgctatctatagtatctgaccatattacattagatatgactctgccactccattttaaagccatattacatctcaagcttcaaattatctattacctttatttattgcaagcaaataatttatttaaaatagaaatagttacttggaatagatttttaaaacttccattagttatactataatactgaaatgttacttttccattcttgctattttcggagtcagcaaatgggagagcatcttttatttgcagagagaatgagagaaatacctcaaaaggttttactcactgaaagcacagtcagcaacattagtctattttctcttgtcttgtgatttggttactgggaatatttagagaaattctgaagatgatgttagttgtctggagaatgcctaattaaaacagaaaattatttgtattcattacacttgaaatatcatctctataaggaacttttagttatttccttataacttttgttttgagtataatcttgaaccaaaatcatctagtcccattatctggttccttaagggtaattttctttaaatcccctcctttccctttgcttattagcggcaccaatttttttctaacaaaataaatttacacttttatttttaaattttaattaacatttcaggaagaattataggaaagtttaagtctcaatgtttaaggaaaaaagatttagaaatagtggtttttaaaagtttgatggaaaaacacatgagttcctgctggtgcattttacatgctttctaggtccttctgagttttaggatcctgagggatttggttggtattgtttttgggttttcttcttgaaactcagtattaaaacactgaaaagtagcagatttttttctacctagagttttctgtttatccatcatgagcccaaataaagtcacaattgtatgttacctgctttacaaagaagccatttatgtttaattgactgttcattttgctttcttgtctgctgggatgacaaccgtgaaattcagtctggtagtttttatgagttggacatgaacctattagaaatgatttaaagtataaaatcatttctcacaggctttcaaaacataaacctgtgatcagaaacctggaatctagaaatttattcaggacttgcagaatttgtagcatatctacattattggagatctattgaaagggcaagaaaaagatgattgcctgttagtatcaacagttatggtacagacaactatgagagaaaccttttagatttggcagctgtatcattaataatgtgtcattggctattctaatattacagtaatctaaaatggcatattaatccagcctttaacaaattggtttaccagatcattagggatgcagaaattttagttgactgtgaaatttatatgagtcatactcatttactttattctttttaagtgaaaactgcccttacagaaaagaaaatgagtttataaagatttctcacagagttcagtggaaaacggttttactgtaagagagagtttaatgaagaagaatcaaagcttattaaatttttcttagaatcattttattttggataagccctgggcaagtgggccagtgcttactttcatggctatgtttaattcctagaaacattttaaaattactgccttactaatattgtttctgtcataagaaagaaaaataatttttagaccaaagctttggtagtatacttgataacctttgtaatcttttttttttcaaactgtttcctttgggctaaatcagcatgcagccgtctaacacaaatcattacaaacccccttttctgagattttactaatcgctatgaactaagcaagaaattaaagtcggttgctttagctactgcaaattgcacatcatcctgtagtttagaattattattgacaactagaggttctttctttcttcactgaacagtttggagactcccagcaactgcgactggtccggatcctgcggagtactgtgatggttcgtgttggaggtggatggatggcacttgatgagttcttagtgaaaaatgatccttgcaggggtaaggagatgcttatcatgataacatcatgaaagtatttcaattttatattatatccagcaccaaaacatactgggcataattttggtcatttattccaatagtgaatgtttcacattggtctgtcagcctaaagttcccaaagaacctgtggcagtcatgtaaaccatattcttctcatttttttctttcttttttttttttttttttactttttctggataaatatggtgggcgggaaatactagaatccattttctttaggagacttttacatctacgattttccaaacaattataccaaccaaggaaaggattttgtctgttatgacatagcaaagtaagagaaaagaaaattgaggtgatgaagaccgaaaatactggataataaaagtttaaaggtcaaagtttttatgaaatgaagagcaggtgaggaaagccataattaaaaaatttttaaataataatccaatgctaacttgactctttgaagttgcagattagaacattaaaaatataaacatataatactatagctctctacatatcttccagcccaagtcctaagttagcttttaatttttctgttttgagatccttctgtcaatttttaagttctcaaccaatttacgttacacgtggtcatttgattgcaatttctaattaggtaccaattactcagtaggcccatttttcttcccccccaagaaaaaaacaataaaattgttataattttcttttacctgtgagctcactgtaatcctttttagcaaacaacaaatgttcacgtcagtgctgtctccttcagctaccaagtgggatcccaggtttcctcctgtagggcctcttggttttggtgatggtgtcaccatctggtacacatagacatatcagtcatcaggcttctccaccaaggccaccatggattgttatacatgttatacagtagccctgctctctcctggccaaagacacacctgcgagagaagtaaaacaagaacaaaagctcctgtttgttttatattttgaaaataatgtagcctaaggtaaaatgcaactccatttatgaagaaatcagaatacatagtgttctgttgggttgcttaggaaggttagcatggctgtggcacagtcttccaaatacatttttcttattgagccaatcccttgagtgcttcttttcctgatgcaacttttcttctaaaatgtgtgctaaaggccagatgtgagcaccctttgcatattcaactactgtactttgtttcttcttctgctaacagtattctttaatgtgattggtatcctgtgtcattttttctagttcatcatcatgggagtaaaatgttacgttcggaatcaaactcttcaattactactactcagcctactataggttggcaacctctctctttgcctctcccctctttccttttctctttcctacttttccattcttgcttcagtcatttgttttaaaataacatgcttcatccatcgcgtatggcttaactcatatccagctgagctggtgcttccaaatttaaattctgaaaatttgatgactttggttgtgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaaggtaagactcaggatgaagacttttcctccacctttgcaatcaatgtcccaagtagacttttgaatgttctatttagggccctagaatttgtaggaccagctatctccatttgtgcaccttctcatactgtgggaaatacaggaatttttttttgaatgtatgcttttgcctagtggcccacatagagatgatctatttaggaagcctttgtgatcttccagattgatttttctttttaaagcttcattcatttttttggtgtgtatgatttgccattggatcttttcacttattttaaattattattcttactgtgaaatgtgactctttgctatgaatatctctttctgtggctttgttttttttatctgctatccttttcatttgatttgccattgttccatacagattctccatcctttaacacgcaattatggtaaaccatggttgacaaacagcaaaatgtcaactccttgtaaagcagcagagtgctcagactttcccgtgccatctgcagaggtattgtaaggccccagagtccagtcttaacattctcctttaactgaagctatcactcactaacatcgttgcaccactccctaaatatatgtactttgctaaccctatgtctttttatacacttctataagataagtatcaaccgagcagttcttggaagatgtgagagtaaggggttaacagaaaagatagtctgcagctctttaaacagtgtcaatttgacccagtcactcctgcagactacctcctttttgttctcattcgtacttagttccactgttatctcttgggagagtaacatagagtaggttatagccagacttaagtaaaatttcttttaaagctactaaatatactagatataatatgggcaagaagtgcaacacattcccttcaaatgggagtaaaaggcagtatgatttgcaagagcatcactgaaaagaatgtttactgaatgttcactgtgggcatggtccttctggatgtctgttacatttatacctgccccaaaactttgggcaggtgtgacataagctctcagtatcagtgcaggggggtcagaggggtaggcttaggtatgcagaaagttatttgtcattttcaacaggtaataaatgtatgggttttttttaaagattttaataactaatttaagcatgctctaactttttaatacggcatgatatatggggagaagatatttaggtgatataaaatttgccaagatgaactcatgtatcaggtcatttacattcaattgaaaatcagctgtatatctttttaagaaatttcactgtgaaacaacagacataggtacaaaataatcagatattttattagaatcccaataattagtggggaaaaatccctaaataccttttcttgaaattgaagaaggtatttcaccttaatgataaaggacgtaacttaaaggccaggatcctcaaataaaagtaatataataacttttaaaagccctcttatgcttttcaaaacactttcttgtctgttacttaatcctcacattaataataagtgacaggcagagaaaaaatgtgttaccttcatgactccatggcaatctcattgctgagaagtgggagaattggaacaaaaacaacccattctttagcgtttcctcatttcttcctcctcattttcccaagcccctcatttccaccccttcccaccaactgggtgatgttagtattatatattacctctagagatgtctgtcaattattatggatctattatagcaaaaacagagaaaggttcaaacaacctcaagggacatattaacatttgctttaaatattgaaggctatgatgctgtgttcaaaattttttttaagtggaaactctctcaaagtctaagtagttattttgactagtgcaaaactgtgtttcatttcaaataacgtgatgaaacaaaaaaccaaaaaacaacatgtttctatgggagggactgtgaaataaaatcaaaacaatcaaggcattctgagaagaatgattttggtctttcacggttatgaattctgccaccttgagtggtatgtttcataatttgtggcttctcactccctcgtgttgttgagattctgtttaagttaggaatttagctagatcagcattgtcagatcttgggcaaatcatgtgcctcctcaggctcttgatttttcacattttcaaggttatgattaggtgagtgtgaggattaattgtggttatgtgtgtaaaagtattttgaaaacttgaacattctatgtatacaaatcacatatagatactacacttaagtgtatgtatagtatacacatatgtagataaatgactattaatattaataagagtaactcatgtatcagatgattataacattttaagctaataaagggaaaatcagttgtttaaaaatatacatgtaatttgtttcaatgcatttcctccaaatagttctctggctgtgttttcattgaggaatattatattacattccctatgttcctcaagatacttgtttattttttttaactttgggagaattttttaaatgttgtgatctggaaaaagtgcaatgattgtataataaaatctcatacttatgattgttttagacattctctacaaactcatataaagattgtaaaaaaaaaacttctccaaatgttgcctatgtattttgtctgtaaagactgtagaagtgatagagccaggaagtgaagtgatgtggtagcaagttatttaaaaatcactttttttctttttgcagttaagtttatttaaatgatgtctgtatccattatttatttacttatcattctgtgtctgtctctgcctggctccataaaagcaatggaggcagcagaatatccagacacagtttttctctgctccatgccccctctatgcatgcagtcaccatctttttagcaatacaccattaactctggaatattcactgacagtctgaaagatactaacatactcaccatttatttctccttgccatcacttttatgctcagttttgggggtctccattttgttttctcttcaaccatgaattcatattgtttagaaagtttctttgaattctgagagagaatgagaaattagaagagaaaatcaagtgagaaccccatgccttatttaattgaagagtttctcccccttcacctcctaaagaggaatagtagagagtttccacccatatgtaaagaagtggtgtcagtggaatatcatggtacaggagcaatattttgaaatgtcttgttgctggttaaatacagggaacgccaatacaaggaagcaagcttcgacttccaggatatttatcagggaaaggcttccactctggggaggacagtggcttgataacaactgcagctgccagagtccgaacacagtttgctggtgagtgtggtgcctttcttttttcaatggcttttgcagcatggtcatctgaggattaaagtcccttttcctcctcattggggaagaaattacaaattgaccctgaggtagtcttaaaatgatatgtagccccagtcctccaaaagttggggataaagtgagtcatgggtgcaagtgtctaaaagtgtccaagaaagatgaaagaattactgtacaacagaggaaaatatacagtggtattctaccccttcaagctgaaagattttggctcttctgccagctcagcgattgcacagggccctgttttggggtggttggaagaacccagccacactgagcctcacaccagtgtagctcacattgcttcgcaaaataatgaacctactaatctctgggttctgagctcagcaagcaagaagcctctttaaagtttccaatctcatctgttgaattcctacattcttggagttacctattcttgggcaagacttaaacctgtcttgtttgttctatgtttgcatcacacgcatccctggaggcataatttaaactttagaaagcacaatcttaaaggataggtatattccttatgtctgtttgcaataaatggaatcctgttttaagtaggggaagccgaaacttaccttgtagttggaaatctagccttttctatattatgtctacttagagtaagcctgcatacccttgtgtaatagagaaaggctgtgaatccacaactgttttctgagtgcctactacacaccaggaaaaaaagttaagattaaaggtggcatcgggtttcaaaaattagttgcagatggacccaataataagggtgagctgtctctaccttctttcctcagattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaa

SEQ ID NO: 10891 - DNA, 38771 bp, Homo sapiens; identical to SEQ ID NO: 6652
  misc_feature (7892)..(9416): n equals a,t,g, or c

SEQ ID NO: 10892 - DNA, 127 bp, Homo sapiens; identical to SEQ ID NO: 6580

SEQ ID NO: 10893 - DNA, 1578 bp, Homo sapiens
  misc_feature (48)..(48): n equals a,t,g, or c
  misc_feature (83)..(83): n equals a,t,g, or c
  misc_feature (155)..(155): n equals a,t,g, or c
  misc_feature (158)..(158): n equals a,t,g, or c
  misc_feature (168)..(168): n equals a,t,g, or c
  misc_feature (183)..(183): n equals a,t,g, or c
  misc_feature (199)..(199): n equals a,t,g, or c
  misc_feature (211)..(212): n equals a,t,g, or c
  misc_feature (220)..(220): n equals a,t,g, or c
  misc_feature (360)..(360): n equals a,t,g, or c
  misc_feature (439)..(439): n equals a,t,g, or c
  misc_feature (645)..(645): n equals a,t,g, or c
  misc_feature (713)..(713): n equals a,t,g, or c
  misc_feature (776)..(776): n equals a,t,g, or c
  misc_feature (915)..(915): n equals a,t,g, or c
  misc_feature (929)..(929): n equals a,t,g, or c
  misc_feature (934)..(934): n equals a,t,g, or c
  misc_feature (940)..(940): n equals a,t,g, or c
  misc_feature (947)..(947): n equals a,t,g, or c
  misc_feature (954)..(954): n equals a,t,g, or c
  misc_feature (1420)..(1420): n equals a,t,g, or c
  misc_feature (1455)..(1455): n equals a,t,g, or c
  misc_feature (1489)..(1489): n equals a,t,g, or c
tgctatattgccccgctggtctcaaactcaatggactcaagcaatccntcccacctcagcatcccaaagtgttgggattacanggcatgagccactatgcctggcctagtaaaatatttttatactaagtagagagagtagattcgtggaaaacntcnttaaactcanccaggtactgcaatngaaacttctagcattnggtgattagcanntactaatnatgtactgggcaaatttataatcgttagtaatttgcaatggagtcttttcattctgatattaaaagtattttacaaacactaaactttcaaaatctctcttataataggtattgttaaattaattccatatttcatatgnaaaaaacaaaagctgagggaggcaaagttacttacctaagaccacacagtatttaactgatggaacctgagtagttccnaaatttccgttactcaactctaacccgcatataaaataaaatcagtgtaatgctaagaaatactattgtacctccaagaataaacttgacaataaaaatattgtcatggcagtttaaagaaatgtctttattaaaatgaggattccaaggtaaaatcctctaagtataaacatatttatataagatatttatatttaagaagatangtaatttcattcaatattttgtttttaatatcatgatcattaagttacatagattctcttctggtaangcaaagtgcaaaaaaagccaaaattgttatagactgtgattcaaatactctttcatatagccnagggtgataaactacttatttattgaacttgactgtttaaatataaaaatgattgtcctaatggagaaagcccctaaaaagcaagtagctccttttgcataaaagacttttacattattttggattttagtgaacagtngtttttttctattngtaantttctngattagnatatcancattatttatgaattgtttgttatggtaggagtatagtatcttttggaagaatttatcttagtatatattaaccaatgagtcaattaagattagccaatttcaatattatccttaagcagtattaccattgtaatgctagaatagacatatcccagaccattaaaaacctgacaattctttatccaaaaaaaacaagcaggcaaaatatttacaaaactattaaaagattggggagctaaagtagtggcaaatgcattactctgaaaatcctcacacatcctctgaaaaccaataaagatgaacaaataagactacacataaccaggctgggcacagtgactcacacctgtaatcccagcactttgggaggctgaggcaagtgaatcacctgaagtcaggagttcaagaccagcatgaccaatatggtgaaatcctgtccctacaaaaatacaacaattagccgangtgtggtggcacgcacctgtagtcgcagctacttngggaggctgaggcatggagagtcacttgaacccngggaggtggaggttgcagtgagccgagatggcgccactgcactccagcctgggtgacagagcaagactccgtctcagaacaaaacaaaa

SEQ ID NO: 10894 - DNA, 1554 bp, Homo sapiens
tgctatattgccccgctggtctcaaactcaatggactcaagcaatcctcccacctcagcatcccaaagtgttgggattacaggcatgagccactatgcctggcctagtaaaatatttttatactaagtagagagagtagattcgtggaaaactcttaaactcaccaggtactgcaatgaaacttctagcattggtgattagcatactaatatgtactgggcaaatttataatcgttagtaatttgcaatggagtcttttcattctgatattaaaagtattttacaaacactaaactttcaaaatctctcttataataggtattgttaaattaattccatatttcatatgaaaaaacaaaagctgagggaggcaaagttacttacctaagaccacacagtatttaactgatggaacctgagtagttccaaatttccgttactcaactctaacccgcatataaaataaaatcagtgtaatgctaagaaatactattgtacctccaagaataaacttgacaataaaaatattgtcatggcagtttaaagaaatgtctttattaaaatgaggattccaaggtaaaatcctctaagtataaacatatttatataagatatttatatttaagaagatagtaatttcattcaatattttgtttttaatatcatgatcattaagttacatagattctcttctggtaagcaaagtgcaaaaaaagccaaaattgttatagactgtgattcaaatactctttcatatagccagggtgataaactacttatttattgaacttgactgtttaaatataaaaatgattgtcctaatggagaaagcccctaaaaagcaagtagctccttttgcataaaagacttttacattattttggattttagtgaacagtgtttttttctattgtaatttctgattagatatcacattatttatgaattgtttgttatggtaggagtatagtatcttttggaagaatttatcttagtatatattaaccaatgagtcaattaagattagccaatttcaatattatccttaagcagtattaccattgtaatgctagaatagacatatcccagaccattaaaaacctgacaattctttatccaaaaaaaacaagcaggcaaaatatttacaaaactattaaaagattggggagctaaagtagtggcaaatgcattactctgaaaatcctcacacatcctctgaaaaccaataaagatgaacaaataagactacacataaccaggctgggcacagtgactcacacctgtaatcccagcactttgggaggctgaggcaagtgaatcacctgaagtcaggagttcaagaccagcatgaccaatatggtgaaatcctgtccctacaaaaatacaacaattagccgagtgtggtggcacgcacctgtagtcgcagctacttgggaggctgaggcatggagagtcacttgaacccgggaggtggaggttgcagtgagccgagatggcgccactgcactccagcctgggtgacagagcaagactccgtctcagaacaaaacaaaa

SEQ ID NO: 10895 - DNA, 5775 bp, Homo sapiens; identical to SEQ ID NO: 6656

SEQ ID NO: 10896 - DNA, 738 bp, Homo sapiens; identical to SEQ ID NO: 6657

SEQ ID NO: 10897 - DNA, 579 bp, Homo sapiens
  misc_feature (456)..(456): n equals a,t,g, or c
  misc_feature (493)..(493): n equals a,t,g, or c
aaaagtgagaaaacatatcagtttttatacatctatacatgttggatggatgcctgcactaatataaggaagcagtcttatagataattcagtaatcacttaagtttgatatattagtatatagacttggctactgtgacagaggcttataaaggtagaaatatatttatatttacttgaaaagtctgtgtaaactatcttgagattaaatggaggctgcaaaatcactgtgtcccagggctcctttgtcttgctctgctcttcttctatgcagtttctgtattgtgggcgaggatggttaccattgtgtctgctaataagaagaaaaagagaagggcattctctttacctttaagaggagtttgtgtatatcactttcactcagatccctctggctctttgtcacgtcacaaccagttgcaaaggaggctgggaaggtgagtgactctgacctangcagccatatgttgcacttatttttattactgcatangaaggagagaacagattctggggagatagccagctatctgtcacattaagggttgagtcagatttattttcattaaaaaaaaaaaa

SEQ ID NO: 10898 - DNA, 1021 bp, Homo sapiens
aatttttaaaatgtgagaaaacatatcagtttttatacatctatacatgttgtatgtatgcctgcactaatataaggaagcagtcttatagataattcagtaatcacttaagtttgatatattagtatatagacttggctactgtgacagaggcttataaaggtagaaatatatttatatttacttgaaaagtctgtgtaaactatcttgagattaaatggaggctgcaaaatcactgtgtcccagggctcctttgtcttgctctgctcttcttctatgcagtttctgtattgtgggcgaggatggttaccattgtgtctgctaataagaagaaaaagagaagggcattctctttacctttaagaggagtttgtgtatatcactttcactcagatccctctggctctttgtcacgtcacaaccagttgcaaaggaggctgggaagtgagtgactctgacctaggcagccatatgttgcacttaatttttattactgcataagaaggagagaacagattctggggagatagccagctatctgtcacattaaggtttgagtcagatttattttcattaaaaaaaaaaaaatggcctcaggcctgtaatcccagcaggctggcaggctgaggctggtggatcacgaagtcaggacatcgagaccatcctggctcacacggtgaaaccctgtctctacatacaaaaaaaattagccgtgcgaggtggtgggcccctgtagtcccggctactcgggaggctgaggcaggagaatggcgggaacctgggaggcatagcttgcagtgagctgagatggcaccactgcactccagcctgggtgagagcgagactctctctcaaaaaaaaaaaaaaaaaaaaaagccgttgattatttaaacagttaacttttttgttgttgttctggaatgagtcttggttactgtatagtatgtattaaaaataaccattagcaatctaggcatagtggtatgtgcacagtcccatctcatgtaattaaaaaaaaaaa

SEQ ID NO: 10899 - DNA, 682 bp, Homo sapiens
gaaatagtagtactttaaaaattaacatggtttagaagatatgttttatagatacaaaatggtagttatacagaggtatatctgaagaggtctttgaatgtacttagacaagaaatagattttgttttattaataagagatgaagtagtttctgcttagatcaaaactatacttttcaaggatgaaagcaaatacaaaacttcttcagaataacaaatagcaaatttgttaaaggttctggtattaatcatgggtttcatctcaccaaatgatctggaggccggttgatatttgtatttctaatgctgatatttttaaggtataatttctcacggttagaaacataggttagaaatgttaatatccaagttaatgtaactggcatcctccaaataacagagtgctttggatcagaagtaatttgtgaaatctagcttttttcttttacctgttttcagaacaagttcctttgagtgcttctcttggcttacaagtgaagtttcattttagattgaatgggttctgttacaaagtcaggggaagaggtattactgaatttgtgagaatattttaagttgggaattactctttttatacaaaagacgatgatgattaggttcagaagcttgcctattataacctgctttgactcatagttgaagttccatattattcaaaaaag

SEQ ID NO: 10900 - DNA, 297 bp, Homo sapiens
ttgttcttttttccttttttttttttttgagacagagtctcgctctgttgcccaggctggagtgcagtggcgcaatcttggctcactgcaagctctgcctcctgggttcacgccattctcctgcctcagcctccgagtagctgggattacaggcgccggctgccacgcctggctaattttttgtatttttagtagagacggggtttcatcatgttagccaggatggtctcaatctcctgacctcgtgatccgcctgcctcggcctcccaaagtgctgggattacaggcgtgagcaac

SEQ ID NO: 10901 - DNA, 1064 bp, Homo sapiens
cagtcactttagtaaaataagtacattatattacatgtcattataatattgtgttatcacataaactgagcataccacaatccatattctacggactgtcttctcctttttccactgattacatgtgagtggttcttagataacacaccctaaagacaaagaaagaaaggaagagaaacagaattaacaagagagggaaaagagtgtcagtttcctttgctatgactattaaatgactcagtgaattttcttagggtaaagttactgccattcaaaattatagtaaattggtaatattttacagtcatatattttttgtttcagctgagtatattttgtttcagcttaagtatgggcacatatctcccacacttttttagatcagatatgacacataaaaaagatggctttggttttttaaaaactcttacaattagcaactaatggcagtgtgaacatataattggttttataggtaaatcaatttgtcgacttacaaacttttaagacttcatttgttattcataactacattttgctgaggaaaaaaatacttgtttatgtcaaaaaggggagaatttccattaagttcatactctccatgatgagaaagcacaccccgaaataagacattaaatgttagaatgtattacttttcctggttagaaaagaacttggctttgggagtggaccctatgcgtatcatggtgtggcaatgccattttgtttccaaagataacatttgtagatgtacagatgtcctgaactttattaaaccacagctgtggttatcacatatttattcaaaagatattacagctatcaaagcagtatgtcagcaaagtccttagtagtttgcttaaattgccctttcattttactgtatctgtaagtattcaaccaatgtctttaaaagcctgagtaaaaaaaaaaaaaaaaaaagaaaacacaaataagcaaacacgaagcattatttacatggaagcattcagaaatcatgaatagcattatcacaaatgagttatgacattttataggttcacaaaaacgagagagagaaaaaa

SEQ ID NO: 10902 - DNA, 1005 bp, Homo sapiens
gaacaaacaaaaaaatctctctaacgtttgattctgccttatccttcattggagaaagggatgaaggctgccacgtattagccgtgatttcttaacttctctacctttaatttcctcatctatgagatgatgttgaacctgtctacatcataagtagttaaggatgaaatgaatgggtatatgaacattgtgttggggtacgtagtagatactcagcaaatgtgtcttcccagtgatgtcacatttcctctacttctgcttggcatgtgtctcgttcccctgagcccagctcatgtcactgtgacgtgagagggcaggtgaagtgttagttgttcccactccgtcgtgccctttcacagttgttagtctgatgctaaagacttaagatttatttcttcattgttgttgttgtttttgtagagatgagggtttcactatgttgcccaggctggtcttgaactcctggcttcaagtgacactcctgcgtcagcctcctaagtagttgggattataggcatgtgctaccacatctggctaattgtatacattttttgtagcaatgtggtcttgctatgttccccaggctggtttcaaactcctgaggtttcaaagtcctcccatcttggcttcacaaagtgctgggattatgggtgtgagccaccatgcccagcctagattttatttttaaagtaagaatttatagacagccgagcgctgttgttgacgcctgtaatctcagcactttgggaggctgaggtgggtggattacctgaggtcaggggttcgagaccagcctggccaacatggtgaaaccctgtctctactaaaactacaaaaattagccaggcgtggtggtaggcgcctgtgatcctagctacttgggaggctgaggcaggagaatcgcttgaacctgagaggtggaggttgcagtgagccgagatgacgccactgcgctccagcctgggcgacagagcgagaccctgtctcaaagaaaaaaaaaaagaa

SEQ ID NO: 10903 - DNA, 1009 bp, Homo sapiens
gaacaaacaaaaaaatctctctaacgttttattctgccttatcctcaattggagaaagggatgaaggctgccacgtattagctgtgatttcttaacttctctacctttaatttcctcatctatgagatgatgttgaacctgtctacatcataagtagttaaggatgaaatgaatgggtatatgaacattgtgttggggacgtagtagatactcagcaaatgtgtcttcccagtgatgtcacatttcctctacttctgcttggtatgtgtctcgttcccctgagcccagctcatgtcactgtgacgtgagagggcaggtgaagtgttagttgttcccactccatcatgccctttcacagttgttagtctgatgctaaagacttaagatttatttcttcattgttgttgttgttgtttttgtagagatgagggtttcactatgttgcccaggctggtcttgaactcctggcttcaagtgatgctcctgcgtcaccttcctaagtagttgggattataggcatgtgctaccacatctggctaattgtatacatttttttgtagcaatgtggtcttgctatgttccccaggctggtttcaaactcctgaggtttcaaagtcctcccatcttggcctcacagagtgctgggattatgagtgtgagccaccatgcccagcctagattttatttttaaagtaagaatttatagacagccgagcactgtcgtcacgcctgtaatctcagcactttgggaggctgaggtgggtggattacctgaggtcaggggttcgagaccagcctggccaacatggtgaaaccctgtctctactaaaactacaaaaattagccaggcgtggtggtaggcgcctgtgatcctagctacttgggaggctgaggcaggagaatggcttgaacctgagaggtggaggttgcagtgagctgagatgacgccactgtgctccagcctgggcgacagagcgagaccctgtctcaaagaaaaaaaaaaaaaaag

SEQ ID NO: 10904 - DNA, 298 bp, Homo sapiens
aaaaaaaaaaaatcgcaaaatacatctcataatgttttaagaaagcttataaatttgtgttgggccagtgggctgtgggttggacaagcttgttgtagatggttagaaagattttattcagggctatttgaagatgaacagcatgataggatttattatggttgagattccaagtgaaactccagtgtaaatttgcttctctgctgtatagactaagtggtgttggggcttaaggatggcagcctggtctgtgggtgtggagatcagcatgagtggggcccctaggaatccaggaaat

SEQ ID NO: 10905 - DNA, 298 bp, Homo sapiens
aaaaaaaaaaaatcgcaaaataaatctcataatgttttaagaaagcttacaaatttgtgttgggccagtgggctgtgggttggacaagcttgttgtagatggttagagagattttattcagggctatttgaagatgaacagcatgataggatttattatggttgagattccaagtgaaactccagtgtaaatttgcttctctgctgtatagactaagtggtgttggggcttaaggatggcagcctggtctgtgggtgtggagatcagcatgactggggcccctaggaatccaggaaat

SEQ ID NO: 10906 - DNA, 19586 bp, Homo sapiens
ggaggagcacaggccttggaaaggaaagcagctgagatccagaggagtggaaggctcccccttgactaaagctgtaagtagttaccttgggctgcaaacattattttttctttgcttccttgctcactgaaaataaacaagtggcattattggtggattgctgtgacattctcatattgatcaataagacataaacttttctatttttaatctatcttttttttttttaagtctgcgatttccatgatattttcttaccataccctttcaaacgcatgtctctccaactgcctacataaatcaacgagtgacttggatccagttcctgtggatttatttctgtggtgacagtcatcccgactttaccaaaagcttttaattcagtcaagagaatttttaattttttaaaaggaccggctggtgaatgcaagaaacttttggcagggttaatagactggcatagtgggtggacctatgagattaatattgttaatattttattttaaggaagcaggagctgtcggaaagtaggggaggatgctactaactcaaagggacttctgcaacttcaaccctaagtttctgagacaggaaaacagacatgttggttgaaccatgtgaaattacttttgctaggtcaaaaacagtgatgattggcaatttcatgttgcacaagcatttccatctagcagtgctttcagagaatccaaggctgtgatatatcattaccttctcagatttgctctggtttcagctgtgttcattagctatctgaagcattgaacacccatccaactctaaagctggaagattacctcatctgaatgagacctggccccaaaagatggttaaagttcaagctggttcttttcaaggcaaccttgccttttacagggcctgactcagtctcactaaagccatatgtaatactccaatggtgtagagacagaaacgtttttctttgccattaagtactttttttggatacagtattgtacttttttggtatacagtattaagaggaacagttttaacactggagcctggcttttctgcctattgttgcttcttattcttattttgacgtgtcacccttgctgcctgtgagaatgtcattgataataatacatgatatttcccattctttgtttctcagttcacttgtcattttgcattcaggagaagggacagaacaggaagtccagtagccagtgtcagagcctggagcagctcctctccttcctggggttgagttccttggttttcttgtttcacctttgctaccccactgcagtttttctaccacgctgggtttagcacgaatcaggagttgatgcccaggtaccctgtcaaccccatttcattccagcagttcttcagcacggtcatccaaatagactagaatttgaattgaacaacagtagttctgtgggcctaacaatgaaataatattaagcagtcaggatattatattactaaatagtcactcacttttgttaattattgtcatctgcgttgtagtcttacagaggactttcacatatctttaggagatagagcaggtatgattacctaaacttttagatgagaaatagaggtccaaagaagtggtgcaaagcagaaactacacccctatgcttactcttgagaaagtgggaaaaaaatgaggtttttaaaattaaagacctaaaacctagtccaattgaacattattctaacagatgatcagattcacaattagaaacaaatatttgagctattactgtttttcgtttatttgcttgttttttatttttgagacagagtctcactctgtcacgcaggctggagtgcaatggtgctatctcggctcactgcaacctcctcctcctgggttcaagcaattctcccgcctcagcctcctgagtagctgggattacaggcgtctgccaccatgcccagctagtttttgtatttttagtagagactggctttcactatgtcggccaggctgggctcgaactcctgacctcaaataattcgcccgcctcggcctcccaaagtgcagggattacaaccatgagtcactgcgcccaccccaatactgttttttttttttttatggtgactctttgaccaaataatttttaattgattttaactttttacccctttagctaagttcattaatcccaaaatggcaaattaggaagtaggctcttttagcaacgaattacaattaatcaatgttccctgtggcaaaataaccttactttattttataattcagttaaactaaaaattttaatctttacctgatcaatcatctttatgaaaagtcaactattgaaactgtatgtcctgaatttggttttttacttctgaagatttaaaacaatatcaatgacctctacagcaaatattttcttcacatctcagggattttcctatatttaaattgctccttcatttactaacttctaattcttttttgcaattacctttgttactcaaattctcagtttcaatgagacaatttttagatgcttcaaataaaaaaacaaaggagggaatttagtcatcttgattttatatcagaagtgattttccctttccctgttagccaaacaaaaaatccaaaactctgatcaacatcatttctatcttttacagccaaggacagagaaaaacatccagatttgggaacacaataacagatatgattgtccccacttctactgccaaaattataaaactgttaactcctcctcatcagcttacctgactacttaaaagcaaaagagttaattaagtattactaattggtgatactagatcaatgaaggtaggtcatggcccaaattgtacttatggagatggaagagcttaattgtttttattaggcatcaactgcatcagaaatttcattagcacttagcaaatttgcctatggtcttcttaaggtgatcattttgaattgggttctttaaaagacatgaatgactggctgcagtgactgacacctataatctcagcactttcagaagccaaggtgggtggattgcttgagctcgggagtttgaaacaagcctgggcaacatggtgaaacttcctctctacaaaaaataacaaaaattagcctgacatgttggtgcgtacctggtgttccagctactagcgaggctgaggtggaaggatcacttgagcctgggaggtggaggctgaagtgagccatgatcataccactgcactccagcctgagcaatagagcaagactctgtctcaaaacaaaaaaacaaaaaacaaaaaaaccccaaaagacacgagtgttcagacactcagttgcagacattaaaagagagcacagacacatgtgctgttttaggtataaaggaaagactctggaatcaggaatgagaagcgaacatcctgctctgtcgctctagctctctatgcctcagattcctatcctgtaataagtgggcatttgggttacatgatttctaaactctaacagcactcataatctattatataccaatcacctatgctaatttactaattatacactagatagtatggttatatactaacagtctattatacaatctgctaaaaattcataaaaatatctatccctttacattttccacaaaagggcttgaccatttttcctgaattatttttagttttctgctctatagagataagaaaagttattcctttaatagaaacttctattcaaagcagaaaatatgagcagatcttatttatagcccctaggccccattcttaacaaaacatttatctcagtaagaaggaaagcacagaataaactttgtttaatcgtacctactcttctatgctgtctaaaagcatttccgtgacttttaccaaagggctggataaaaataaaacaaatcctttatttggcaggattgggcctggggaagggagaatatgaatgtcctaagaaggcatctgagatcacatcctgtatttgttgttattattgtttttttttttttttttttttttgagacggagtttcgctctgtcgcccagcctggagcgcaatggtgtgatctcagctcactgcagcctctgcctcctgggttccagcgattctcctgcctcagcctcccgagtagctgggattacaggcgcccaccaccacgaccagctactttttgtgtttttggtagagatggggggttccactatgttggccaggctggtcttgaactcctgacctcaggtgatctgcctgcctcggcctcccaaagtgctaggattacaggcatgagccactgcacctggcctgttagcattgtttttaaactcattgttgttatttgctgctaacaaaaatgtaagttacatcttctccttattacaacacagatgatctttatcaccaatcctggactcttccccttccctggcatcttcctccaaagcagggggtggggagggaggaaaaagaaggaggagaaggagtaggaggagaaggagaagtagggggaggatggggagggaagggtgaaagagagaaagaaggaaagaagcggagtatcctgaggcctggggcccctgagctgagattcctcctctggcctaggtgcctcggggtattgttgctgtaggcactaactatacagcagtgaacaaaccagacacaaaatcctgcttttctggagcacatgttttcagtccttaatagcaataagtaagtcagagtgtagatttgggtaaattttgttatcaatattgtcctgtgttacattttcttagtagtaagtatttaatattttcccccccgtctaaaaataaacacaatgtaagtgactcaacagaaccaaaaaaattgttgtcaatttttaaatttaataaatgagatatttgttgggatgtgatttttttacacgagagttagttatgagtttctattaacaaaagctggaattgttctatatttgaattcgggtgtcttttggaaattcaatattaaatcttagtactaatagtacatgctgttcaatccctgtaatactttctgattgtcttaaatggactgcaacttttctttctttaaaagtggtcagatatattgcgttcttaagattataaagtaggccaagtgcagtggctcacgcctgtaatcccagcactttgagaggctgaggtggatggatcacaagatcaggagtttgagaccagcctggccaatattgtgaaaccccatctctactaaaaatacaaaaattagctggacgtggtggcgcgcacctgtagtcctagctgtttcagagactgaagaaggacaatcgcttgaacctgggaggtggaagttgtagtgagctgagcttgcgccactgcattccagcctgggtgacagagcaaactccgcctcaaaaaaaaaaaaaaaaaaaaaaaagaagaagaagaagaagaagaagaagaagaagaagaagaaaaatgatgataaagtaaaaggccagtaactggcagccacatgttatgcaaacattctcccctctgtaaatactacatgaatgttatttttgctttcagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcaggtattctcttatttctgttaatcataatgtacacgaggggcatgggagctggtggaagacgagagagctgaattgtctgtgttgtacatggaaaaatcatttttattttgcttgttttgaacagggtgctcgaatcattgtgactccagaagatgcactttatggatggaaatttaccagggaaactgttttcccttatctggaggatatcccagaccctcaggtgaactggattccgtgtcaagacccccacaggtattttaactatcttagtcttttgtgcaaaagtaactctctaaaatgcgcacgttcaccaaagcaaaatgattgctcttgaattaccatatatgtggtatatgttatggttatatttatctcaacatttgtcagattttaaaaaattgtacttagatactatttaacaatcttttgtgattgaaaatctttattaaattttgagaaaatgtgtaaatagggtattcctgcaagaaaaactaagggaagagatctcatagatacaagtagtaacttaatttctgaagtagacagtggattgtgttaggaatacattccaaagcctctgctgaagggacaccctttcaatgttatagagtctctccattccagagttgcttcttaggcagaaagacttcaccatgtattttcaagtgaatcataagaccttatgctttgaaactgcattttcctaggctcacaaatctaattttcctgggaaaaggttatctagaaaccttctaatatatattaaaaatctgggtcctactgtcatcctggaggtgtcaacgtggcagttgcatggacaagtctggcatgaaaagacaaaattatatctggagatagaaaatcaaatgtcagcatatagatggtgttaaacaccatgatgagttcacctgtggagtgagttagagaagagtttaggtataaggcttgagcactaggaaattctagtgtttagactcggaagaaaacgaggaatcagcagaagagtcgaagaagagcaaccaataaataggaaaatgagagggtgggtccaatagagaagtgaggtgtttccagaaggaggtgtaattaactgtgccaactgctgttgaaaagttaagatgagatcaggtaaaatgtgggggtcactgctggcattagtaagagtttgggtgatagagatacaagttggagtgctctgaaagggaatgggagaggaggaactggcaacagcaagagggactgatcttttgaggagttttgctttaagagagagatgaggattaaagcaatatttggaagggcatgtttggaaaggtcaaaagaggttttaattttattttttaaagatgggaggtactagaggatatttcattgctgatgggatgtttcagtagagaggagacccttgatgaggcaggagaccgaataatgaatttctggagcaatagataccgtgtgggaagcattcatcaagtgtataatcatctgtggcttttaaagtatgatatttttaggcatagtttttgtattaacttaagttccacttaagtggttacagttgctatcgtttccatataaagtgactaaaatatttttttaaaattgaaatttcttaattataatttggtttagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggtaagagagagtgacggacgtgtaaaatggagcgtgttgtgagtggtcaatgctgggtttaggagtttgaatttcattccctatatgatacaatattactagagggtttttttgttttgttttgttttttgttttttgaaagtgggcaataaagaaaatgacacttttggctgggcgtggaggcttatgcctgtaagcccagcactttgggaggctgaggcaggtggatcacttgaggccaggaatttgagaccagtctggccaacattgtgaaaccccgtctctactaaaaaatacaaaaattagcggggcgtgatggcacatgcctgtagtcccagctatgtgggagctgaagcaggagacttgcttgaacccaggaggtggaggctgcagtgagccgagattgtgtcactgcactccagcctgggtgacagagggagactctcaaaaaaaaaaaaagaaaaaaaagaaaaagaaaaaagaaaatgacacgttgtaaaaaactactcagaaaaacatgtaggcagagaactgttaaaaaaaaaaaaaagtagcatgatggtccaggattgagataaactttttgcacatataaaacaaataattttaacataaaaaaagatactaaggtgactataatctgggcactgtttcaataattttatatttttttagagacagggtctcactgttgcccaggctggagtgcagtggagccatcatggctcactgttaacctcaaactcctgggctctagtgatcctcctgcctcagcctcccaagtagctgagactgtaggcatgtgccaccatgctaatttttaaatatttttttggaaacagagtctcactacattgcccaggctgtctttgaactcttcacctcaagcagtcctcccaccttggcctcccaaaatgctgagattagaggcatgagccactgagcacagccataatctaaatactatttaatattgaaatggtagaaagatgtttcaaaattgtatgaatcagctttgcataagttaatttgctatcaaaccacaaaataccttattttctacaccagctaatttaattaccatcttatagatttaagatcaaaccataaaatgtttactttaaattctgaattgaaaaaaggaatcaaataacctttaagtcataattttatactaaactaggtagagaaagaagcctggccttttaaatggatatgtgtgatgtacaggcagtatgaatgtcccttctccacacccagatattttgtaagcatcttaaactgtagcctcagaatctttggagtggagaaattatctcctggcagtctcagttaaaatataaatattaattaagaggagggatgttaaaccaatggttttcaaatgatttcgatcatggacccctattggaaaaaatcgttaacataagtcctcaatatatgtatttttgtgtgtgtatttataaagtgcaacaatttcaaaatgctttcttcataattttgtggattttgacagcttcttttcatatatatcactgcatttcactttcttcttaaaatgtgtctcatagtaaaaatagaaaggtcagtgcttccattttcttgcttgggagattgtttgcattatttgtattatctttcaatgcagtttatttgcagtaatcatttgaagctattctgccattctgtaaatatgcaggatggcacagtgcactgaatgtggacaaactagcaaggaacctgcagtcaccctgtctaagttgaaaggctctcactcttccctgagggtacctcagggaccgtttgtaacccatgacctctgacatatgtgaacctaatgagaatacctttgtcgatcaattcctttttttttttttttttttttttttttaggcagagtctggctctgtcatcccggctggagtgcaatggcacgatctcagctcactgcaacctctgactcccaggttcaacccattctcctgcctcagcctcctgagtagctgggattacaggtgcataccaccacacccggctaatttttggattttttagtagagatggggtttctccatgttggccaggctggtcttgagctcctggcctcaagttatctgcctgccttggcctcccaaagtgcttggattacaggcatgagccaccttgcctggcctgtcaattcttaaaatagtagtaaagcccaatttcttttctattttttagatattttttctacactgcagaccattttattaactgttgattccatttattatattagactaagtttttttttagtttacctagaaggaatcgggaaattaaatacatttctatggtaattttgaaaggtgggcaagagtcactgagattactttggatgggacactaaagagagagatgacatctctcacctgacttacaggtatttattatgcatctattaatattacgtttctaggcaccaaggattcaaagaagaataatgcatgttttttaacttttaagaagcttatagggccaggtgctgtggttcattcctgtaatcccagcactttgggaggcccaggtgggtggatcatgaggtcaggagattgagatcatcctggctgacacggtgaaaccccgactctactaaaaatacgaaaaaattagccgggcatagtggcacgtgcctgtaatcccagctactcgcttgaactcaggaggtggagattgcagtgagccgaaatcatgccactgcactccagcctgggtgatagagcgaggctccgtctcagaaaaataaaattaaattaaatttaaaaaaagcttacggactttggggtttatgggggggtatttggctcttaactgagagagagggaaagagagagaagggagagagaggagatgagagatgctatggacgtatgttacatattcctccacattttccttagaaatttacttccaattgccagatttatccgcttcctaggagattccctgcagttgaccatagccaaatctgttaccaacttagagggtttttatgagtcatttcttcaacaaataaggttttactggttttctcctatccatttgttgtagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggtaattcatgaccaggttaggtttcatcttatatttttaagtgcagagaaatgaatgcctcagttatgacttgtattaattttttgcttattggaaattcttactgtgtttgtcatagtttcacaatagaaaaaaaaagctagcacttgattataagctatggttatactaagacctttatgtgtattattcatttaattattacaataattatatgagatagatagtgtcatcccaattttgcagatgagaaaattgacatacagagagtgcaagtaatttgccaaatgctacccagctactactttcctcagtggccatggaagcctctatatcttgccctttgtctcctcctatggctgcatggcatatcctcgtgacatggctgctgtcttcctctagagcaattaatgagaggggacaagagagaaaaggaaagaagccacattgctatttatgactagttacccaccatcacttctgccatgttctattcattggaagtgagtcactaagtccagcccctcttcaaggggaaaggaattagatcctcccaccagaaagaagaattttaaggaatttttggatatatttgaaaaccaccacaatgaggaataggggagaatttttattccctttccccacctttcaggaactcctgactacaaagatttttgtagttggtttaattttccataatgctaataaataatgctattatatttaaggtttaattgaaatgagaccaaggaatgtttattttaatctcttccattagagaatagaagtagttaggtgttcagtgcaattagaagcatgtatcctctctcatcgtgactaatatggtggcgtgatcacatgcccaattctgatggggaaattggcagttttggtttttttgtgtgtggtgttgtttttagaagacttgtctttcattcacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtaatttcagttcaaatgaaagggcattcaagtgaaaggtaaattccaggttaactttttatatttgttccagaaaaccaggtgcttttccttggcttgactccatgcattgatggcaacacacacacacacaacacacacacacacacgtgcatttatgcacgtacatacactgggataaaatatttacaatgggaattaagtataatcttattgcttgctttaagcatatttaaaaaattattaacctaaccatgatgagtttcgatttgactaataaaccagcctactgtggagaacatcaagaagacttccttaagtgggtttgccaacatatctaaattataaacagtcttattttcacttgcaaaactaacagtaaatagagatactacttttattttagtttctcttctaatcagatgtcccgggttttgtatagctttctttttcttttcttttctttttcttttttttttttttgagacaatttcactctgtcaccctggctagagtgcagtagcatgatctcggctcactacaacctctgcctcccaggttcaagcgattctcatgcctcagcctcctgagtagctgggactacaggcatgtgccaccacacctggaaaaatatatatatatatatacacatatacaaaatatttttagtagagacagggtttcaccatgttggccaggctggtctccaactcctcacctctgctgatccgactgcctcggcctcccaaattgctgggataacatgtgtgaaccaccacacctggccttgtattgctttcaaatgacaaattttaaagatgaaactttttatagaatgttggctctgaatttgtattttcctattatactccatgtcccactgccttcttctaaagaaaaggattgggaagagaggtgagattaaagggtggaaaaaattttaatatcctttcagcttcagtactcttcagtactattgttgcccaaagatctccacttcattgagctcgatgccatcatctgacataccaaactaatggtttaactctaattctaaactgacttctttctcttaatccgcttgttatttaggaagtgggttgattctcaagtcactggccatttttaataaagcagttaattataagacacatgatccaaatcccttttcagagaaagataatgtttgcttcgctgtagttaaaaactaaggcaacatttctggtatgagtaacttcaatgtaaggcattgcgttttatctgcgtttgttccacataggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtaagaggacttttataagagtattttcattttatatgttctctgaagtcaagtaaaacaagctatagccactctgccagttaacttctgctgtgtaacaaatttcctcaaaaccatttctttagccctggttctgtgggttggcaatttgaacttggggtaggtaggctgtttttctggtctgagataggctcagttgacgttggctgggctcattgtgtctgccattggctagtgggttgattaggactgaccagtttgtgattgccttgtcctggacagctgggattattaaggccatctctccccgtggtctctcatctttcagcaaacctgagcttgttcacatgttagctgaatgagtccaggagcatcaagagaaaaacaaatctttgcaagttctttgcaaatctctgcttgcaccgtgtttgcaaatgttgcatcaacacaggaagttacatgagcagtggtgattcaaatggtagagaaatgaagaactcagacctctcaatgggaagagctataaaatcacacggcaaaaggacatgggtcaaggaggggaaaatattgtgatcattttttcaatttataacaactaattataaaatgatgatacttcattggaagaacataataaagaacatacctagaactgtgagtctgagataccattcattgaagaatgtttgtttatagatttttaatttccttttgtcactagtgaagacaaacagaaaatcagatgtttatttcacatttttttttaaacagagtcttgctctgtcacccaggttagagtgcagtggcatgatcatagctcactgaagcctcaaactcctgggctcaagcaatcctcctgcctcagcctcctgagtagctaggatttaaaggcatgtgccactgcacccagcatttgttcataaattacagtggctgtagctaattaattcacaaattaagctggcttcaaattagaattatgactctgcaggcttatatctgctaatatacaacacttgcacacatgcacatacacgcatacatacacatattccagtggtttgaatattaatgtcttctctgaattgtggcaaacagtggcagggtttcagtaactagggtgaaatcattgcatattctataaaatagggtccaagttaattcaatcaaggcatcaagtaaggaagtctttaaaattgcagattgcttatggtcatgtatctgtatctgctgtgttatcagagtggaatatatcatacttataaaaatgcttaattctatgaaaccaacaatttaacatacagtgtaaccttaaggccataaaatccaaagatcaggaatgctttgctgccatagaacctgtttaggcagaatctcatgagcaaattgaggctggaataaaagctgaagtgccaactacagaaaatcatgattaaatctacagcaaggagtctggggctaaaatccagtagctaaaaggtggctggactgacataaatatctatctgagatcacttcaaggaagtgagagagagaaatcagggtcaccaaggtaaacttaggaggacatagggtctagccatattgatgcattatattctgtaagcctgaagatttaaactgagcacacaatctaattttctcgtactactttgccactttttccatgtcttgtactcatagaaatctatctctttgaggaattgtcccatagtaggactgaacatttacctgatgaaactacttcatccatgggagaaggacaaaaaaatgctagagttttccaaactaggttaaaggtccaaagccagaaataccatttcactcttactctgaaccacataagtgtttgaaggtggatggtgatagtgcatgaagagttggagaacgtaaataatttattccattactacttcctttctttgttttaaaaatttcatcccaaatgtcttcaggcagttaagaagagttagagaatgatacaagagaatacatgtttaaatgcttaactccatagtatttgtacatctcaactcttaaacatttttttaaattatttttaattattattattatttgagatggcgtctcgctgtgttgcccagactggagtgcagtggtgcaatctcagctcactgcaaactctgcctcttgggttcaagcgattctcctgcctcagcctcataagtagctgggactacaggtgcatgccaccacgcccagctactttttgtatttttggtggagatggggtttcaccatattggccaggctggtctcgaactcctaacatctagtgatctgccacctcgacctcccaaagttctggaattacaggcatgagccaccatgcctggccttgtttttaatttttgtgggtacatagtaggtgtatatatttatgggttacaggagatattttgatacagacatgcaatgtgtaataatcacattagggtaaatatggtatcagtaggtctcaacttttaatgattctgtgaacttgtcatgctgtatcccatctctggttccttcttagatggaaggaaggagggaagggggcatagcacctaccgtttaaattgggcacctgtaatcattatttggatcttgtcttacctgctccagaccatttgcagaagaaggaaatgagatatagattgtattacaccaaaaaagatatgaaagagccatgtgacagctggcagggagggtctttggaattgtagtcccttggagggagcatcatgatgagggtgaggcaggtctttattttgtaagtgtagattctctgtggcatgactttcactgaagttcatcaggttctaaggaacagatactaatcaaatttgcaagatagataagcgagaacaccaacttgttattttaaaaaataggttcccttagctgggaacaatgaactgtatgtcaaggagactcttcattggcaaatcctctcaaaagtacaaatgatagatcagtttgttttgtgagtgcagaattaaaacaaaaggagttgggcattcttggaaaagatttccaagaacccacagaagcctgaggcaatgtgattcttctctttagggctggtgatctgaagaccatgtaggatcaaggtgcccactttcctcaaaaagagccaaaaaaaagtccaataacccattcttggtttttttagtgcttcttttctctagagaccttgcagggcatggcccttctgtgaatatgttgtttctagaaacagcagtcataatattgaagatgacaaatgttttacatcagtcatgctcattatggcttcttgagtagcttctcagttctgttgatggatgcacactctctccatagatatttacacgttatcttagaggatcactattgcagagatttcaacacacttgttgtgtatcctcaacccccaccaccactttagttttatgttaaaagggtggtgttactcaccatgcccacaaatgtggaaacatcttgctttagcaccttaggcaactctggtgtattgtcagaagcactggcagagtctgttctctgtaactaactagttagataaccttgggaaagtcacttaacctctgaatttcctactcatagaagagaatattttcctcactgatttggtgaggatcaaatatgataatgcatgtgaagacactttgtgaatggtgaagtacaatcattatcttctaggatatttagtcattttctcctcccagttgtaaagcatctgttttcctaattttcaatttcttctccactccaactaatttcccaattttcaatttcttctccattccaactccatttccacaactaatgggttcattttcttttattcttgttctgtttattgactgtctatgcatgtttccttctgttcttgttcaattgctttgtacatattcctctcttatgaaaactccactgtggcttcaggctagatctagtcattaatgcctttcacagtctgatctccaccttcctctgatcatattccttcttctcttcttcactaatcttcagcgctagccagtggtgtgatgtaactttaaacaattccttctctgaggtagaaaacaaaaagccctgacttatggaatttgccagttttcattgtgtcaatattcccgccatgatcccaccagcttcaagaatggatctgttggcagagtttgatagctcacgcctgtaatcccagcactttgggaggctgagttgggaggaccatttgaggccaggagttcgagaacagcctgggcaacatggtgaagccctgtctctactaaaaatacaaaaattagctgggcttggtggcacgcccctgtaatcccagctactggggagcttgaggcaggagaatcacttgaacccagcaggcggaggttgcagtgagccaagatcatgccactgcactccagcctgggtgacagagcgagactccatctcaaaaaagggggaaaaaaagaatggctgtgtttaacagccagctgtccaatttcctggaaatttaacaatctgttctcatgagcctgtgcaccactagctccagcacaccactggttttaaccaatctagaatgagaactcacattgccttgatctgtcacacacacttctgtctcagaatgagcctttgctggttcaatgtccacttcccacaatgtcttccaccatacagcccttgaaagaaattcctaacagcttgagtttttggcagcttgtgtcccactccgtgaaacagaccagttcagttttttttttctcagacctcctagcacttacctgttctcttctctgatacactgataaactgatttctctctttatgtttagaatccgctccatttcaccattagctctttagcttcttgagggaaggatgtgatgtataactctctggttcctgattgtcttgcacataatcgaactcaatgaattgctgctgctgattttgactttccattaatggttacatttgattgttgaaactaaaatcttgggccctcttgaattgctctagtcttcattatgtagtaaatggctgtcccctgcctggcctacttgctgcatcctcctaaatcagaaatgatttgactatacattatatctaggatggtttcaaaatgattaatttgcttttaacttctatgttaagaaagctgactgtacttttcccaccttttctttaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 10907 - DNA, 513 bp, Homo sapiens
ggagtttcgccatgttggccaggctggtctcgaactcctgaccaggtgatccacccactttggcctcccgatgtgctgggattacaggcatgagccaccatgcctggcttctttttccttttcataaagtatgggacatttaaaatttgccaagttttgcttgaggaagttagatgttgtgcagtggttttgcagcatgtattttggctcttgggcaatgacgtttcatttgcagaagtttagatgttgattgaaaatcaacagctgacgttaaacaaactggtttgagtaagatacaagcaaggagctcctttcacagaaagggacagttctgattcaagcttggagctctcagctgtacctcagtttgttaaaaataaaaacaaaaaacgaaagcaccaagtgccaaggaaattaaagagcacttaatgctctactgtaaaattgcctgcaccacattttaacccatctccaccgtggtttctcacatacattttattttatcaaacaacc

SEQ ID NO: 10908 - DNA, 857 bp, Homo sapiens
ggtttatcaaaaaatgtcatgaatgtttctatatttcttgttggtttatttctcattattgagttatatattgctggaagtttaacaacttctcttgaattccaacaggaagcatttgctaggtaggcatttggtacctaatggataatctttcatgatggataaatctgccacatcagtctctcttgactttgaaaattaaaatctgggcactttgggaatttctgctgtcttaattggctggcctgtcctgtgaacagccgtcttctctaaatggtataataactgcatttcagcgctgtctcattgtgagtctttttgaaagcttttaaaatgatgttgtgtgatccaaatttaaattaatagttaagcagtgtgttctaccaccaatgcaaataactcaactgaatgacaattggatcctgcttcactcagtttgcgcataaatggttgaggaaaactacatcataggtgacccccgttggtggtagccaaatttcatagtctactgtgtgaaccatcatgatttcagaagcactaaaatatagaaacatacattcttggccaggcacagtggcccatgcctgtaattccaacactttgggaggccgaggtgggcagatcacttgaggccaagagtttgagactagcctgtccaacatggtgaaaccccatctctactaaaaatacaaaaattacccaggtttgggggtgcatgcctgtaatccgagctacttaggaggctgaggcatgagaattgcttgaacgccggaggcagaggttacagtgagccgagatcgcaccactgcactccagcctgggtgacagagccaccctgtctcaaaaaaaaaaaaaaa

SEQ ID NO: 10909 - DNA, 857 bp, Homo sapiens; identical to SEQ ID NO: 10908

SEQ ID NO: 10910 - DNA, 857 bp, Homo sapiens
ggtttatcaaaaaatgtcatgaatgtttctatatttcttgttggtttatttctcattattgagttatatattgctggaagtttaacaacttctcttgaattccaacaggaagcatttgctaggtaggcatttggtacctaatggataatctttcatgatggataaatctgccacatcagtctctcttgactttgaaaattaaaatctgggcactttgggaatttctgctgtcttaattggctggcctgtcctgtgaacagccgtcttctctaaatggtataataactgcatttcagcgctgtctcattgtgagtctttttgaaagcttttaaaatgatgttgtgtgatccaaatttaaattaatagttaagcagtgtgttctaccaccaatgcaaataactcaactgaatgacaattggatcctgcttcactcagtttgcgcataaatggttgaggaaaaccacatcataggtgacccccgttggtggtagccaaatttcatagtctactgtgtgaaccatcatgatttcagaagcactaaaatatagaaacatacattcttggccaggcacagtggcccatgcctgtaattccaacactttgggaggccgaggtgggcagatcacttgaggccaagagtttgagactagcctgtccaacatggtgaaaccccatctctactaaaaatacaaaaattacccaggtttgggggtgcatgcctgtaatccgagctacttaggaggctgaggcatgagaattgcttgaacgccggaggcagaggttacagtgagccgagatcgcaccactgcactccagcctgggtgacagagccaccctgtctcaaaaaaaaaaaaaaa

SEQ ID NO: 10911 - DNA, 453 bp, Homo sapiens
ccgccgtgcctggccttcccttgctttttctttgtgtggatttgagtacatgtcagatgtgctgtgtgtgtctaagtgtgtgttccacctgtgtttttccttcacacaatcccaggccctgatatgttgtctatatggcttattttctggagcagacaggaacagtgtaatgaaagagatcagacttgcgtttaaatcccatccggccatggatgtcctgtgtgatcttgggcatgtcattcgaactcctgaccacaagctcctcatctaagaaaagagtgatattatctacccccacatggtttctatgagatttagaccagataatatatcagcagtacacaggagagataatattttttttcctttgcatagtctttccctgctactgcttttcattctgctcttctcccttcttccccttctctgttttttgtttgtttgttttgtttt

SEQ ID NO: 10912 - DNA, 117 bp, Homo sapiens
tagtagagatggggtttcaccatgttggccaagatggtctccatctcctgacctcatgatccgccctcctcggcctcccaaagtgctgggattacaggcgtgagccactgtgcccgg

SEQ ID NO: 10913 - DNA, 117 bp, Homo sapiens; identical to SEQ ID NO: 10912

SEQ ID NO: 10914 - DNA, 453 bp, Homo sapiens
ccaccgtgcctggccttcccttgctttttctttgtgtggatttgagtacatgtcagatgagctgtgtgtgtctaagtgtgtgttccacctgtgttttgacttcacacaatcccaggccctgatatgttgtctatatggcttattttctggagcagacaggaacagtgtaatgaaagagatcagacttgcgtttaaatcccatccggccacggatgtcctgtgtgatcttgggcatgtcattcgaactcctgaccacaagctcctcatctaagaaaagagtgatattatctacccccacatggtttctatgagatttagaccagataatatatcagcagtacacaggagagataatattttttttcctttgcatagtctttccctgctactgcttttcattctgctcttctcccttcttccccttctctgttttttgtttgtttgttttgtttt

SEQ ID NO: 10915 - DNA, 2932 bp, Homo sapiens
ccccggctcccgcccgctcccagccgggcccctcagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagtggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccaccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccacgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccattttttggtgtgtttatggaagtgcatgtagagcatcctgccctttgaaatcagactgggtgtgtgtcttccctggacatcactgcctctccaggtcattctcaggcccgggggtctccttccctcaggcagctccagtggtgggttctgaagggtgctttcaaaacagggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggttggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagactcttgagaaattgttactcattgaactggagcatcaagacatctcatggaaatggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaataatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtctgtggttcagagtaaacttgaagcagatctctgcatgcttttcctctgcaacaattggctcatttctcttttttgttctcttttgataggatcctgtttcctatgtgtgcaaaataaaaataaatttgggcaaaaaaaaaaaaaaattaag

SEQ ID NO: 10916 - DNA, 333 bp, Homo sapiens
atctaaaatcaaaagttgaaattataaaaaataaaaaaataaaatcaacaatgtatatttctctcacacagccatcacgatgatgtatttggaataatatatgcataaggatgttcattgcagtgttgtctgcaaggacaaagtgaaaacaatctgaataaccaacaatatgacacagagtaagtaattattggtacgtctgtacaatgcctcatgcaatcaccactgacagcatgggaaagagagacatctattatgaaaagaccactaagacatatgattacatgataagtgcaaggttcatgaataaatagtatgtatactagtatagca

SEQ ID NO: 10917 - DNA, 6594 bp, Homo sapiens
gttctcatgtagcatgtcccattaatgttgcttgaagggtgagtttatgtgccttctgttttacaacattgggtaggcagcaatagattattttctgtttatggagaaagcatgctttgtagagccttaaaaacacacgtgttaatagctaaaactttaggtacgtgagggaaacaaatcttctaacatgttgcttaatgttagttaattgttttttgtcttccttaggctgacattttggatgtcaatcagatatttaaagatttggccatgatgatccatgaccagggtgatctgattggtatgtattattgatacctttaacctcaaggtgagttgatagtatttggcatgcatctgtaatcccagctactcagaaggctgaggctgaagcaccatctaggagtttgaagccaacctgggcaacataatgagaatttgtctcttaaaaaagaaagaaagaaagaaaaaggagttaggctaggcgtggtggctcaggccctgtaatcccagcactttgggaagcccaagcggcgagatcatgaggtcaggagatggagaccatcctggctcacacggtgaaacccgtctctactaaaaatacaaaaaattagctaggcctggtggcacgcacctgtagtcccagctactcgggaggctgaggcaggagaatcccttgaacccaggaggtggaggttgcagtgagccgagattgcgccactgtattccagcctgggtgaaagaaatggcttcgtctcaattaaaaaaaaaaaaaaaaatggagttagtcatatcagctatagagttaaagtatgtttaggaatgccgttttaaaaattaccaaatttatttttcgtagcaatttttttatgttatcaaatgtagaagttaaatgaggcctcatgaatactcagtcccattgacttctttgtacatctttgtttagagaaatagctctcagcttcccagcttttatctcaacaaacttgcaaaattatggggttagtaaccctttttttttttttgagacggagttttgctgttgttgcccaggctggagtgcgatggtgcgatcttggctcaccacaacctccgcctcctgggttcaaacaattctgctgcctcagcctcccgagtagctgggattacaagcatgtgccaccacgcccgctaattttgtagttttagtagagacggggtttctccatgttggtcaggctggtcttgaactctcgacctcaggtgatctgcccgccttggcctcccaggtggtgggattacaggcgtgagccaccacgcctggccagtaactctttttttaaagctttctatgtggaaataatttcgagtttattaaaagttgcaaaaataggctgggcatggttgctcacgcttgtaatcccagcactttgggaggctgaggtgggaggatcacttgaagccaggagttcaagactagcctaggcaacatagtaagaccctgtctttaccaaaaaattagccaggcatagtaacatgcacctgtagtcctagctactcaggaggctgaggtgggaagatcacttgaacccaggagttggaggctacggtgaactattattgtaccactgcactccagtctaggtgacagagtgagatcccgtctcttaaaaaaaaaaaaaaaaaaaaaggtagcaaaaataaaaatattataaggaccttctttataccctttacccagatttacctcttgttaacattctaccccatttgctttattatgtattctttctctctttctctatgtgtatctacataattttttatgaatcatttatgggtaagttaaatacttcatagcccccaaaaattcattgttttttctccaaagaatagggctagtctcttaccaaggtagtaactcgatttcatggctggatagtttggatagtggtagtgaaaccaggacatgtaacatcagaaatctgttcaatttgcagtcttaaaacatctgagtgtgttaaaacatcctctgtccttccttttgcagatagcatagaagccaatgtggaaagctcagaggtgcacgtcgaaagagccactgaacagttacagcgagctgcttactatcaggtaaaagcgggtaccaaagaaagtcactctgtgttgcagactttttaggccatcagagtacattgacatattgagaacagctacagcctttgcttaggtttaagctaaaggaaagtagtcataattgcagtcccagttccatttttattattttcctttgcagatagatctacaaaaaataatcacaccttgaataaacttatcagaaggctagtaactgcaaagctaaccctatacactaatatgatacctaaatctgctatgaggctgttttatatcccgaacagctgaatgtatttcaattaggatagtaagaagtacagttaaagtagaagacttcatagattctttatgttgagtgttgccatagaggatggacatagaatcaacttcgactgctatttatatatgaataaataaggataatcattctggaactgttcctgtaaagtgaaatccttctacatgttagttgaaactctggtttttttacttatccaagtctttatctcagtgtacaaataatgtgaatgaagtctttctcacttcccttcaatttggtgttgcatggctttttagaaataaatagcatttcatgtccttcgcccactttttgatggggttgtttgtttttttcttgtaaatttgtttgagttcattgtagattctggatgttagccctttgtcagatgagcaggttgcgaaaatcttctcccattttataggttgcctgttcactctgatggtagtttcttttgctgtgcagaagctctttagtttaattagatcccatttgtcagttttggcttttgttgccattgcttttggtgttttagacatgaagtccttgcccatcctatgtcctgaatggtaatcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacagtgatagactggattaagaaaatgtggcacatatacaccatggaatactatgcagccataaaaaacgatgagttcgtgtcctttgtagggacatggatgaaattggaaatcatcattctcagtaaactattgcaagaacaaaaaaccaaacactgcatattctcactcataggtgggaattgaacaatgagaacacatggacacaggaaggggaacatcacactctggggactgttgtggggtggggggagggatagcattgggagatatacctaatgctagatgacgagttagtgggtgcagcacaccagcatggcacatgtatacatatgtaactaacctgcacattgtgcacatgtaccctaaaacttaacgtataattaaaaaaaaaaaaaagaagaaatagcatttcagttgttttccgtgttcctgggatagctgtattttacctgggagtgctcgtaaagaaattcgtatttaataatagtgtttcctttaaaaactaggtgattaatttagtgtccaacagtaaaggaataattaagtaaattatatacatccactcattgttgcatatgggaattaagagatgtttctgaagagtttaaacagaaaaatgtttatactaaacattaagtgaggaaaaacatcaaacatcatacaatgtgatccagttatgtcaaataatatacatagataacaaatcagaaagaaatacaaaaatgttgacggtattatctatgggtgatttttttttctccctccgcttgctgtattttttttttacaatgaacataacagttttatacgtattataaaatgttattaaaatacacatgcacaaataacttattttattgcaaataatgcctggcagcacaggtatagttcctttgcaaaattgtatgtggggacttggaattaaaactttgaaacctatactactcggctgggtgcggtggcccacgcctgtaatcccagccctttgggaagccgaggcaggtagatcacttgaggtcaggagttcgagatcagcctggccaacactggtgaaaccccgtctctactaaaaatacaaaaactagctgggcatagtggcacacgcctgtaattccagctgctcaggaggctgagacattagaatcacttgaacctggaaggtggaggtttcagttagccaagatcgcaccacggcactccagcctgggtgacggagtgagactctgtctcaagaaaaaaaaaaacaccaaacaaacaaaaaatacttgcactactacctagtgctgctgacttaagatttctgggaaagtctgtgcataattttgcatggatagagttaatctttaattacaaggaggcagatttatgaagcattcttagagtcttacacatacaaattttacttgtttcatgagtatcttgtttacatatttctttcctcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacattgttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaatttaaaaaaagaacaacaggatagagctgttggggtggcacagtggcccaaagagcagcttcagagataattccttggttctatgatccctgtttaactccaaattacagtcggacttggatacatca

SEQ ID NO: 10918 - DNA, 3148 bp, Homo sapiens
gatcctcaatgtcacgctggtgccctacggaaacgcacaggtgtgtgggcgctggggaaactgaggcacgtgggcaggggagcaggggacccagcctaccagcaggctctcaccctgctgccttgcaggaacaaaatgtcagtggcaggtgggagttcaagtgccagcatggagaagaggagtgcaaattcaacaaggtggaggtgagcggccccagggccccacactggggtgggggaaaactgtcccacgtacaggaggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccaggcctgcgtgttggatgaacttgacatggagctagccttcctgaccattgtctgcatggaagagtttgaggacatggagagaagtctgccactagtgagtgacgcccctcactccacccaaggagggggacatgggtggtaaccttccctgcatccaggcagacccaaattcaagtcctagccctgaccactgctgtctgtgcagcccaggaaaacaactacccttctttattttatttatttttttattttttcttgagacagagtctcgctctgtcgcccaggctggaatgcagtggcgcaatcccagctcactgcaacctccacctccagggttcaagtgattctccagcctcagcctcctgagtagctgggattacagttgtgtgccaccatgcccagctaatttttgtgtttttagtagagacagggtttcaccatgttggtcaggcttgtcttgaactcctgaccttgtgatccgcctgccttggcctcccaaagtgctgggattacaggcgtgagccaccgcacccagccctttttttttttttttttttttttttttttttgagacagggttttgctctgtcgcccaggctggagtgcagtggtgcaatcttggctgactgcaaccactgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttagatcagggctgagagagtggcaaggagagggcactgaggagacactgtggaaggaggatgaagggtgttcctggcagagggatcagcctgtgtggaggtcctgagtaaagtgagatactatgggggtcagaggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatggggtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccaggtaagctgggaggggagcagtgggattcaggtggtgggggtagggtctccttccaggaccccaactcatggccttcacctccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcct

SEQ ID NO: 10919 - DNA, 432 bp, Homo sapiens
tttttttttttttttttttttttttttgagacggagtttcgctcttgttgcccaggctgaagggaaacgcgtgatctcggttcaccacaacctctgcctcttcagttcaagcgattctcctgcctcagcctcctgagtagctgggattacagacacatgccaccacgcccagctaattttgtgtttttagtagagacagggttcttccatgttggtcaggctagtctcgaactcctgacctcatgatccatctgtctcggcctcccaaagtgctgggattacaggcgaaagccaccacacccagccaagactctgccttttaaaagaaaaagaagggaaagaacatgttcagtgttgtattttttcctactgatggactggtcaaatcatagatgtatatattcttccttcgaggaagtgaggcttaattcc

SEQ ID NO: 10920 - DNA, 12301 bp, Homo sapiens; identical to SEQ ID NO: 9333

SEQ ID NO: 10921 - DNA, 33296 bp, Homo sapiens; identical to SEQ ID NO: 9331

SEQ ID NO: 10922 - DNA, 8899 bp, Homo sapiens
tggagatcaacggggagaaggtgaagctgcagatctgggacacagcggggcaggagcgcttccgcaccatcacctccacgtgagtccacacgcccactcccacccaacccgcgccactgacctgtggacacagttgagcgaccggtgcctggtcatggtggaaatgtcactggtgggtccctgaggctgtcgggaagtgagcctgttgttggctgtagtaggtggcgtttggctgcacccttcctggtcctgaagatgtgaggggggtgctgtgggggagtcgctgagcaccctggctggagtctggccggacagtggccatgttctatctccttggagagtcagccgaccctccggcccactgtgccgtcaccttacagagagagcagaatagcatttgcctcgctagggggttgcgaagtgccttgcccacccaggacttagtcgctgacaattcctcttggtaggtgtcagttatggcagctggagttggcctgtgcaggctcccgtcacctgcactgatgccttggaagtgacgctgtctagagacgaacacggtgcatgtcagcaggcccttccctacccttaaagctgttcctgggaaatccggccgcccaccggttgcccacctttgtggctgagctgcaggccggggggaagctgggctcctgcgcagatgggcagtgtccttcggagcggctcctggttattgggttgttagtggagcaggttttaggaaagagcagggtctgaaggggccgatttggagctgttgggctgtgtgtccttaggcaagttgccgaagctctctgcgctcgtttcctggagggcctgcctctgggattggcttccatgtggagggtgccaggtgctctgctgcaggcgtcaacgtgcgtgccggggtgtggtgtctggcagctctgtgtgcttggtgctgctgtcatcccatttgacagagggcgccctggaggggtccctcccagcggccaagcctgtgctccacacagtggcctgtgcagagtgaggggcggctgtctggctccacgggcacctccttggctctctcgagcagctcctctggaagtgacctcaggaaggcgaatgaggaagtcccagccagcggcccccttccttcccacagcatgaaagcccggcactccccaggctggctgcccctgcccccgggcccctcggcatctcccgagggtgggaagtgtggggtgcagcgcccccatggatggctgggagtatgggggagagcagggctgctggagagggacaggtgtgctgggcgagcagctcctggggctggagccaaggcggagggcttgtcactgggttcaccctatgctgagcacatttgtgctgtggcccgtgatgcccggaatccctgggagctcccagtcccggggtcgccctggtgtggtgctgtgtggtgaccgttgatgagccctgtgagcgagggctctgtggcctgcatgtcttggcagctgccagtgagaatctgcggaggacactggggcagggctggcatcagtgctttgggcagcctggggctgcaggcccaggcgaggcaagccctcatgccgttggctggtctgggcgctgacctcatgaatccttgctctgggttggtcctgtcgctaggatttcagctgctttattttggttaatcccggtagagagacctgtgactatctccattttatggacaggaaaacaggcccagggaggatgaagcctcctaactcagtggggcagaggttgggggcactcagggttggccctgagtctgccgaggccctgcatcgactgggcaggtggcgcccctgccttcctgccccgtcctgtgccttaaaaccaggcggaggttcagggtggcagaggttcagaggcccgtggccatgaggaatgaactcctgggcagggcagtggggcctggggggtccgaggctctttcagcaggaggagccacagcccctccctgccatcatgcagtcagctgctttctgggctgggcagagcgggaagaaggtgaactggttcctccattccgtggggaggcggggaggagtcactcagcttcctgggagcaacatgggtttttccccaggggcttgggaaggggcggcctgtgggcagcggctgggcccctgctgccgtcccacgtgtctggggaagcagacaggtggctccatcttagagtcccgctctggccctcatgaggcaggaggcccagcagggcgccctgaggggccactggaagtctcgacgccctttgatggtcactggcaaagaaggaaggagttttggggaggtgaggagttttcaggaatagggcagtcaggatgcagtagcgtgacttttttccgatgcagggcgttcagagagaaactgaaactgcatcctgttagcctggcgagaaaaagccttgtggtcaccccttctcgggttcttgctctcagaagctgaggtttgccggccctgagaggtgcgggtgggatggaggtgaggggagaagtgacaaggaaggcaaggccctggcgttgggcctgggagtcagccctgggcgccaggacttccagctggccgctgcactcagcctcacgtccttgctggtcacatggccatcctgaggtctgctggatcaggtggctgcagacattaataaggtaatggataccaagcccccagctctgtgcctggcctagagcagagtccctgtgagtgaaggtgattcctggtggccatgggaaacgtcggtgctccggttcctcctagccagagctctgagcccctgacttcatccccagacaaattctctgctctcagataaagcccctttcctgggccccggatgaggcagaggcgcccagggagccgcgggggctgtgcgccggggccatggctgcaggcgtttcttggcatctctgatcatcttcagcaaaggagagtctgcagagccatccgctccttgggcttcctctgctggcaggggacagtcgcctgttcctgtggctccggcgcgccctcgctctggaaggcgtctgacacaccatgccatgtgctgacccggcgctctcagcagcagctgccaaggccagagctagttcttgggcccagtgccaagagagcttgatcgtcacagctaccccgaagccaaggagcgacgctgccctggaagcaaagctgtgggcagaatgaagccctgggaagagatcccagcggtcgtgttgaggatggagcaaggatggggcaggggcggtggcaggggcaggttgggctttgtcccagggctgggcaggagctctggctctgcagcatcagggaagatgctcagggctgcccctaagctgcctgttggtttccttccaccacctctgtctgggaccacagattgtccttgaaggcacattgatgatgctgaagaacgcatactgactgtttactgctcccccgccttggggtaatgcttagctcctttcttcctcatgaccaccccagttaaggactagccacctgtgtgctataactgttgaagctgcaaggtgtggcagggtgaatgcaggcaccttcccaagggccagcctttcagagatggagccagggttggtctttgtccttagatcgggcctcagatgtgaagcattggccagagagctgatgggcaggtggacaggaatggagctgcagccacaagtcagcctggctgccccattcttgctcagcctgcgctgacttgggctgttcctgaactggggcttgggctgtccccatgaacctcatgggggtggaggtaattagggctggggcaggtggcagccagaaagccgggaggaagcggcctgtccactcatggtttgtctgtgtgctgtcctgaggagccctggggtggaggtccctgcggctttggggagaggggacagagggacagctctggctgattgcacagtgtggggcggggctgccgcctggcctccggctcttcgacagctctcggggaagcggaggctgtggtccccctcctcctccggggattgatgtcgtcctgtgccactgggatgaatggggacatggggtctggagaggagagttgggcctccccttccttctggccttcctggctggccctgggctctgcatgtttggggtgatggctttgctgggcgccctctccccagccatccctggatgcttgtgtggcttccatgcttttcctgccacctgcacagatgagccaagagtagcaggaagggaggtgcctacctgccccaggggaggggcacagactttgccagggcgtcatgatggtgtggcttcttggaaaggttctctaaaacaggtttgaggagcaaatatttttttgaatgttcaaagacagtgataacatgatgtcaaatacaaaaactgcctgatttcccaaaataaagcaagaacttcaaagatgtttcaagcctgcagcagactctgaacagcaggaggtgactcctcagacctgctctgctgcccaggggctggccctcccgccctgttggtgccccgggcgggcagggggagtcagtgctgccgcagtagcctctcctgctggcctgttgtggctcgggggcatctgccgaggctgagtgagagcccaggctccagggccaccctcaccttttccgggtcagtgtcctgacgtgggcaggtgggtcccggcaagggggtgactcctgtcggggttgacatgctgccgcacactctggccctgcaggtattatcgggggacccacggggtcattgtggtttacgacgtcaccagtgccgagtcctttgtcaacgtcaagcggtggcttcacgaaatcaaccagaactgtgatgatgtgtgccgaatattaggtgaggctgcactcagggccgggtcggggttgggtgggagagaggcagccggctgcgcccctcagggctgcgctgactctgccttcgtttgaagtgggtaataagaatgacgaccctgagcggaaggtggtggagacggaagatgcctacaaattcgccgggcagatgggcatccagttgttcgagaccagcgccaaggagaatgtcaacgtggaagaggtgaggccctgggccactgtggctctgccacacacccgtggccgccttctccatgctgctggcctgcttgaggcatctaaatgaccaacagaaaatgtcatagtaactgccatttattgagtgcctactatgtgccaggccctttaacgatcttagttcatagttcaacagtcctctgaggtaggtacaattatacccacatttcaaatagggaaactgaggctccaagtgttgaagtaactcaaggaccaccacctggctagtaagagactgagtaaacctctgtcccacaccaaagccaagcacagtttccactccagtcctctgcctcattggccgccttgtgctgtgtggagcccagaggcctgtggaagtcgaggatcccactgcttcagggcacaggggccacacagcagcgggcacaggctcctttgtaagtcaggctggtgtcctgatgctggcccatccacctgggcctgtgggcaaggctggtatgaccttgggcggtgacttcacctctctgggccccacatgccatgaagtggcgtggagcaggcagaccccgggtcacctatgtccgtgaacagcaggggcactttcatctgtcatgtcataagattccagctgggccgggcgcgccggctcacgcctgtaatctcagtgctttgggaggccgaggcgggcggatcacgaggtcaggagatcgagaccatcctggctaacatggtggaaccctgtctctactaaaaatacaaaaaaattagccgggcgtggtggtgggcgcctgtagtcccagctactcgggaggctgaggcaggagaatggtgtgaaccagggaggcagagtttgcagtgagctgagatcacgccactgcactccagcctgggcgacagagcgagactccatctcacaaaaaaaaaaaaaaaaaaaagattccagctgaaggaaaggggttggtctctctaaaagaaggactggaaaacccctgtgagattgacttccccaagtccacacagctcatgggcctctgatggtgttccttttttcagacttatttatttgttgagtcagggtctaactctgtcatccaggctggagtgcagtggtgtgttcacagcccactgtagtctcgatctcctgggctcaagtaatcctcccaccttagcttctcaagtagctgggactacaggtgtgcaccaccactcccggctaatttttgtgttttttgtagaggtggggttttagcaatgttgttcctttttgacctttaaataaaataattcaccacctccttctagaataggctttgaagacatacataccaaaaatgcacaggtagaaagagctgggccccggaaggcggggaggcagccgtgcaggccagcaggggcctcctggccaggtctgaggcgggcccttcctctttcctctccacagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaattttcttccagggtctgtttgctctccctccagagatgtgctgagtggccgtggcttcttcccacccaccgtgtcctgctcttccctgttctt

SEQ ID NO: 10923 - DNA, 3516 bp, Homo sapiens
ctctgtagaaattcattttattcttattcagactattttcaaaagaagcagtggtgtgctgtttttctaaaaatatgcctttatagatttttatatatgtatattataaaatccatacatgtatttacatgattgctacatacaaaattacagcactgtggtatgtacacatctacaggtacattcttgccgcgcatccctgctgtgctttccccacgtgagggagggagggagactgaatcggttgtgagcagctgagggctggccgggccgcggagcctctgagttggggcctgggtggaggaggaggggcggctgcagaggcaggagcagcagccactgcaggcttctgcaggcaggcaggcagcatctggaggcttccggcagcctccccctcccctccaccccgtggtgcctgtgctgccctcaaggtggggtggctgaccacagacccctctggtgccattcagtggcctggacttgtttggctaggccaagaaattatgtatgtatgtgaggggtggaggagggagctgtgggaggaggagaccccgtccaaccccagccctgagcaggggaaagggctggatggctaaagcctgcagatgactggtgataacactctgcctggccaggccctgctaaggggcagagactgaaggctgggagggagagcagtggcgacagggggacagggccttcttcctccctggggctcgggtggcctcagctgagcttgggtaagccccggctcttagaccctgcggccagaggcttggcctcctgccagctgaggtgcatgcatgcgggggaggggctgccatctctcctttgaccctgggccaggggctggggaaggaatggaggctcaggcctggcccgctgcccccacaggtctaggcccctggggctcaggcctcctgaggcatgcagagaagggcctccattccttctgttccccatttgctaaaatcaaggaggcagcagtgcctgggggtgggctgcgatctgttgggtgtgagctgcaaagcccaacaccaaggggcccctctgggaggtggcctaaccctgctcaagcacgtggtcctggagaagcccaggcgtgggcttggccaggcggtgggccaagggaagccttcagtggccaaggcaggcccccacctctaggtctccatccccaccgacgaaagggagcaggccctcccggacccatggggccctagcatgaggggcagggcagctgctgaggtgcaagctgcaggggaggccttgcctgcaccgcctttccagctgcctccagtccacccatctttggtggcctgactcctcccaacttaaattttcctgaagaatgagaagagtcgtttgccttcagcgatgctgggctcatccccccgcccagcgctgtggcccctgcagagggcagcagccggctggctccgttctttcaggtgcgtgtccatcagctgccggtcaatgaccctgtgcatgtcatcctgcagaggggaggggacagtggccaggactgagtagctgctctcacctaaccctggggctggacagggaggtgggaacatcagacagatgagagatgagaatgtgatgagtgagaggctgcagccgggactgccctgaccaagaaagcggtgagcgtgggcaagacaccaggcgcacgcaggagccgtatggcacctccagcctcctcaggcttgggctgggttctcctcaacagtgttactcctgctgggccgccacagtcctcagctgatggctcgggtggtctctccctgcagtctccacactagcactccacctgctctgaccaggcctcacggctctgcctcctgtgtcctgtgggcctggctggtgcctccggtttggcttgccacccccagccccggcaggccctagggccacctcagcttaacagctccccagcccaatggcctggcctcaggggctcctcctgccttttcctttccaattattccagcctgagctactgatgcccaggcaccaacggcagcctcacgtggcaaggatgccctgggtgctgccctagaccctgctgctgaggctcccatctgcggcagaggccaggggcctcacggtcttcaggggctgtcctgcaccaaatcaggcccatttctttcagcttcctcactggggtaggaccgtcccccaactcgaattcgttcatgtggtccagaaaatgccttcctccccacagcccgccccaccatgttttacagaacagcagcctttcccatagagaagcctgtggacagggcagctccactcccttcccattttggtggctagattctgactctgggtaagactccatttgacaaaagttctgccactaacaaagtttgaaaactcctgctttagaaatatgagcagcctgtgtaattagcatcatcagtaaatgtaacatgtgtctgctcgattccttcatgacttgaacctggcaggctctgcggcatcctggtaagaccccaagcttttctggctaaacccctgagtgagtcagcctgtggtgtccgagcacaggacaggtgaggcctgtgttcagggcaggctccctgtggccagggcagatgacctctttggttccgagcagccactgacgagatgagggcatgaagttgggctggctgggcccctccatctgagcagcttgtccactcctcctccctcccacccatgggtgtcattctaatatctctgcaggtttcagcatgaaacaaaggggccttcctgagtcatcgtggggtagcagtgagtgtggacccctcacgcgctctggctcagggcctgctctccagcctccctattctctcaaccctgtctttcagactcagctcattcctggtcttctccttgcccttgtcttcttcccttctcttccatccccttttccacttgcccctcagagctggcactgtgccaggtatttgccaacacacggtccctccttataagggtctagtatatgatccttggcacagtgccctgcacttacgacgtgctcagtaaaatctacgctaaatccaatgtaggaatgctaaagggtctttcaaaaaccaacctttcaaagctgccaatgttttgtttggcacactgaaaacttcatttttttaactttaagcaatcaggtctgtccaggtcgccctttagagtttcccagacacacgctgctcatcattccaggcctgctggtccctcagtggatggaacagccatctatgagaagacggcaccagccgttagcactgggccacacactgctgaagagctcactggacgcgactgtgatggaggagggagctgggacttgagggcatgtcacactgcacagagatgacgccaggctccagcacacagaacacagtgggccatgaggggaggcggcggggcagcacagcaatggcagggcgagacggtggatgggatgtagggctcaggctcacctcaaaggcaggaggggtgtacaactaaagctgttgatac

SEQ ID NO: 10924 - DNA, 84 bp, Homo sapiens
taatcccagcactttgggaggctgaggcaggcggatcacttgaggtcaggagtttgagaccagcctgggcaacatggtgaaacc

SEQ ID NO: 10925 - DNA, 5780 bp, Homo sapiens
gccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgacggtgtgaccttgggcaagtctggcctgctgggccttagtttccctctctgcagcagggacttgggggtggtgaacttaatgagccgtatactcccacccagcgctcacttcctgaggctttgtgactttctgggagggatggggacgtggaaggggccttaaagcagtcccccctcgtcactgccccccacaggtcttaaccatgaacttctctggaggagggaggcaggaagcagcagggtccaggggtagaagggctcccagaccccgagaacaggtgcgcgcctcctccccaccccctcccaccagtccaggctccctgggagttgctggggggcggagctgaagggtcctactattcctggagaccactggcactcctttctctctgggctctctctgcagtgggtcattgagggttcaggatgggcagtagggcagggtcaccatggagactaggggccaccgctgggttctttcaggaccgagacgtgcagctgtccaaggctctgtcctatgccctgcgccatggggccttgaagctggggcttcccatgggagctggtaagtaggggccttggaggctggggcttgagcccagagagaaacgtgagcctgtctgcgactcctccctgatggctgcctccaccgctccctgaggaaggcacagagtgcacttcctccccatgcacagaggagagcaaggcctagagcccctgtcatgtccacagcagactgaggagagttcttgtctgggccaggcctggtgaccgccccctccagccaagcagccagatcagcacttaccccgagggcgagccctggagggtacggtgcagctggtggtgtgagtgtgcactccgggccagcgctatgctgggcactcacctccctgcccctccgtgaggcagatcctctttttatgtaagttgaaaaaactgcggcccagaaaggggagactttctaaaggtcccacagaggatgcccaagcgatctccaagcccagactttgtttcggttgcctgtggctccctgttaaccctggcccagtccagagcaaggttagctcctgagcaccctgcctgcccacagatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtcggggtgaggggacaagtgcgagacgagatgggagggacccctgcctgcgaagggggtctcactgctacccgttcaaccaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggtcagtgccctcccctccacctagctactcccacccactctgtcctcccaggtccccttcaaaggttacaacacttgtctggggccaccccatgtccggcatggagcagcacccctgcatcccccagcccaggaccccagtctgcctaggttgctgactgcactccaggtgcccaggcctcagctccagctgtctctgcaggcatgcggtcccattgtgaaatagctgtgttcatcgatggacccctggctctggcaggtgagtctggacaaagcaggagctgcccttgccttcggggagggcatgagtcacatctctggctctgtcagcagatggaatacccttcttccgctctgccaatggggtgattctgactccagggaatactgatggcttcctccttcccaagtacttcaaggaggccctgcagctacgccctacccgtgagaaccaccaccccagcccctattccttgttcctgaaagctgtgcccttctgccctcacctctctcctagcttccaaccctagactgacttaggtgtccctttctctaaccaactcttgtctttatcaggaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtagctacatctggtcttccttgtgtgctgggggactgcagataggtcaggggtatcagcctcagccactcagacaaggaaagggggcaccacatgagctcagggacccccacccccatccctggcctgggtgatggtacagcgtctggccctgccaggtccttggcctgcacaaagtcagtgacagcaggtgaaatgcccagctgggtgcctgcctggagcgggtgtggggcagtgagcccctgtgggtgtgggcttgggagtggctgtgacagggtggtgagcagggcaggggcaatcagacagccctcagaaggcctcatggcccccggtgagctgcaggaagaggtcttcatccagctcctccccacgggcccgctcccgcgtcgacaggaaaatgtagcccccgatatactcgtgtacaattcggcagctggcagacacgcagctgaaggccacattgatgtgttcatcaaactcgatggccacctgaagggcagacagaggggcaaatggtgggtgggataagggagcagcccctgccccaccctggctggatccagctccggcctgcacctgtcccccatccatataccctgggtctgggcccacctgccggatgtcccagttgacattccactggcgcatgttgctgaaacgccaggtcttgaccacgtcgcccacgggccaagtcgatgcggatcagtcggttgttgggcgatgcccaggatctcgtctttcctgctgcccttgaaccctggcccccagggagagagagtgagccagggctccaccctgcatggccagagcccgcccagacaatgtggcgccgtgctggagagccagcccttcccgactgcagctcaccagctgtgtaaccctgagcaagccatttgggttccctgggcctcaagttcctcatctggtaaatgggggttaattgataaaatccccacaacagcatttagcagcatcgggcaaacaggccaagcctttaaatggtaactttttttggtttttgttaccatcctcatcaactgctgtctccctcccttctttgcagtcttgggaaacaactaatcaaaggggcccactccccataacagcatccaccgctagccctgtcttgcggaccggcgaacccaggcccagacagtgaactgtccacagcagagctggagcaagaactggttcttctgctctcctgacctgaaatctcttttttttttttttttttttttgagacggagtgtcgctttgttgccaggctggagtacagtggctcgatctcggctcactgcaacctccgcctcccgggttcaagtgattctcctgtctcagcctcccgagtacatgggattacaggtacgtgccaccacttgtggctgatttttgtgtttttagtagagacggggtttcaccatgttggtcaggctggtctcgaactcctgacctcatgatctgcctgccttggcctcccaaagtgctgggattacaggcatgagccatcgcgcaggctcttttatttatttatttatttatttatttatttatttatttatttgagactgagtctcactcgttcgcacccaggctggagtgcagtggcacaatctcggctcactgcaacctccacctcccgagttcaagacattctcctgcctcagcctcccgagtagctgggattataggcgcctgccaccacactcggctaatttttgtatttttagtagatacagggtttcaccatgttggtcaggctggtctcacactcctgacctcaaataatctgcccgcctcggtctcccaaagtgcaaggattacagacgtgaaccaccgtgccccgcctatttgttttttgttttgttttgttttttggaggcagagtttcgctctgtcacccagcgtggagtgcagtggcatggtctcagttcactgcaacctctgcctcctgggttcaagggattctcctgcctcagtctcctgagtagctgggactacaggtgcgtgccaccacacctggctaatttttgtatttttagtagagacagggtttcactatgttggccaggctgctcttgaactcctgacctcgtgatctgcccgcctcggcctcccaaagtgctgagattacaggtgtgagccaccatgcttggcccagcctatttatttttgagacagagtctcgctttgtcacccaggctggagtgcagtagtgtgatcacggctcactgcagtcttgacctcccaggctcaagagatcctcccacctcagcctcctgagtagctggactacaggtgaccaccaccatgcccaggtaattttttacaattttttgtagagacgagggactttctgtgttgcccaggctggtctcaaactcctgggttcaagtgatcctcctatctctgcctcccaaagtgctgagattacaggcatgagccccagtacctggcgtgagctttgtctcttatgtttgttgtggagggacagcatgaggggcacacatggggccctcagtaaggcctgcttacaaagaacaagggaagggagtctttggggtgcctgtccagaacctactcttgggatgtgggcacacagcagccgggtggcaggtgagggcagagacggtgctgggcagggggctgggccaggggccatacctgaccatgacataggagatgccgaagtcgggcagggactgccaggcctggatgaagcgcagctgggcctctgccagcgacaactgggccacattctggtgggcttccaggatccgtggggtgagctgcgggaccatactggtgacgggctgccaggcactattcccctcctccagagtcaccgagcccccacctccccatcagggtgacagcatgtgagcctgggaaggggcagtgcccacgtggggccgccaaggtgcagatctgcactgcgccaggctgcaaggtggacatgggcacctggaccgtgactcctcccaaagggtgggtaccagccgcacaatctcagggacacagtgggagaagcccagtgagtacgtagctttcctgaggaaggctctgtggagacccaggggtcagaggtctctgggtaaacactatgctcattcccaccctgacgccttctggtacctgcttggccttgaactttcgctggaaacggggggcaacgaggccgtaggggttgaggccctcggcagaggcatcagggccgtgggggtggttgcccgggcccccactgcccgtgcgctgcaggctgaggaaggccaggatggcctgcacctcgctggtgtagctgctgtcggccatggtgcggcctttggaggccaggcggcagccagccatccagcgggcatactgctgctc

SEQ ID NO: 10926 - DNA, 8018 bp, Homo sapiens
cgagctctgcgaatcactttattgcgcgcgtttcggggagcgggccgtccagggaaggaagcaaagcgggaacgcactgcaggccccatccaggtgagcccctcaggggccggcgccccggggcacgatctcggggccttgggttggctcggatggtggcggctgccgctgccctagccgttgtcgctcctgctgaaggatgcctctgttggccctggaggagagggcacctgggtggttgggatagggatcccgaagtgtggttcctggacagggagcagggagcagaatagagcagggacagacctggcccgtgcccgggcttcgttgtagaaggctgtgatgatccgatccttttcatccatgaagttaaggtgcatctgcttcaccttcctgcaatgggtcacaattaaccctgggaatccaattcctgctgtccctgaagtcctgcccccttccaccccactctaggggcctcacagctttttacccttacacagggttaggaacctcagtctaacccttcctgtgatagatagggagggctcagagtggccctggcttgtctagggtccaatggcatccgaagtccctggtcactttgaggtgtgacagcagctgtggacatgggggtgctcctcccagaagactagaaagggtatgcgtctaactccatcactgaactaggcaggctgctagcagtgggcactggcctttaggtatctgctatagaaaatcggctttgtggccaggcgcggtagctctcacctgtaatcccagtactttgggaggctgaggcgggtggatcacctgaggtcaggagtttgagaccagcctggccaatatggtgaaaccccatctctactaaaaatacaaaacaactagccgggtgtggtggtggacgcctgtagtcccagctactcgggaggctgagacagaagaattgcttgaacctgggaggcacaagtggggttgcagtgagccgagattgcgccactgcactgcagcctgggcgacagagtgagactccatctcgcagaaaaaaaaaagaaaataagagaatagagagaatcagctccgtggcacgcgtgagagtggcagggagatgcctactgccaaatgaatgagctgtgctgcatttgctgcttgtgcttgattttgtttggctcaatcccttcctggcagccagcatgaaagatttacattcgaaatatgaaaaactgtaaatgacaacgttagctcttggtgcagcgctgcctttaataagtaaggagaggctccagagaccaacttcaagcagctcttagcttgagagacacaagagtacgggccacgaggtgctgtggaggactggctgaccacactggaattcacccaccctcctgccctctgcccatcaccccgggggagaacaggcatcacctgaaggcaatgtagtgcaggcccatgcccgccagcatgaggaggaggcagtaccccagcacttgtttgttttgtttgtgttgctgctgcctcaactggggcccctgtggcctcacgctgtgaaactgggaccagtactgtgcgttggggggtgtccaggagctgctgggaggcagaggaagggacattgtggaaatgagactacccaagagacctgggggtggggcaagctgagggcaggattactgtacctgtgtgtttggtgggcagacttgtcatggactgtggttcgtggagactttgggggactacctgagcggagctggtcatcatagctgcggcggctctgctcacggctgagcacacggtatgcctcgctcagctccacaaagcggctgtgcaggcttgggttcccagggtcccggtctgggtgcagctggggtggggcaggactccccttatctccctttgcctgtccctccccaggacccatgctgatgacatccacccaccagggctccagtcatacccagaggccctgcctggtcagtgaccctcactcaggcctgcccactcctcagaaggccagagagcatggactcctgcttcctcctgtgttcaagccctccccacctgccagccccctgcattcaccatatgccctggtccaggtttctcaagagcaggcaggcaggtcaagaaaaccaagccccagcccatcagacaggacccctggcctcctgcccacagcctttcccttaccattgagcacctgccactcccctatgagggctgaaaaaatgtggcacccgccagagatgctggtctactcctgggaatttgaagcacacccccactggctcaaagttccctgctccccttccccacttcaggggtacgggtacctctttggacttggagaagaaagctcgtttaacttcctcagtgctggcaccaggatgcacccccaacagttcataataagtactgggtctggacctgtggacagagtcccaaaccttgcaggggctgaaggaacccagaagctagctctgccctgccttctgggccacacccttcaactcagccaccaggagctgacagggctgaaacaggtcccaggacagatctgtctccagatcagcaccccctttggagtgtttcaggcatagtgcaggtcaggatttctcaaagtggagtccaaaaacttgttggaaaaaactgattcctggacaggcgcggtggctcacgcctgtaatccagcattttgggaggccgaggagggcggatcacctgaggtcgggagttcaagaccagcctgactaacatggagaaaccctgtctctcctaaaaatacaaaattagccgggcgtggtggtgcatgcccgtaatcccagctactcgggaggctgaggcaggagaatcgcttgaacccgggaggcggaggttgtggtgagccgagattgctccattgcactccagcctgggcaacgagcgaaactccatctcaaaaaaaaaaaaaaaaaaaggaaaaagagaaagaaactgattcctgacccccacccaattgattcctccagttcagaatctccagagcagagcccaggaatctggattttgtacccgacacctccccatctcccaccccccacagagggttatgcacagtgatacagcgatgcttggaaaccactagagctgtggtaagagcgttgggtttgacctggactcaaacttcctcctctgccgcttaaatcggtgtatgaccttgggggtcttctctatctctgatcctcagcagggaaggcgagggttacctgagacaaacctgggagcctcctgacacggagtagagaccacaactaactcagcacgtagggcaaacagaaacccattgaacaaccgggccggccccccgcgcccaactcaccgctgcccggcggccgctccgaggagccgggagggagggttgcggggccacagccggcacaggcgcaggggcagtaagggcggcatggcggcgggcgggcagctgggaaaggaggctaccaagagcgcattggaccaggatggggctagacttcaagcacccgggggcagagggaaggggcctggcccgttgttctgcaaaggaagactgaagcaggcccggagagggggcggttcttgcccaggaccagacccgcgtgtccttggacctgccccttcctctgacccgggcatccgcagcccttcccagcgctggcttcggggtctggccacccagccagggaccccaagaccccgttcccacccagggaacttggggacgggagaaggaggggccacaaccaggccccgcccccgctgctcacagacccgcggccgtcgccatttcctgcgtctattcaggccccgccctcacattctcattggcgtggatgccaagaccacgtccacctgtcaggaaaaaaaaaaaatcggtggagaccccgcccctacatgtctattggcctttggtgcctccggtcccccagcctgcggactcgctggacaggcgcgggcgcccacctggggagcgggcgggacagagcccgctctctgcggctttgtgacgttttcggcccggccaccgtgtctccgttccgctgttgctcccctctgcagcgaggtatatcttacggagctgcttccgccccggagcctctctggagccagcaaagaaagggaggcacagttcttatcccctgcttgcagagggggacacaggctgggcgggtttttttttttttttttcccaagtcacttgtcctgccttacacactcagggcccattgctcctctctgttacagaaatagcagatgccaacggaatccaagaataaagtcgtttattattttcagagcggcgggagtagggctggggaccctagggccgctccagtgggacttccctgaacccggttgtagaggatgatggcgcctttggccgaggggcagagttcagcccacatctccgtctcgggcaatctccgcacgttctgtggggagacaacgagacccaggcattcaagcttgccacttctcctgccagggctgtgcccagaattcctgagcctcagagacctctgcactgtccttagggaggcatgttaaggggctgaacatgtccctggacctttcccttgcactgagggcaaatcttgtgactctggagggaattgtgacccagccaacacctcccctacaagatatgcattgccaggcctctgcaggccccagccctggcctccaagcaagatggtttgtcactctgcacctgtgtctccacaaagaagattcctgtagactcgtgggcctcgggtcccccactcaggtagtgcttcctcacctgctcagaagtcaggctgcacctggacaagaacacaagggtggcttagtgggtgaccagcccctgcggggtacctgtggagccacagctgcctcagcccactcctcaccacccaccttcccaagacccaggatcatgtacccgagcctactcactggacatagaactcggcactggctcggccagcactggtctcatttcgggcgatgcccaacagcaggggctggctcagggtgagcagcggcaggttcacctgcggtggagggtggggtggggggaggtcccacctatcaatgccactgcccacatccctgcccgtctcaatgaaaaaccgcctgttacctgtgtacagcattttatagcttgtagatcaaggacccagcattacagaatgtcagatgatgggcatgtttgttttacaggtacaccaaaaccagagagattgaacacgttgcccaaggtcacccaagagaagtcaatttagtgactgggactcccacttactcctttttctttttttctttttttgagatggagtctcgctctgtcgcccaggctggagtacagtggcacgatctcagctcactgcaacctctgcctcccaggttaaagtgattctcctgcctcagcctcctgagtagctgggattacaggtgcacgccacaacgcctggctaattttttgtatttttagtagagatggggtttctccatgttggccaggctggtctcgaactcctgacctcaggtgatccgctggccttggcctcccaaagtgctgggattacaggtgtgagccaccacaccctgccacacttactcctttttcttttttttgagacggagtctcgctttgtcgcccaggctgaagtgcagtggcgcgatttcggctcactgcaacctccgcctcccgggttcacgccattctcctgcctcagcctcctgagtagctgggactacaggtgcccgccaccacgcccggctaacttttggtatttttagtaaagtcagggtttcaccgtgttagccaggatggtcttgatctcctgaccttgtgatctgcccacctcagcctcccaaagtgctgggattacaggcatgagccacggcgcccggccacttactcctttttcaacagacttggggagtaggcaagatatttatcattgtttccattgaaaagaagaatccttggcggggcaaggcatgagaatcacttgaacccaggaggcggagaatgcagtgagccgatatgccaccactgcaatagcctgggcaacagagcaagactctgtgtcaaaaagagaaaaggagaacagaagaagaatccggcctggtgcagtggctcacacctgtaatcccagcacttttggaggctgaggcaggcagatcacgaggtcaggagatcaagaccatcctggctaacaaggtgaaaccccatctctactaaaaatacaaaaaaaattagccaggcatggtggcggatgcctgtagtcccagctactcaggaggctgaggtaggagaatggcgtgaacccgggaggtggagcttgcagtgagcagagatcgtgccactgcattccagcctgggcaacagagcgagactctgtctaaaaaaaaaaaaagaaagaaaaaagaaaagaagaagaatccaaggcagagggtactgacggctagaattccactccaagtatgtatagctgcaaagccaacttcttccctcattgctggccagatgcctgcaggcctcctgccagcccagacctgtagaattctggcaagtcctaccccctcccttcatgtctaccaccctgtccaggtcaacctcactcacctcatcacagatctcctgaaggacactggaaaagagttcatgtaccaccagctgcccagcgaggtcctggtgctgggggctgccaccagggcacagggcctgtgagaggtcaggctcagcccctgctccccacctcttccccctgccccatctcaggaccagcaagcctatacctgctggccttgagggtctgatgtggcacagtgtaagagagttagtgatcctgagtctggtgtcctttccctgacagacaaccagaggtccagcttcaaaggagatacacagggggcaggggtggagtagggcatcttcttcctgtgcccaatctttcctcccgtgttttctagtttctcacaggactggggcaggggtcagtggggaggcaggtggactgccctgagcaaacttccagagaaataccaggccaattttccctttaagggatggggaaaccaaagctgggaggattgggagggtggagagctgcagctcccttgagctgtctgggtctttgtgcccagcctggaatctcacctgaggctcagggtgcccaccaggtacgtccaccagcccaggggcctcagccacctgccgggagcggcgcaggaagacaaggaagtcatcggctgtggctagtgcagcgcccacccccagtgggtccgccagataggcctgcgtgtcaccccagtcggtggcaccctgctgtcgcagccaggcagctgagctggaccagttggtgcccaggaagtctcggtaggaagtaaggcccaggcgcaggagcagctgtggcccccgagagccaataggcgccagggtggctgagtgcaggcggaacttgggggcgtcgaagagccagggttgggcctttagccgggtctcccagatggcagtgatggcctcgtccccacctggcagtgggcgacggtcatgggcggggctcagctcggcctgtatctgctcctggggcaggcccccgccagggcactgcagcagcaaggtcacctcaggatccatggtctgaacggggcagctctgggggaggatacggccaggcctgtcatccaggggggccactaccactcctgggctgcgcagctagccccctctgtcgcagacctcctgagggtatccgcagcgcttctccacccccctgaccactccttgggcagtaaaacgtgccatcttccccgcaggagccccgagtcccgcagggtatccaggacgcccgggcatccctaccatccagaggtcttgggttcaggcgccccaaatgcccatgtcccccaaacccaggggtctgcctccgacccggggcgcgcggggacccctttccagggcccggaagctccagcctccagcgggcgctcaccagccgccgggtccctcaggctcc

SEQ ID NO: 10927 - DNA, 1308 bp, Homo sapiens
gctcccacttataagggagaacatatgatatttggttgtccattactgagttacttcacttagaataatggtctccagctccatccaggttgctgcaaatgccattatttcattccttttatggctgagtaatattccatggtagaatgttacttttgtttatctacttgttggttgatgggcatttaggttggttccatattttcgcaattgcaaattgtgctgctataaacatgcatgtgcaagtgtccttttcaaataatgacttctttttattaacaccctgtagttaataacctgaattctttatagcttgcattctgaaacatttttctcgaactatccgccttctggcctgttccagtcattctggctttcatcttgatttgtttttcttaaaactttctccagcttccctctgcatctgtgattcgtgctctgcttcttgtttgtggctttggatcaataatgctacagatccagtctaattaatcatggatcaaaagctaaagcatccttcccccagatggtttattattaataccacccagaaaaataatttataatttaattctctacctcatagagtttgggatccttggtagaatgtgttcccttccccttttcttcttcgctatttcctcctcttcctctccatcaaaagtggctttatctccacctttgcagctgacagcaaccctcccatgctccgttgatgaagccctcctttcttaacccctcgtccatatggctctccctccaccctgctccatctcctgtgatctcaaggcctcggagaaatgatctcaaggcctcggagaaatgaaaagtgacctttggtatttgagacaaccaatagcaaaatatagctcccacttccaacagcccatattggtgggggagggatttgcttcatacgtggtctgtgttgggccattctccttctccatgttttctctgttcttacagcaccatctttttgcctcatttctttgctctactctattcctcccccatcatcgtctggtgactcacactgtaatcctagcactttcggaggatcacctaaagtcaggagtttgaggccagcctggccaacatggcaaaaccccgtctctactaaaaatacaaaaattagctgggcgtggtaatgggcgcctgtaatcccagctactcaggaggttggggtgggagaatcacgtgaacctgggaccgggaggctgcagtgagccaagatggtgccactgcactccagcctgggcaacagagcgagactccgtctcaaaaaacaaaacaaaaccaaaaaaa

SEQ ID NO: 10928 - DNA, 1308 bp, Homo sapiens; identical to SEQ ID NO: 10927

SEQ ID NO: 10929 - DNA, 39062 bp, Homo sapiens
ccaagatatagtattagatctggtcacatattcagagctctggctttagccttctttgggccatctcattggctgacccactgagctgcagggaagacccagcaggcactgggaggggctgtgggcacagcagcacgactcccacacaccaggggtggtgggccacagcctgtgtccagactgactcacttacagtggcaaaactaaaacgtggtccttactagagagtagaaatcatgagtctgaagcagggactccagattgggaatataagttgtctgttttgctcttgtaaagacggatatatctgtgacatgctaaccccagagaccactgcctttgtgtccacctttgctctctaggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagaaagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtaactccagcaggctgggaagtagagggaactgggttcaaatcccactttcctggcctgacacctgtgatgttgttagccactactattgtctgctttacacacagtatctttttttccacaaagtactagaagtattattaattctatacaaacggtttcccacctgtccttcttccaaggatggtcactggcttagcaccactgagctcactgggacaggtggccagtggttgtctttgcagctatcgtgatcctttggggaagcctaagggatgtggtggagattggggagggaatagggagtttaattttctgtcaactgcagagaaggtccgtggctggcagcagatgccttgcttcagaggtggtggattacactcgccgtgtggcctctctcctgccgatcagagcagcgtgaggtggttgggaaacaacacctctttcttaacactccatcaggttgattatttggtctgtaatgactgaaagcagtaattagaaatttcttctgttcttccgcactgtcgtgggcaccactctgtgcagatatgtcagattcctaaagccaggcttttggcaagagcccttcctgaaacattttctttggtcagtattttgacacagactgcctggtggatgtccaatatgaggtacaaaaacaaactcataactagccatggatagtttttttttcttccagccttccactttaaaaaactcccttttctcccacctgtgatccacttacttgagggttggtgacatggaccaccctgaatctattttatttacctgtatcattggagtgcttgtaccaattataatgaaagaaaaaagtacatttttagctgtgcattttaatgggccacatgttgttttaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatgtaagtgatcccagtgtggagcctctggctgctgacagtgtgtcagtcaaggtcttggctgacaacaggtgtttagactgaagagagactagttaaggggttgtttatggagatgtgggcagggttatgggaaccagctagggctagtgaggcacctggggcctagcagcagctggaagctagaaagcacacctgggcctgacagagtaaggggagggtgcgtgacatcagagccctggagaacctaagccaggacgaggggcggcctggctgcaggagcagtgaggagggggtgacttcctgccatccctcctcccattctctggtctctttctggtgcctctcattggctgagcccggctgaaagccagagagcaggggcacagctgatgcagacacacagccttgtggtgcatagaggtcagcctcctggggcccagaacagaacacagaagggcaaggagctgctctgggggtggtgggttagcagataggctgggcaaatggaataaacagcacagatggtgacaattatatgccgtcacggtgaggaccgaagaggtgtcacatgtggtttgttttttatctgatgcttaaacaagttcctaaaagtaatttattttaactgatttgtcattaagttcactttgatggctgcatgaggatgactgtataaagattaataagtctcactgaaaaaattgcctcgtggctgctattaagtgcttttctgctatctgcagggcaacaggaactaagcagttaaggaaactgtcaatctgatgggcctgtttttaactgagctgttattgggcagatgtgcaaaaatagacattttgtattagaaacattttgtatcttgtgcaatagggaaagtcctcatcgcattaagaaaatcagaatttggcctgttacctacctccttggccaacaagtatttttttttttgaggtggaacaaaaggcattgcatgttatctttggccttgagcatctcctctgtgaagactaaacatcaggcacaggctaaacaggctaagtatatttatgtgaagtgggaaaaaaactcagtagtgaagcagatgtcaacataacctccctcaatggggagggctaagagatgaggatagggccatcagaagctggggaaagccagcccagtgtacacgtgtgtggccaaacgttcctaaccccacccctgctttgtggtcacatgccacccctcaccaggatactcctgggatgaaactatgaagttgcttttgtccctataatatcataattatttaatatcataatttctctttatagttatgaacaccatatagtcatttatcatttcatgagtccatgcatcaatgacccctgtaagaaaaatgccctcattgtataatgctaagttgtccaaaacgatgtctgatgctttggcaatttcacaggctgtatttatgtgtgtttagtaactgcctataacattaaggcaccttttctgtccgctcctattgtttatattcacacatgccaaactgtgagttgtttttttttttctgctctgctatcattttgatttctaacaatattggtgttggttattggaccttccttccatgaagcccagtgagctgcttctgacagaggtaccaagagactacaggggaactaatgggattgtcctcagtgacatcagttttaccagctggggactttgtttgaatgccctggatttactcactgaccactctggaaatgcaatctattgattgataaccctccttgaacttatctgtaaaaccattcatgaaatattttatgtttccataggctggcaagttctcatttttgtgtgttagattttcatggtgaccctctggctctataattcttttatttgaaaaaacacaaccatgtttactctgtcattactcttcaagctttttcgtatttcattttcccttccttttagaaggagtgttttcacactgtagcttttctcatttctttatgcaatcaccctgagagatcgaaagttattaagcataataacctatattgtgtcaaattgtgggtacatccaaagtgcagccatgcgtgggtgttaataggaaattccaaagggttcataaaaatatcttcagaagtttaatacattcagaatatatccaattagcattagtggatttctaatttcacttgacacattcatcataatgaattttgcttttgaagtagtgttctgtttaaactggcgctctggtctatggtagtgttttttttttttttttttaaaaacaggcttactttcaacatccatttacaaacatttgttgaaaaatattttaggagtatttgtttaaacattattccgaatttactgctccataaagcctagtgaatatttaaattcttgaatatgttgccagaaaaagaagcagagatccaaaaacaagtatatgaccagagttagagctgaaataatagcttgttgaagaagagaaaattgtaataaattgctttatcaaacttgctttcaaaacctgttttttaagttgggcacagtggctcacgcctgtaatcccagcactttgagaggccaaggtgggtagatcacgtgagctcaggagttcaagaccagcttgggcaacatagcaagacttcatctcaaaaataaaatagcgttaaaaaaaaaaaaagaaaaaacacacctattttttgaacattaatttcagtgctcatgctagatttcagcaggctttggtactcataattctttttagagaaggatttttaactgtttaaaagcaattgattccagttattgatctcttttctagacctgtgcacaatttggatttaataatctgtcttatgtaaattaaatgtggtggttttttttgttttgtttttgtttttgtttttgttttttttgaggtgggatcttcctgtattgcccaggctggacttgaactgggctcatgtgatcctgcctcattctcccaagtagacaggattataggcacaggccactgtacctggctctaaatgtacacttttataactgctagtttggagtttttctctcattgagagattgctttgtaatgcttccaatgttaagaatttttttgtacttttcttatcctagtctcttatgaaagaaagatatagtaactacttcatcaattttcatttttattactgactttcacatatcaagattcagaagttctttaaatatttaaacacgtattcttgtttagtccatatactacctcttttctgtcatttgaactctctctgcctcctaatatataggttatacagctgccttaaattagtgtaaagtaatacggattcagtttttttcttgccacatcttgtgcattctatcctctgtgttccttttgactttaaatggaaagagagcaggcgtatgcgccagcagcattatatgcctgtgactcctgagtagccttttccctctcctttttcctcttgtgtctggcctgtgaatacagctgactgtatacagggttactgttggggttattgtggggcagtgtaaggtgatgaagatctcactgacttagtgttgatggcttgagtttgagtcctggtattacctctcgtttgttgataatcttaggtaaataaactggcattgctaagccccagaaaaatgtatttagtggaacagatgaaatatgattcagtggttaggaagttaacttctgaagacagacaaacctaagtttgaatcatggttcaccccttagtggctttgtggccttgggcaagtttctttaattttcttatctatactgtgaacagtacttacatcataggtttggtctgaagattctgtgagataatgcatatcaagtggttagcactttgccaggcacattgttaagtgcccaataaatgtgggccaaatgtgatagctcacccctgtaatgccagagctttgggaggatcctttgagatcaccctgggcaatatagcaaaatcccatctctagcaaaaaaaaaaaaaaaaaaaaaaatagctaggcatggtggcacatgcctgtagtcccagctactcaggagactgaggcagaaggcttgcttaagccagatgttcaatgcttcagtgagctgtgatcattgccactgcactccagcctgggtaacagagcaagacctcatctcagtaaataataataataatatatgtaaaagtgctttgtaaatgatacagcaatatatcatgtttttaatatgggagagcagaatgacaaccattattttcgtaaaaatgaaaattactgtcagagataagaaagctgtatatgggccaggcacggtggctcatgcctgtgatcccagcactttgggaggccgaggtgggctgattgcctgagctcaggagtttgcgaccagcctggggaacacagtgaaaccccgtctctactaaaatacaaaaaaaaaaaaagttgccaggtgtggcagcgggtgcctgtagtcccagctacttgggaggctgaggcaggagaattgcttgaactcgggaggcagagaggttgcagtgcgctgagatcatgccactgcactccagcctgagcaatagagcgagactgtctcaaaaaaaaaaaaaaaagaaaagaaagagaaaagaaagctatatgcgtatgtacttaaagttctcctaactagtcaatggccttgtcaatcccaggggactactgttgggaatgattgaacagaacctgtacacacattcattgagtgctaaaagcattcacttttgctttgcccaggagcagactggacagctctaactctgcagggcagggtcatcaagaccaaaattaacactacgttttgatgttttttaaaaaacaactatgctccagggcttcaagcattttacagaataatttataagatgaagtaaccattggatacagcagcctcttccatttaattttaagcgtagcaacagattgactccagaaatatcatgcaggaatcagtagcacagataaagagctttgctaaaagcctggctgtgatatatatatatatatatatatatatatatatatatatatatatatatatatgctcatgaatacctaattagtccatgcagtgcaatcaacctgtaggactataaaagaacagcaagtcccttcaaatggtaaatcattacttaagtaacacagataacattaaatacctcaggtcagcaacaaccttaaaatcaataggatacaaagaaaacatctatgtaggacaaatccactattttggaacatctctcgttgttttcttttccccatgtttggataataaacatggcagtgcctcaggcctctagcactgtcttctatagccacagccctcaatacaacactacctatgtccactggcctatggagcacttttaaaactacatattttgacctatacatgggttttgattaccagtttttttaatgatatagaactaaaatcatcacacattaggcttcttattgattagtgaaacctttgtattatgtgtgtgtgtatttatacacatgtgcacacatgtcacacttgtatgcatatggcatgtcatgccaggttatgtcatataagcgtgtatgccaggtcatgatgttaaaatgtatttcttatcatggattgtggttaaaaaaaatactgatctctgggtatccccaactccaatctgaaatcattgtgattctctcgccttctcaatgtgactagtctttttaaagttccttttgatcttcccaaatggcatccctgtgtccactttacccacttccaccgccttgtgcagtgctgcaagaggactttctaaagcatgagacaatcatttactcttttgcttgaatagcttcctattttctaagagactaaactgtaaactccatagctggaattgccccttttatgtccttcaaatatacacacatacccctgtatctcctcttatgccccagtaacactgtttgccattctttaaatagtccacctttcctcacacctctctgcctatcagattatgctttctttgcctaggacactattgaacaaacttttttacatttttgaagacccatttcatatgttgcctcttcttcaaaatcattccaggccccatatccctgttctgttccagatgtgttcctctactagggcttcaggtgccttgaagcagaaagcagggactttattttccttatattcccagcaccttgcctggtgcctggcacatagaaagtgctcactaacgttagttgactcttccccataaaactggggttagagtcatgtgtgtctattactttagtgtggccctttcttctgaagtaaagagagatgggagatgatctttctttaaagaaacttaaaggggaagagtaagatgtttagacatgcctgcagctctgtgtgttcattgtcgttacctaaaggaaaataaaagcttattataggtctcttgggcttcatgtctcttgcatcgtgtcagagttagacacatgtctaattttgatgtttttcccaaaatgttttactacctacaagatatttgaacatctgtgccattctctgcaaaaaagctaccaaccctctctcattttattttggagttccatatctcatcatgtaacttgattctgataccctttctgaccttgagcacctcttctcaacttccgactgaattttactcagcaagtggccagcctgaaagtgcagccattccagaagttatgtacggtatcttcaaggccacggattgaatttgggccctaatcaggtgagcacaggcacagatacacagaagatcagacattttcccggaacccctccagaccatcttgccacactttgaaccctttcttctttccctctacccctaagtcttcatactgtcttcatgtatacctaccaggatcccttagcaatgtcccaaggtccaaaatgattaattttcctcttcctcttgtttaccttagtacaactcttaagcctttagtgactgacattaaacctgtttccaagagaaaaatttctgataagcaaatgcttttagagttatgataaggccatatgtgattgttaccccttctggtattttcatgtgttaaaaatatgtttgatgcactagaaatctccagtggtggcacttcaggtggtcgagataactcgtgtcacctgatggggcagagatgcttttgggttagagtggggagagtcacacctgagagatttatcagttgaaaaatacttatcaggtatcttttatgtgcttggtactgtgtttatagcagtagtcaaaatctgaagtagaattagcaggggcgtggtggctgtgtgcccagggtcccagctactcaggaggctgaggtgggagaatgatttgagctctggaggtcgaagctgcagtaagctatgatggagccactgcactccagcctgggtgaaagagtgagaccccgtctcctcccccaccccccctcacccaccgaccagccaaaaaaaagatctgaggtaggaggattccagcaacatgtactaaactggtgtggatggcatgcctcccctctaaaactatatagtgatggataaaatatcaccatcctcactgctgccccattgttataattcctgtcatgaaaaaaaatggaaatccttttgtgccagagataaatggaaatctaaaccaaagcagtaagcatgagctggtcctccaggatttcagtcttgatacaggtcctaggaattgggtgctgagttctcagattcacccgaggatgaaagactgtggtcttgtgtgcatgtaaggcttgagacctggaatcaagccccttacctaaagtctggagcttcaaagaactattcttccatgaaaaggagactagaaatcaccagacataagcagtgaagcagcaaagaaacaggctggaaacaggttagggaaaataaagtcacccatgagaaatcaaaaccccctgtctgtgctatttgtgggtttcaggtccagatttattctacccgagtgatttgcgaatccctacccaagaaataaacataaaaccagaagcatagaaacctttaggactctggcagaaggaagcacactactttagacacttctacaaccacaagcttatgagacgcatataggaaaatgaaacatagctccagtaagataggcccacgttcagaaattacaaacatatgtgggaaaccaggaaatcatcatgagtggagggcaagcgcatacaagcaggagaatcagcactcctccagttggcaataactattaaagtagccatgtttaaagtgtttacggtgataaaaagaaggaattggaaccttaaaaaaaagagaggataatgtgataaatgatcatttagattcatgtaagaactaaaaacaacttctaaaattgaaaaatagtccctgaaattaaaactccaggtataggttaaagaacagagcagattaaatacagctaaagataattagaatttgaaatggaggctacttaagaaattatgtttttgagctctgagacaaaaagacatgaaaaatatcaaagagcaagtaaaagatgtggtggccagagtgaagagactttatagcatatgcagaaagagaatagagaaaatgagggaaagtaatattcaaagaaagaatggctggcatttttcaggttaagtaagcacactgactcccaagtagggagaatattaacaaattcacacttaacaactggacatcaaagataaagaaaactcttagaagtagctagagagaagaagacatggcatctgtcctcagggagtttgcgatctaacaggaaatagaaataagtcagcagtgaaaatagtgtggtcaagtgtgtggcagcaggaggccagggtgctgagaacgtgcgcacaaggcggctgtggtgaggactcagctagggtcagtagcagagtgaggatgagaagcagggaagagtgcagggcatagtatggctttttcagggaactgaagcccctttcgctgatgaccccttcagcatatctcagagctggctttgccaccaacaggaggtctgtctgtcccctctttcagtaaaactgctgtcaggaatgtctactcaacatgggatctaattaaagagcttctgcatggcaaaagaaactaccatcagagtgaacaggcaacctacagaatgggagaaaatttttgcaatctacccatctgacaaagggctaatatccaaatctacaaagaacttaaacagatttacaagaaaaaagctaacaaccccatcaaaaagtgggcaaaggatatgaacagacacttcacaaaagaagacatttatgcagccaacagacacatgaaaaaatgctcaccatcactggccatcagagaaatgcaaatcaaaactacagtgagataccatctcacaccagttagaatggcaataattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgacccagccatcgcattactgggcatatacccaaaggattataaatcatgctgctataaagacacatgcacacgtatgtttattgtggcactattcacaatagcaaagacttggaaccaacccaaatgcccatcaataatagactggattaagaaaatgtggcacatatacactacggaatacaatgcagccataaaaaatgatgagttcatgtcctttgtagggacatggatgaagctggaaaccatcattctcagcaaactatcgcaaggacagaaaaccaaacaccgcatgctcactcataggtgggaattgaacaatgagaacacatggacacaggagggggagcatcacacactgggacctgtggtggagtggggggagtggggagggatagcattaggagatatacctaatgtaaatgacgagttaatgggtgcagcacaccgacatggcacatgtatacatatgtaacaaacctgcacgttgtgcacatgtaccttagaacttaaagtataataataataaaaaaaattctagctgactttatatattggaggagatggtttaagaataatgagtgataaccagatttcttttctctggatggatttgagactgaaggggttttttggtttgtttttatttttttaaaaactggtctacaattcacacacctctgcagtccttttagtggctctcagtcatcctagtggggtgtgttggccaaggacgaccttgtatggtctgaatcttcagttccaaggctatggaggatgcagttatataggtgggtcttctcctctaaggaggcagaggaataccaaaggggatctgaggacctttaagagtagtgctgagaaggtgactgtcatcacattcatcatgggctctttgcatgactgactaaaggcctttcttacagctacataaaagctaatattaagtcatggtgctgtaacataaggagaattattgtggaaaggtattttgtcatgtagcatcctcttattaaagtacagtttaataaatgtattaaacttaccagaattatataaaatgaataacacatgggagttcaaatgaagccaaagactctccctctccctctccgtctccctccacggtctccctctccctctctttccacggtctccctctccctctctttccacggtctccctctccctctctttccacgttctccctctccctctctttccacggtctccctccctctctctttccaccgtctcgtctccctctccctctctttccacggtctccctctccctctctttccacggtctccctctccctctctctctctttccacggtctccctctccctctctttccacggtctccctctccctctctttccacggtctccctctccctctctttccacggtctccctctgatgctgagccgaagctggactgtactgctgccatctccgctcactgcaagctccctgcctgattctcctgcctcagcctgccaagtgcctgtgattgcaggcgcgtgccgccacgcctgactggttttcgtatttttttggtggagacggggtttcactgtgttggccgggctggtctccagctcctaaccgcgagtgatctgccagcctcggcctcctgaggtgctgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcctggccgccaccccgtctgggaagtgaggagcgtctctgcctggccgcccatcgtctgggatgtgaggagcccctctgcctggctgcccagtctgggaagtgaggagcgcctcttcccggccgccatccagtctaggaagtgaggagtgtctctgcccagtctctgcccggccgcccattgtctgagatgtggggagtgcctctgccccaccgcaaccctgtctgggaggtgaggagcgtctctgcctggccgccccgtctgagaaatgaggagcccctctgcccggcagccgccccatctgagaagtgaggagcccctccgcccagcagccgccccgtctgagaagtgaggagcccctccgcccggcagccgccccgtctgagaagtgaggagcccctccgcctggcagccaccccgtctgggaagtgaggagcgtctccgcccggcagctgccccatctgggagggaggtgaggggcagcccccgtccggccagccgccccgtccgggagggaggtggggggcgcctccgcccggccaccaccccgtccgggaggtggggggtgcctctgcctggccgccccttctggggagtgaggagcccctctgcctggccgccaccccgtctgggaggtgtacccaacagctcattgagaacgggccatgatgacgatggcggttttgtcgaatagaaaagggggaaatgcggagaaaagatagagaaatcagattgttgctgtggctgtgtagaaagaagtagatataggagactccattttgttctgtactaagaaaaattcttctgccttgggatgctgttgatctatgaccttacccccaaccgggtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaatactgcggaaggccgcagggtcttctgcctaggaaaaccagagacctttgttcacttgtttatctgctgaccttccctccactattgtcctatgaccctgccaaatccccctctgtgagaaacacccaagaatgatcaattaaaaaaaaaaaagcaaagaaaaatttatatattactcatttattaataaatcagaaactacaagaagctatcacccaaaaaaaataaaataaataaataaaatcaagctaacacacacacaaaaaaaatgaagccaaagaatcatgtgttttattatccagaatatctcagagaaaaacatagagagaagtgcttccaattacctgaatcataagttgcctgttccctttgtgtgtgtgtgtgttttttgttttttttgtttttttgagacggagtctggctctgtcgtccaggctggagtgcagtggcgcagtctcggctcactgcaagctccgcctcctgggttcacgccattctcctgcctcagcctcccgagtagctgggactacaggcgcccgccactatgcccggctaattttttgtatttttagtagagacggggtttcaccgtgttagccaggatggtctcgatctcctgaccttgtgatccgcccacctcagcctcccaaaagcctgggattacaggcgtgagccaccgcgcccagcctccctttgtgttttaaagaggcttcccagtggcttatccctgatagttaaacccacactgttataactattgtgcagattttagatctggttatgaatacagaagtcttcacactcctgctctctgtaatacacatgtgggctgagacatctctgaagattgataaagggtcagtgtcaagcagcataaagatggggaacttgtagcaacatgcatgatagaagtggctgtgttttctcctaatgacaataaattcagaccatcattcacacttcttgcactcttgtcttctaagggatttccttggattttatagtagagggcttgggagactcattgggctaaaagtcggaaacacttgtgagttcctagactttatttcttacatgccaagatacttaataagctcttttttttttttttttttgtcctgagtgttcctatctgtagagcagtactgtgttcctgccccccttcaggagaaatggcatgatgaattaataagtagttatgggaagcatatatgcaagaacggcatttcctcactcttcattgggttaaaaatagataatcacgtgaaatactagtcatttaaatgtggtacatagaaaagaaatatattaattatggtgcattggaggtataatattgccagaaaataagaaatgcacagatgacttaataggaactgggttgcatccaaaaataaactgttcaccacagctagaatgtattagatattttgcacatgcccagcactgtgttatgttcctttcaaaggctgcagaagaaaaagaaatgtgatttatctccttgagttacttataaaatcactgagtagacaaacatgtgaaatcaagaacaagttaagacagtgtgtgatgaagtgccaaaatgaatggtgtggacagcaagtattctcagaggtcaaaggaagagcagtgcagtgcatgtgggaaggtttccagggcgagggatggactcacgccaggtccttgagggattgtggacttgagatggggtggcagggaaggcattctgggcacaacctgaggtaagagcaggaatctttttggcctggagaaggaggctgtactagtcccactttcacacaactgtaaagtactgcccaagactgggtaatttataaaggaaagaggtttaattgactcacagttctgcagggctggggaggcctcaggaaacttacaatcatggcggaaggtgaaggagaagcaagtaccttcttcacaaggcaacaggagagagagcaagcgtatgcgaggaagtaccacactttaaaaccgtcagctctcggccagccacagaggctcatgtctgtaatcccagcactttgggaggccgaggcaggcggatcacttgaggccaggagtttgcgaccagcctggccaacatggcaaaaccctacctctgctaaaaaaaaaaaaaaaaaaaatacaaaaattagctgggcatggtggtgtgtgcctgtaggcccagctactcgggaggctgaggcacgagaatcacttgagcctgggaagcagaggttgcagtgagccgagattgtgccactgcactccagcctgggcaacagagtgagattctgtctcaaaaaaaataaaaaaatcagctctcgtgagaactcactatcacgagaatagcatgggggaaattgccccatgatccaaactcctcctacctgtccccttcctcgacatgggattataattggagatgagatttgggtggggacacagagccaaaccatatcaggggtcttattgggaactgaatatgtacagattgggtgggcccaggctgtgaagagctgtaagtgtggaagaaagaacagttttaacttaatggtttgggtgatgtgtgctagcgtagattttagagttggtgaaggaaatgatcatgtggtattttaagaagtttgaggttttaggtaaagtacataaactagggcagtgttgtccacagttgcactatttgtgagctcctgagtctgaggtttcaggggacatggtcaatacagagagagggtggttcaggacagcaggacgaacatttgagcacctaatgtgttgggttctatgctacacgtttcaacacatttttctcacagaaaacttgtgctttaaatggcatttaagcctcacagaagctctgaactaagtactatcccattttacagacatagcaactgaggcccagattgagttgctgaggttccacagctggtaagtgacggtggttgtattcaagcccaatctgacttcagagcccttgctgtcatcttattgttgccctttgttgaattatcagaaccacagctcttgcgattctctaaaccttgtagacaatttcttgttcgtggaagtttaagttaagcagaagtcatgtgtatatgaatcaaggcagcatattttgtgtgtgcggcaatctgacctaaaaccttgaaattggaatgtcctaggcatttaacactcccaggaaatggacccatccttagaggctacaaattaaccaggctgatcctgttgattcaacaagctgtaatagcaaagaaaactcaataatcttctaaagatttataaaacaaggtatttcatttgttactctatcttgaaaaatcttcacaggaaagtagtttgggtaaacaagatattgacaaggtagaaatgaataaatgattgtttctaacttctcatatgagtgcagcaaggggaaaatgataatggcatatggcctctacctcctttctttctggagactggctgtccaccttaacaattgtctgcagctccttactcacctcccatgttcttctatccgcaagtccctgtcagaagtttccgagttacccaattaagtttctgtgggaggcatgtaacctgctgttagtggtctggagagggtggcaggaaggtgccgggctggcagctctgcattgataccctggctgccgttggacactcagtgtggtgtgggcactcaggagggtggcgatagggcagtgcttttctcagctgatggaggaagtacaaacatatcgcagatccattctaataggagaatttgataaattatttggacaggaaacgtatttcaaaattgattctccttagcttgagagaaaagagggtaattgatgtcagcatccataaggtttgtaaagtttctcaaacaggcatcttaagtggaatgactatatttaatattagtgtttctctcagattttcatttggaactctgaaatgaggacctgattaatctgagacaataatggtttgcaggagaacttttaaaaaaggtaactatacaacgtaggctttttggtttgtttttctagagatatttagtcaaggtaacaaaaccctttgggaaaaaagatgttagcattaagaagagaaattttaccaagtaatcttactaaactgacaggtatccatagcatatctcccttttccttaaggtgtatgggaggccaaagtgaggctcaccatggttcagttgtcagcgttggggtacaggcatgccccaccttcctattccttttctttagttcccatgcccaaactccaagtcctaagaagagcagatagtggattaggcttttcataggtgtttaaatcagtcaatcttaggttcgtattttttagaatacttaatttcttaaaagtattgctacatgtatgttactgcaaataagtgtatgtatgaaacctgctatgcatgtgaacttgataaaattgtgaacttaaaaaacttacttgacagatttcactatttactaacttctactattaaggtatggctagtaagaaatagtattataaagaagcatacatataattcagtgtttgtttattgtggttctatagatgcctaaaaaatagtcttcccagccaggcacggtggctcacgcctgtaatcccagcactttgggaggccgaggtgggtggatcacttgaggtcaagaattcgagaccagcctggccaacatggtgaaaccccgtctctactaaaaatacaaaaaattagctgggtgtggtggtgggtgcctgtaatcccagctacccggagggtgaggcaggagaattgcttgagctcaggaggcggaggttgtagagagccgagaatgcactactgcactccagcctgggtgacaaagtgagactctgtctcaaaaaaaaaaaaaaaaaaaaaaaacccaagaggaatgttaaattgaattccagggcatagtgtgcaggtatgtatttctgtgacaaatccaaacatagttttctagatcttagagttctttaaattctgaaaacttagagattgactgataagccagatcataatatgtttacactgcccagtctctaatggggttgagtttcctttggaaagatgatcagaaatctccagtcaccagaactttagcttcaactctctgaccctgtgcaagttcaggcctgatcagggatggccagcagtggccccggtggcccttgaattgtaactaaaagtagttgatgatatttttatctctttccagcattcatttcttttcttgaatatttagacttccctctagtttgttcttcctttaaaaggtgtttattctttagtaaataagtaagtagctactaagtgatatagttagatggaggcaattggattgattcagggaattgtgtgttatgtatttagtagcctgagaatatgtaattcttggagttttttctcttttgaaaaggttctgctggttcttttctgttcctggggcctgcatgcataaaagtcagcgatccatgctgtaaggaacacaagatgctcatcgactcttgtcatttgcttgtgcttaatctgtctcattttcattcagcaagtaacatttttcaaatgccagctcctgtgctagaggctaaggatgcagagagaagattcagccccactttcaaggaatggactcccgcaaattcttgtcagtttgtctcaatctgtgtactcattgttctttcgtctttactcaggtctctacctcagattctgcctctttgctccagtgatttaaaaatgacttgtgagcctataatcccaacattttcagaggtcaaggcaggcagatcacttgaggccaggagttagagacaagcctggccaacacagcaaaaccctgtctctaacaaaagtacaaaaattaggtgggtgtgatggtgcacacctgtattccagctacccaggagacatgagaatcgcttgaacgcaggagccatgtgttgcagtgagctgagattgcaccacatcactcctgggcaacagaacaagactgtctcaaaaaaaaaaaaaaaaagtaagaaactttggaggccaaatgtagtggctcacacctataatcccagttctttgggaggcagaggtgggaggagcacttggggccaggagtttgagaccagcctgggcaacatagcaagaccccatctctacaaaaacgttttttttaattagccaggtgtggtggcacatgtctgtagtccagctacttgggaggctgaggcaggaggatcacttgagctcaggagcttgaggttactatgaactgtgatcagacttctgcactccagcctgggcaaaagcaagaccctgtctctaaaaaataaataaatacaaagacttgtgctgatttttcatgttagtatttttagttttacatttctcttgcatgcttacttttaaaataattgagccaacctctctgtccctttttgttattgcatgtaaatctacagccttctgatataacctaagcttgcagaatcttccatccatcaccttcctagtatgcctcttggcccttattccagcagttagttgcttaaaacaaagcactttgtgttggtagtggtactatataacttatagtctatgcactgttggggattgacacactcttcccttccctaccactgcagtgggaagatcatttagaagactaagttcgatttgaacctagggtccaaattacctattgcaaatcaatcctcctcctccccttgccctttgcaaaagctagaattcactgtgaaaggtgacaggcatacgttcaactcattgtctctatgttgacatatggtcagtatgagagaaaggtctctaatatagatctgtcccgtggcatgaccagcatgttgtggatttctgacaaatgcaaagcagtgaaggagtttgagctcaaaatacaaatatttgaagtgttcaaatttcctttttttttttttccataaggaccagactcattgatggcaagtcgtcatcatcttgatataaatttataacacaggatgaacaagaccttggaggagcttgtaaagagaagtcactgaagccttgtatctttagttgtccgttttggagactgtatatatgcatgtgtaagaagcgtaggggtgaaagggtcatgaaaacctttggttgaaaatggtgatggggtcattatgtgtgtaagaaaatctttgtacttttcagttaacaattctacaaaatgagaactgtcttgggaaactgggctttatgaattcaaaaatatactttatcaaattctttatctctcatgtttaaaattatttgaacagacaaataaatgttgaacatcagactttgcctgattgctgttcctttcaatgggaaaaatataaatcctgataatagggtttatatctttttaaacccttatatttttataaaccctgataatagggaaaaatataaaccctattaccagggtttttcctactatttttcctactattcccccttggataatagtaggaaaaaatgttggtccgcacgaagttttcattcatctcaccactctctttcccatttgtgagaaggaatacaaagctgcacaggacagagtccaagactagggagtcagatcacctgttaaaattacagtattgcatcatgcatctttgatttgtatttgcagccttcccactacttggattaagtcgtaaaaattacaggtaaccatggtccagtggcaaagctgtatatctctttgggttctttgttgcaattagcaactcttgttaacttaaacaggagggactttagtgaaggaatattaggaatgtatagaattgatgagaagtcaaaagaattagggttcaaataggcaacaaggcaattctggagttccaggaaccatggactacttgaaggtgtttgtactaagtcccaccaggccttgtactaattgctgtctgggcaggaatatgctggtgccaaccatttttggtcttctgtgctggtactaacaaggaattcccagggaaggagcatccagctggcatagcttgggccatacaaacacactgtgatagaggaaggatggacccgattgcagtctcaccgggccttgtctaagaaagatcattcttcaaaggaaaattcggatggatttattggaggaagttatttaagcagccaaaagaatcaagcagtcaccccaggatagtagaaaggagtaaggacggaagcagccagtactaattttccttggtaaatgagggttagaagaatgtgcatatgtgcattggctttgaggcaggtctctctgtctctggctctctctatcctccccctcccccacccatccctcccaagcagttacactttgatttgttttgagaaattaggtctttaaaaaagtccttgtgactgcttcagtgtttaccctatttaccctatggcataatttaccagttgttaaatctgctctatccataactgcctggctgtcaagaattttacatttaaatgtatttatcagtagtgaaactttgaccttttggactcacctggataaataaacccatccctttgtgtttctttttcagcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgattttgtaagtactggttcttatatcaccaaagaaatctagttttaaaatgcttttaacgacattttgattataaaatcacaaattcaaaagtactgttttaatataattggagattagcataactaaaactagaacatgcagcataaaactcgcaacaggatagatttcagtagtaatagctcttccgtgaaacaaataacaaggagcggcactggaattttttggaatgaggtatatggtgcagtaaataaggaatgggtggagagatcaagcataaaaggaaactgtaaatcatccactggagaactcatgagttctccttttattagattgatattttaataagtaggccagtttctgaagggattgtagttccttttattaagcaaacattttcacaaaggtgttaaggataaaatagaatatcatttgtgtaaacatttccaacatttccagctttaaagtactatacacatgtaagattatatcaattgttgctttttttttttttttttttttgacagagtctcactctggagtgagtagtgcagtggcatgatctctgctcactgcaacctccgcctcctgggctcaagtgatcctcccacctcagcctcttgagtagttggactagaggcatgtgccaccatgccagctaatttttgtattttttgtagagatgggttttgccatgttgctcagtctggtctcgagttcctgggctcaagcaatccgcttctttccaaatgggattttaaaatcactttcgtaacaatactttaaatacaaacaacagacagagcctatacactcttagaaaagtatcagtagctccccccagccactggaattaacatgcatgacaaaatcttctcagtatctgcgtatgtgcagagaaattgaaagaatgagaaaatacatttagagagggagggggaaaggtttcaaaagaagaaaagcttttccagtggtgatgaacacttaaaaagagagagagaagcttaagggcatatggcatatagctgggtagagcttggatgggctgacctcagagacaggtgtgtgaggaaagagtctgctttctctgctgttccctcctgtctgcacagcgctgttctctgcagcacagccccaaaccaaaacatctgttatctgcttcctggcctccaaaaatgatgcaaacctgtttacccaacaaagcaggaagtttttaaatattaattacctacgctaattgctaatgtaatggtcattgtcctgggtttttatgaccaaatctatacttgtacccattcctcaaaaagagtctagacttttatgactttgaagaaggtgctctgaaataccgtctggttgttatcaaagtcgggacagtgtggcaaggcaggaagaccactgagcgtagctgggttatggtctaggctttgccgttggttagttgtgtaacaatggacaatcccgagtctctccgaacctcagctttcttagttgtaaaagaaagatagtacctgttcaacaagggtgctgtgagaatcttctgaaaattagggatataactgctttttactgctaaagcaccatgccaatattataaaatactttaaaagccatatatgttagctttagagccccataacctggggtcaaatccaagttctgctacttcctaaccatgtactctttcaaagccttaatttccttatctgcaaagctggggaaataatagaacctatctcctatggttatgaaattatattagagaatgaatgtaaagcacttggaatagtgttagatgttataagcactcagtaaacagctactattagtatgatagtcaataacaattagtttcatgaaacaatattaatggttgcaaagactgacaacaccttttttccaaactgtttatttgggctttaagctgaagcgtactcttgcaagacatctgtcctggggcaatatgagaagcacttgtggattattatgatcttattttttgttatacagtagtaggcagtttctccttctaaaagcaggttgagttatgctgatttagaggttaatgtttccttttctgtaagagaagtaatgtatattagacttcatagtttacttcataagtatttgccaaacttttatatttcattctataatacatacgtcttgtcacagttgatatcttggttatcaaagcaataaattgttatagttaattctttttacttcctttggacagaagtgtgttcaagcacttactagtgtgaatgacttatttaacctgacaaaaccaagatcaaagaaaattttatctgcagtttaaaattctccttaaaaaaaatcacttgaatgaaacctgtgattaaatggcttttagaaccttcaatacaaaaagagaaggtagctatttgaaattttagaagttaaaaattggagaaatccatctcaggaataaaatcccagaaagaggagtttaaaaagcccccagcatggttcaatggaataatcaagtcttttaaaaaatgttttcttttttttttttttttttgagacagagtttcattttgtcacccaggttatagtgcagtagtatgatgttggctcactgcagccttgacctcctaggctcaagcaatcctcccacctcagcctcctgattagctaggactacaggtgtgtgggccactatgcccaggtaattttttaatttttgtagagacagaggctcactatgttgcctaggttggtcttgaactcctgggctcaagtgatcctcccacctcagcctcccaaagtgctaggattacatgcgtgagccactatgactggctaaaagttgtctaaatgctttgatttcacgtctagtatatatttcatatagaccacagttcttatttccacactgcatcatacagttttcatataggctgtgaacactgtaattactttttccaaacagaaagggttcaatgtaatatgaatattatttttaatattttgtgactcttactaaaaattttctatttcactccataaggaactgaaagctaataaagatccttttaccaccttgtttacttggaggagcatttccatgagaattggtgaaatcctccttactttattactcttagtcacttagcagttgtgtttcatccacctgacacaatgtatttaagattttaaaccaatgaaaaactgaaaagattgcatctctgatagatattttttccatgtcgttgatcagcccagatggtcaagatcaacattttcaaatgcatctgttaatctttttaccttgaaaataacaggcctaatggtctagaagaaaattaggtatgatggaattacccttgccaaagccatcaggtgtcttactgaagatgctcgggtatctgcctgccaaatgcaaaagcatttgcctctggtgaaagacacagatggttgctattctctaaaaaaatgaagctgaacactattccaagggtaaagatgtcctgaaaataattgccttttctttattgttattaaagacctagttaaaatacattcttgaaagcaaaagaaaaaaaagttgtgggggaggttcaaaatgacctgttcccgtcagtctcctctggaaatgtactgggccagaataatctgagctattgggggaaaaaaacaaaaaccatactgtttactaaattatttataacaaaaatgcaatttgctatgtggttacgtgtaaattcacattctcaatattgtttagctataaaaattatatcaagaagttcttaatatgggaaaggattattataaagttttttaaaggcaagaaacacttttggaatgatttcaactatgaaaaaaatacttgtttaaaaagactagaataatacatatgtaaatcttaatagttagcaaaagtaaactttgttttacaagaacctattcttatacctggtagtggtagggtttgagatggcttgtgattttttaagtgtatttgaaactgatgagataaaagctgtgtagttagaaatgaattaagaaaattctgactcttaaaatattggcagagatttgacttctagccctcattgtgaatgttcttggctttgcagtgcatcatgcatcttgaagatagactacaggagatgtaccttaaaagtaaaatgctatctgaatatctccggggacacacacgagtccatgtgaaagaattaggtgtcgtactggggtgagttctgtgaagtgccgtcacttgtccctttgataggtatccctagcattgtacccactaacgtgtttagcctgtgtcaccctaaacctcaggccctggtaacctatcaaagtatgtggagtccatcagatacgtgcctctgcaactccccaatgaacagcatgttccgttatctgatactgggtttcacacctacaatcaatcgcaggactttaggctggtcgtgctttgttgctcttctctgtggattatcttatgcttgaaaagaaaatttaatcccacactgcccgtttctagtaactgaataagatgctgaagtcacaagctgtgggacatgcagcagcagcttgtgtttacatttcacttcctggaggaggagtaggttggcacattccacctggtggcaggaaaggcccttctaggcttgaggagcctgcctgcgtgtctgtggggggacagtgctttccttcctttattataagcccaccaaagaggagacttgtatgttactaaaaatgcctatcatcctccagagggtatttgctataacttctctaggggaagtaattcttacttctgttttactgtcagcttgatttttcaaaagagaacaaaaagacattgtacatttggggaactgcccccgcttatccatgatgatgattcccctcacttgggagaagaaaatatttataatgtcgacgtttaaattatctaagcctcctaagagactggggcctttgtgttttgcttagatttctcatctttcacacccaaaatgtgacgcctgtgttgttcggctcttggcatttcctgtcatagattattcttacatactttatttacaaagtatttcccccttatgaggtgtttgcttttgcagttaacttgcaacatgtctctttgtcgttttttttttttgcttttgtttatatctctctaccagcctcatacttcaatcctgccttattagtttttttttttattattatacttttaagttctgggatacatgtgcaaaacgtgcaggtctgttacataggtatacacgtgccatggtggtttgctgcacccatcaacccgtcatctacattaggtacttctcctaatgctatcccacccccagccccccacccgccaaataggccccggtgtgtgatgttccccttcctgtgtgtgttgtcattgttcaactcccacgtatgagggagcacatgcggtgtttggttttctgttcctgtgttagtttgatgagaatgatggtttccagcctcatccgtgtccctgcagaggacatgaactcatcctttttatggttgcatagtattccatggtgtatatgtgccacattttctttatccagtctatcattgatgggcatttcggttggttccaagtctttgctattgtgaatactgcttcagtaaacatacatgtgcgtgtgtctttatagtagaatgatttataatcctttgggtatatacccagtaatgggatggctgggtcagatggtatttctagttctagatccttgaggaatcgccacactgttttccacagtgattgaactaatttagactcccatcaacagtgtaaaagtgttcctatttctccacatcctctcaagcatttgttttttcctgactttttagtgattgccgttctaactggtgtgagatggtatctcattgtggttttgatttgcatttctctgatgaccagtgatgatgagctttttttcatatgtttgttggctgcataaatgtcttcttttgagaagtgtctgttcatatccttcacccactttttgatggggttgtttttttcttgtaaatttgtttaagttctttgtagattctggatattagccctttatcagatgggaagatggcaaaaattttctcccattctgtaagttgcctgctcactctgatgatagtttattttgctgtgaagaaactctttagtttaattagatcccatttgtcaattttggcttttgttaccattgcttttggtgttttagtcatgaagtctttgcccatgcctatgcctgaatggtattgcctaggttttcttctagggtttttatggttttaggtcttacatttaagtctttaatccatcttgagttaatttttgtaaaaggtgtaatgaagggttccagtttcagttttctgcatatggctagccagttttcccaacaccatttattaaatagggaatcctttccccactgcttgtttttgtcaggtttgtcaaagatcagatggttgtagatgtgtggtggtatttctgaggcctctgttctgttccattggtctgtatatctgttttggtaccaataccgtgctgttttggttaccgtagccttgttgtatagtttgaaggcaggtagcatgatgcctccagctttgttctttttgcttaggattgccttggctatgcaggctcttttttggttccatatgaaatttaaaatagttttttccagttctgtgaagaacatccatgggagcttgatggggatagcattgcatctataaattactttggggagtatggccattttcacaatattgattcttcctatccatgagcatggaatgttcttccatttatttgtgtcctctcttatttccttgagcagtggtttgcagttctccttgaagaggtccttcacatctcttgtaagttatattactaggtattttattctctttgtagcaattgtgaataggagttcacttgtgatttggctctctgtctgttattggtgtataggaacgcatgtgatttttgcacattgattttgtatcctgagactttgctgaagttgcttatcagcttaaggagattttgggctgaaatgttggggttttccaaatatacaatcatgtcatctgcaaacagagacaatttgacttcctctcttcctatttgaatacgctttatttctttctcttgcatgattgtcctggccagaacttccaatactatgttgaatagttgaataggagtggtgagagagagcatccttgtcttgtgctggtttccaaagggaattcttccagtttttgcccattcagtatgatattggctgtgggtttgtcagaaatagctcttattattttgggatacgttccctcaatacctagtttattgagagtttatagcttgaagtggtgttgagttttgtcgaaggccttttctgcatctattgagatgagataatcatctggtttttgtcactggttttgtttatgcgatggattacctttattgatttgtgtatgttgaaccagtcttgcatcccagggatgaagccagctggatcgtggtggataagctttttgatgtgctgctggattcagtttgccagtgttttattgaggatttttgcattgatgttcatcagggatattggcctgacattttctttttttgttgggtctctgccaggttttgctttcaggatgatgctggcctggcctcataaaatgagttaggcagaagtccctctttttctattgtttggaatagtttcagaaggaatggtaccagctcctgtacactctggtagaatttggctgtgaatccatctggtcctggacattttttggttggtaggctattaattactgcctcaatttcagaacttgttatcagtctattcagggatttgacttcttcctagtttagacttgggagggtgtatgtgcccaggaatttatccatttcttctagattttctagtttatttgagtagaggtgtttatagtattctctgatgttagtttgtatttctgtgggatcagtggtgatctcccctttatcattttttgttgcatctatttgaatattctcttctttcttctttattagtctggctagtggtctattttgttgatcttttcaaaaaaccagctcctggattcattgattttttgaagggttttttgtgtctctatctcgttcagttctgctctgatcttagttatttcttgtcttctgctagcttttgaatttgtttgctcttgcttctctagttcttttaattgtgatgttagggtgtcgattttagatctttcctgctttctcttgtgggcatttagtgctataaatttccctctaaacactgctttaaatgtgtcctaaagattcgggtacactgtgtcattgttctcattggtttcaaagaacttttatttctgccttcatttcgttatgtacccagtagtcattcaggagcaggttgtacagtttccatgtagttgtgtggttttgagtgagtttcttaatcctgagttctaatttgattgcactgtggtctgagagactgttatgatttccattcttttgcatttgccgaggagtgttttacttccaattttgtggtcaattttagaataagtgtgatgaggtgctgagaagaatgtacattctgttgatttggggtggagagttctgtagatgtctattaggtctgcttggtccagagctgagttcaagtcctgaataccctgttaattttctgtctcgttgatctaatattgacagtggggtgttaaagtctcccattattattgtgtgggagcctaagtctctttgtagctctttaagaacttgctttatgaatctgggtccttctgtattggttgcatgtagatttaggatagttagctcttctggttgcattgatccctttaccattatgtaatgcccttctttgtctctttgatctttgttggtttaaagtctgttttatcaggactaggactacaacccctactttttttcactttccatttgcttgtagatcttcctccatctctttattttgagtctgtgtatgtgtttgcacgtgagatgtgtctcctgaatacagcacaatcatgggtcttgactctttatccagtttgccagtctgtgtcttttaattggggcatttagcccgtatttgatttaaggttaatattgttatatgtgaatgtgatcctgtcattatgatgctagttggtttttttgcccgttagttgatgcagtttcttcatagtgttgatggtctttacaatttggtatgtttttgcagtggctggtaccgctttttcctttccatgtagtgcttccttcaggagctcttgtaaggcaggcctggtggtgacagaatctctcagcatttgcttgtctgtaaaggattttatttctcctttgcttgtgaagcttagtttggctggatatgaaattctgggttgaaattttttttttttttttttttttgagacagagtcttgctctgttgcccaggctggagtgcagtggcgtgatcttagctcactgcaacctccgcccctccaggtttaagcaattctctgcctcagcgtccagagtagctgggattacaggcgtgtgccacgaaaattcttttaagaatgttgaatattggcccccactctcttctggcttgtagggtttctgcagagatctgctgttagtctgatgggcttccctttgtgggtaacctgacctctctctggctgcccttaacatttttttccttcatttcaacctccgtgaatctgaccattatgtgtcttggggttgctcttctcgaggagtatctttgtggtgttctctgtatttcctgaatttgaatgttggcctgccttgctaggttggggacattctcctggataataacctgaagtgtgttttccaacttggttccattctccctgtcactttcaggtataccaatcaaacgtagatttggtcttttcacatagtctcatatttcttggaggctttgttcgtttgttttcattttttctgtaatcttgtcttcacgctttatttcattaagttgatcttcaatctctgatagcctttcttctgcttgattgatccagctattgatacttgtgtatgcttcatgaagttctcgtgctgtgtttttcagctccatcaggtcatttatgttcttctctaagctagttattctagttagcaattcacctaaccttttttcaaggttcttagcttccttgcattgggttagaacatgcttctttagctcagaggagtttgttattacccaccttctgaagcctacttctgtcaattcatcaaactcaattctccatccagttttgttcccttgctggtgaggagctgtgatcctttggaggagagagcattctggttttttgaattttcagcctttttgcccaggtttctccccatcttcatggatttatctacctttggtcttttacgttggtgaccttcggatggggtctctgagtggacgtcctttttgttgatgttgatgtggctgttttctgcttgttaattttccttctaacaggcctgtctgctgcaggtctgctgtggtttgttggaggtccactacagaccctgtttgcctgggtatcaccagcggaggctgtagaacagcaaagattgctgcctgttccttcctctggaagcttcgtcccagaggggcacccaccagattccagccagagctctcctgtatgaggttctgtcggcccctactgggaggtgtctcccagtcaggatacacaggggtcagggatccacttgaggaggcagtctgacccttagcagagctcaaacgctgtgtgggggatccactgctgtcttcagagttatcaggcagggatgtttaagtctgctgaagctgtgcctacagccgccccttcccccaggtgctctgtcccaaagagatgggggttttatctataaacccctaactggggctgctgcctttttttcagagatgccctgcccagagaggaggaatctagagaggcagtctggccccagtggccttgctgagagctgcagtgggctccgcccagtttgaacttccaggcagctttgtttacactgtgaggctaaaccgcttactcaagtctcagcaatggtggatgcccctcccccaaccaacctcaaacgtcccaggtcgacctcagactgctgtgctggcagtgagaatttcaagccagtggatcttagcttgctggctctgtgggcatgggacccactgagccagaccactcggctccctggcttcagccccctttccaggggagtgaaccgttctgtctcgctagcattccgggtgccactgaggtatggaaaaaaaactcttgcagctagctcagtgtctgcccaaatggccgcccagttttgtgcttgaaacccagggccctgattgtgtacacaccaaagggaatctcctggtctgtgggtcatgaagaccatgggaaaagtgcagtatccagactgcagtgcagatattgagttcctcacggcttcccttgggtaggggaaacaattccctgaacccttgcacttcccgagtaaggcaacaccccaccctccttctacttgccctctgtgggctgcacccagtgtccagccactcccaatgagatgagccgggtacatcagttggaaatacagaaatcacccaccttctgcgtcgatcttgctgggagctgcagaccagagctgttcctattcggccgtcttgccttattagattttccattgccaaatgtgtgccttacatttcaagggctttaccccatccttgacccttacaggtgtgcatcaacacgtgtaatcataagcttttattcccctttgcactcatctctaggtcctcttagtgcattattagtggactcatgttcatccttcctttatccccttcctcccgtagtcagggccagtagcactaaaagtactagagaacttctgtgcactctgaaatcagatctgtatgtagcattactggagaaggactagaaaaccccatgaggtaatgccagatactgttttatttttactttgaggaattcaagggtaaggattaggacatagtccacaaactgaaacagttcaatttttttttttcatgacacctggcatcatttttagccagtgcccatactgtatccacctctgctgtaagagaggcagccaaagctgtgtccatttgaaaccatgatgtctcttaacccagtaccttttagtgtcactttgctctcagaatcttgtggcttaaatgctcagtgaggatcccagtataaactttgaacaaattcccaatgttttttaagaaattgctaccatcatcgtttttctaagaccaatttgaacttaggtgaaaaatcagtatgcatttagaagtgttgactggaagaatgagtttataatggagaataccttaaagtatgatacaatgaagttatatagggaatacaggaaagttagaaagtctggtgacccctgccaagggaaaaagagctttatgtccacacacaggcacaacacacttcctgtatttctctccctttgcctccctggtcagtgtccactggaatattttattaaaagagtaagtttattatccttccatctgttttgctttttcattagttttaaatgataatctatcaaacttagtacctagaaataatactttctcataaaaagaaataatactttctcataaaaccatgctcttttaaagtaatattcttttcttttctcaatattcaggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcattacttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatccttttcaaaacatctttccagacattaacttacacattgtataaaaccgaccaaaatgatttcctaaagttcatgcaaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaagttttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaccattcaagttttcttt

SEQ ID NO: 10930 - DNA, 326 bp, Homo sapiens; identical to SEQ ID NO: 10184

SEQ ID NO: 10931 - DNA, 321 bp, Homo sapiens; identical to SEQ ID NO: 10185

SEQ ID NO: 10932 - DNA, 318 bp, Homo sapiens; identical to SEQ ID NO: 6723

SEQ ID NO: 10933 - DNA, 270 bp, Homo sapiens; identical to SEQ ID NO: 10187

SEQ ID NO: 10934 - DNA, 1165 bp, Homo sapiens
gacacagggagcctgaaagattctcacctcatgtctggggagcagcgcttcaaagaaactgaagttaggggcttcccagctctcctcttcagctcagtatcctctttacaccacagacacacttttttttttctgacaaggcacagctctggctgaagcttcatttaccctcaaaacctctgctggtcaggatgaccaggtaaataattttctgaagaagacagcaaagcaaaagtgtgctagagacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaagaaaagcaggaaag

SEQ ID NO: 10935 - DNA, 248 bp, Homo sapiens; identical to SEQ ID NO: 10188

SEQ ID NO: 10936 - DNA, 57 bp, Homo sapiens
tgcactccagcctgggggacagagcgagactccgtctcaaaaaaaaaaaaaaaaaga

SEQ ID NO: 10937 - DNA, 1165 bp, Homo sapiens
gacacagggagcctgaaagattctcacctcatgtctggggagcagcgcttcaaagaaactgaagttaggggcttcccagctctcctcttcagctcagtatcctctttacaccacagacacacttttttttttctgacaaggcacagctctggctgaagcttcatttaccctcaaaacctctgctggtcaggatgaccaggtaaataattttctgaagaagacagcaaagcaaaagtgtgctagagacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaggaaaagcaggaaag

SEQ ID NO: 10938 - DNA, 284 bp, Homo sapiens; identical to SEQ ID NO: 10189

SEQ ID NO: 10939 - DNA, 296 bp, Homo sapiens; identical to SEQ ID NO: 6750

SEQ ID NO: 10940 - DNA, 195 bp, Homo sapiens
aacaaggtgaaaccccgtctctactaaaaatacaaaaattagccgggcgcggtggcgggcgcctgtagtcccagctactcgggaggctgaggcaggagaatggcgtgaacccgggaagcggagcttgcagtgagccgagattgcgccactgcagtccgcagttcggcctgggtgacagggcaagactccgtctca

SEQ ID NO: 10941 - DNA, 1165 bp, Homo sapiens; identical to SEQ ID NO: 10937

SEQ ID NO: 10942 - DNA, 295 bp, Homo sapiens; identical to SEQ ID NO: 10192

SEQ ID NO: 10943 - DNA, 1752 bp, Homo sapiens
gacgatgaagaaatagcgttttatttctttacaaatttatagccaagacaataaatcactccatagaaaaatttaaaacaagatacattcttgtgaccttcataacagatggagtagttagtacaatagtgaaaactgcctgctgggatgtcaggttgcagcattttgtcaggcttgaatgaaaaagaaagtccaacattagtaatggaatgggcaactgacaaaggtgccttgcccttagactcaaattgtttttgtgaataaccaagagagatgaggttagtgcagtgccgggtcttccctaagcttagctacctttgcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcccacatccccagaaaagagaaagagtgaaagatgcttcacaaaatcggcctcagcctggtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtggctgattccccagggatggaagccagcaaaaatgcacagaagggagatgggaacattctcaagggtccttatattgagaaagaaaatgaatggattagtggtgctgtggtgatgaactatctgccctaaaactcctgccaagatcagccagctgttctctggctaggctgggtctcaggggtgtgagtgggtcttggccagctgagttgaaccatttctcacctcttgatagtcatgcagcctacatctgtctgatggaaccctctccctgtgtgcttcccatttaagagaggcacaatttgacccatgttatggaagaaaacagctagagcgttctacaggaaaagtgctataataggtcctaataactattcacactgtgttattactatgtgctatctagttctagtttcacaagcagtagaataatttcctacctctaagatgcactgagcattgacaaacaggaaagaataacacagctgggaaaatgctgacctagaaatgctactgtttcatgacacatacaaaatcaatcctcattttttattctaagtatttcagcgactagtagactttcagaactggaatttactcatcaaatgttctatccatatatgccatattagctttagctgagcttaccagttttctgaaaatgctctactatggcatgaagctaagcattccagaagcaagagcagtgattagaatagttccagggccagaggataagtttgaagatgaaatataagatatttcatgaattgtgacatatataaaatgatatcctgggtgtatatatg

SEQ ID NO: 10944 - DNA, 196 bp, Homo sapiens
aagaaaacaaaagcctgccaaatggttataacctacaagttggttgaatagaagccaccaacccaataaaacatttgccatggaaacatattaaaggaaaaagcaagccttctccatctcccatcctacacacatgcaaacacacacacacacacacacacacacacacacacacacacacatacacacaaattgg

SEQ ID NO: 10945 - DNA, 196 bp, Homo sapiens; identical to SEQ ID NO: 10944

SEQ ID NO: 10946 - DNA, 1752 bp, Homo sapiens; identical to SEQ ID NO: 10943

SEQ ID NO: 10947 - DNA, 196 bp, Homo sapiens; identical to SEQ ID NO: 10944

SEQ ID NO: 10948 - DNA, 2383 bp, Homo sapiens
ctaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaagaaactaaaaa

SEQ ID NO: 10949 - DNA, 537 bp, Homo sapiens
cttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaa

SEQ ID NO: 10950 - DNA, 4586 bp, Homo sapiens
aaaaacaccaagactagaggactctgggttccttttatgcaaagtcaactcttctgggtcacagttacccagcaacaaaaataaaggtagttatttataaatggtattaaagatagaaagcacaatgtatattttttaagagttttggttcttttcccaggagaagaaaacactgtgggttggtattttcaagcacattcaagggttttacaaatcagccccagttccagtcacacacaatctaagaccacccaagataacatttcaagaagagatttttcacaagactataaaatttcagtgctggatgaaatgtcaaagagcatgtccagtgttttcactttccaggtgaggaaatcgaggcctcagacttttccaaagtcactcaactagatatcagcagagcactcgtctttgacatgtgggccttggacttaagaccaacattcatattctctagccattgaaccagtcttccttcaactggtctccattcactctgatccatccaaatcaattctgccaagatactcataacacaaaagaaagcatattatttccatgttcacatttctgtcattcccattgtctacagaatgaaatccaaactcctttagcatagctttgacaagctttcgtgatctggcttcaagctctctgttcagtcatttcccacctctctctctcgtcacttcttactgacaaccagcctgttctccattctagattcactacaacctgctccctgccccggttgtgtctgtaccacctcctctcagttttaaagtcctcccatatttgaaatatatctaatcttttgtgctttgtgtctctttttcttatgcttctgtaacagaacttgctaaacaggcatagactgcctggattaaatctcaattccaccattccagttgtgtgacccttagtaaatcatgtaacttacgtgagccttggttttttcatctgtagaatgggactaataatattacccacttaatggggctattgttggtttaaaggagataaagttccaagcacatagtaagcattcaaatgttagttgctgatattgtcattagtaagtgcttttgtataactatataaactcttgaatgcaaagagtatggcttcctcattgtgtactcactagaaacctggcacagtgctttacacactgaattatgaaaattaaagttggggctaggtgataaagaaaaattatgaaaccatatttcctggagatttgaaagacagagtcatcaatctgccaggtttgtttcagtgaacttcctcctgaaggcagaggcttgcctaaatcagcctttataaggatggttactttattaataagtatttggctatataatatatcagttccattgatctccttagaatttccccatggactccagatcctttactactgaactcacagggctgtaacactgttactgtacagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctgacctctggcactctttctcatgttgtttaaatatttaatattgtctaaggcaattcaagtattttcttaaataaaaaatatgaaaactcactcttttccattcctttgttttctatgacaaatgcaaagaagttgaagaaccaaaatcctttccattttccataataaattgctctttaaaaactgacatatctaagaaggcttttgactacctcatcttctaaatgttttactaagataggtagtaagcagcaaaatgaacttatttggtgcagtcccacccttacatgcaccactccaatactttacctaatttctgccttcagggttatcagtaactttttcctgccttatgtgctattgtggagaaagaaattatgaccttgagccgggacacaaattttctttttacaataacatgtatctgtagatttttttaaaaaacacaaaaataatataggaaacaaaaagttccctcctccacaatccaccttccagagataaccattgttaacagtttattgggtattttaacagacattttactgatcagtttaacaaaagcaagatattatctatacctgccactgctttttttttttgagacagggtcttgctctgtcacccagactggagtaagtgcaatggcacaatcctcagcctcaaattcctgggctcaagcgattcacccacctcagcctcccaagtagctgggactacaggtgcatgccaccacggcctgctaattaaaaaaaaaatttttttttatagagatgggggtctcagtatgttgaccagggtcgtctcccagtctcctcctgccttggcctcccaaagtgctgggagccaccatgcatgccctgtggctttcttttttgacttaatttgtgatgtagatttttctgtgtcagtaaatatagagcttcctcattttaaatgcatagtattccatttgatacatatcaaatatgtgtcttcccattttgatgtacatgaggttgcttccagatttttgttattgcagataatgctgctgtgaacttaggccttggataacaaaaacttctcaaatgtcataataacctgacattctaactgaagcgtatcaactattaaaggaattcctattttcaaaagcactgtggttaaataatagtggcattctctacgtttagagaaggaaactaacagtaaattcatgtgttatgtgctttcccatatgtcatcttaatcctctacctgtgaagtacagggtggtgttttatagactacaaaaccaaggatcaaaaggctgaacaccttactccaggttctgtaactagcaactggtgaatctgggtttcacagccaggctccctgacttcagatctaggactcctgctgtcctgcattgccagtgtggctgatctaaagggaataaaaataacttgtcccgcttgcatgattccttggctcaaacatgagcagctaaatctatggtttgcttcttctggatgtggaatgcaaacaaccataaaaggtggtccctatttagaaacactttccactttgttgagagaaaaaaaaaaaaaagtaagaaaaacctcccacttattaagttgtttgtgtcaaatcttccatcattcccctctcattgttgagctttctctttgtaatcattgttcactggtttttgggtttggtttggtttttggctgctcactgcagcctcgacctcctgggccaccatcttcccacctcagcttcccaagtagctgggaccacaggcacgcaccaccatttctggctaattttaaaattttttgtagagatggggtctcactttgttgcccagactggtcctgaactcctggcctcaagcagtcctccagcctcgacctccaaagtgctgggattacaggcatgagccaccatgccccagcctgttggtattttatagtgccgacttccttgatggatgaagctagatgagggcattgattttactggggccctttcaggattccagcacccagggaaattttcccaaaccagctgctcctcacccctactcccaaagcacttaaaactcaactggatcccttctactggactggtaggaatttactggttattggagtactctaagttgtgcagaggttcgtggttcaaacatttggaagtccctcaccccaccccaccccccgccaccacccactagttgatcatctgtctacatgttactgctgagacatcagttgtcccaggctaaatgaggcagtagttttactgtgttcgtctcacacttggggaatgacaaactttggtgagctaggaactcctgtgtctggactcttccctgaatgcaccaaggacccactttctcttagatattgccatcttaccaaagtattgccaccaaacatggaacaagtttctactccctctgatttttagatctctgattttttttttaatctgtctgggagaatatcatctcccctttggctttcctgagaggcatgtttgcctaataccatggtccctttggtttcaaaaaaaaaggctctttctttttggaaaatcgttcctttcctaccttcgggccatgtggtttcatggggccaatttcacgttctggcttcagagctcgacagaagccagacttggacagagtcatggtgacagattcagaaattagcatggcatgtgactagcctgggactttgctggaatagagttgctaagttgtaaggaaaagtttggtactgctggcagccacacctgaagagcctcctgatcaagccatcctagaagaaaggaagct

SEQ ID NO: 10951 - DNA, 576 bp, Homo sapiens
agatccacttcccataggctcatcacctggcaatccccaattctctgtcacggtagttctgcctttttaaaatatcatatacataaatttacattatctggtcttttgtacctggcttatttcacatagaataaatgttttgaagtttatgttgtgtgtatcaatggtttgtttcattttgttgttgagtattctactgtatgaatataccaaaatttgtgtgtctgttcaccgattgattgacatttgggttattacaactttaaagctactataaataaacctgctaaaaatgtttacataagagcttttgcattggtatagattgtcatttctctggagtgaatatctaagaggagaatttctaggttatatgataagtataaccatattgttaagcattctagttgatgtgtagagaaagacaggatcgaaagcaattaaaatgaaagaatatttcaaaagataaaagagaatatagaataacatggttataaaagccagtggaagagtgattaagggatggaaactggagtttcaatgttagaacttcagaaattgaaaaaaaaataaaaa

SEQ ID NO: 10952 - DNA, 576 bp, Homo sapiens; identical to SEQ ID NO: 10951

SEQ ID NO: 10953 - DNA, 576 bp, Homo sapiens; identical to SEQ ID NO: 10951

SEQ ID NO: 10954 - DNA, 1413 bp, Homo sapiens
tactcatacaaattcttagtatatggtgcgtatactgtcaatggtagttatcatcatcatcattattaatgggagcccattatgtgtgctgtcttatttcatcttcacaatattcacatgaaataagcattatctgtactttatgaataagaaaactgaggctcaaagacataaatgtcttaatcaagtcacccatctattatcagaaagaacggggatttgaaaatgcatcttcctagagacaaaacttgtttccattatgccacagattttactatgtaccacggctttaaaaataataactcttaggaggacttatttataaaagactcctggtattgcaggaggaaagtaaatatattttcatgactctgcatctaactctgggttctttccttaattccattgtgtgtgtgtgtgtgtgtgtgtttttttttaaaggaaaaatacccatagattttctcttgcctcagtgcaacattgcagatgatccctagtgatgacctttcccaaagttacattgtagaattcattggctaataccggctgataccaccgcatgaggtgcataattaagtgatgtggtggcaagaccagattcattatcgtagacggtcatgtgccctgccatgacattttggtcagggacagactgcatatacagtggtgtgcccataagattataatggagctcagctaaaaattcctattcttggtgacatcatagccgtcataacaccgtagtgcaacacattactttttctatgtttaggtaagtttctatacacaaatacttaccactgttttgccgttgcctaacatattcagtacagtagcatactgtacaggtttgcaacaggctataccacaccgcctaggtatgtagtaggctgtaccatctaggttcgtgtaagtaaattgtatgatgtttacacaatgagaaaatgttccatttcccagttcatatcctccttcttaagcaatgcatgagtatctcttctgttcttatgctttcctcttccaggaaatagatataagttgtgtcctagcaacaattttttgcttcacataatatctaaagatatctaaataaattaagattcactaatgactctagtggcttttaatgccatgagatattcctactagttctttctgtcattggtttattttcattatgtagattagaaatgaataaaaattacttccttattttacactaatactaataaatgcctctgatttttagagaactgtaatagatatatgatgtgttactctctttgactatttgtataattttgttttttaaagatacatctagattaaaaactactgttgtaagctgttgaaatcttccatatggccaaaattctgtcactgcctatagaaattccaaaagaagaaaaataa

SEQ ID NO: 10955 - DNA, 1414 bp, Homo sapiens
  misc_feature (1413)..(1413): n equals a,t,g, or c
tactcatacaaattcttagtatatggtgcgtatactgtcaatggtagttatcatcatcatcattattaatgggagcccattatgtgtgctgtcttatttcatcttcacaatattcacatgaaataagcattatctgtactttatgaataagaaaactgaggctcaaagacataaatgtcttaatcaagtcacccatctattatcagaaagaacggggatttgaaaatgcatcttcctagagacaaaacttgtttccattatgccacagattttactatgtaccacggctttaaaaataataactcttaggaggacttatttataaaagactcctggtattgcaggaggaaagtaaatatattttcatgactctgcatctaactctgggttctttccttaattccattgtgtgtgtgtgtgtgtgtgtgtttttttttaaaggaaaaatacccatagattttctcttgcctcagtgcaacattgcagatgatccctagtgatgacctttcccaaagttacattgtagaattcattggctaataccggctgataccaccgcatgaggtgcataattaagtgatgtggtggcaagaccagattcattatcgtagacggtcatgtgccctgccatgacattttggtcagggacagactgcatatacagtggtgtgcccataagattataatggagctcagctaaaaattcctattcttggtgacatcatagccgtcataacaccgtagtgcaacacattactttttctatgtttaggtaagtttctatacacaaatacttaccactgttttgccgttgcctaacatattcagtacagtagcatactgtacaggtttgcaacaggctataccacaccgcctaggtatgtagtaggctgtaccatctaggttcgtgtaagtaaattgtatgatgtttacacaatgagaaaatgttccatttcccagttcatatcctccttcttaagcaatgcatgagtatctcttctgttcttatgctttcctcttccaggaaatagatataagttgtgtcctagcaacaattttttgcttcacataatatctaaagatatctaaataaattaagattcactaatgactctagtggcttttaatgccatgagatattcctactagttctttctgtcattggattattttcattatgtacattagaaatgaataaaaattacttccttattttacactaatactaataaatgcctctgattttttagagaactgtaacagatatatgatgtgttactctctttgactatttgcataattactgtttttaaagatacatctagattaaaaactactgttgtaagctgttgaaatcttccatatggccaaaattctgtcactgcctatagaaattccaaaagaagaaaaatna

SEQ ID NO: 10956 - DNA, 1413 bp, Homo sapiens; identical to SEQ ID NO: 10954

SEQ ID NO: 10957 - DNA, 729 bp, Homo sapiens
ctggaaccaacaagaaaaccttaatatggaactgcaatgatgggaatttggggcattgaaagaagttgggttggcaacattgcttgggtgatttccttgctaacattgtactgtaaggtgtgagggcctttgcattagactctgactgggctctgtaaacctgagcctcattcttagaacctcttgagccccttgatgttgcccagtcaagtccatagtgactgtaggggctgaacttcaagggccacttttgcttatagccatcacctgagagcacctccagaatcaaatggccttgggaagtacttgccccagagagagttttaaaaattattctgtcaatctgactcaattccttgtagatagttcatttccaggcatgtattttcttggagtttgttaaaaacaatggaaaaatcttatcttaaaagtacctcttgggccgggtgcggtggctcacgtctataatcccagcactttggaaggctgaggtgggcaaatcacctgaggtcaggagtgtaagaccagtctgaccaacgtggtgaaaccctgtctctacaaaaatacaaaaattaaccaggcatgatggcaggtgcctgtaatcccagctacttgggaggctgagatgggagaattgtttgaacctgctgcattccagcctgggcaacagagtgggactcaaaaaaaaaaaaaaaaaaaaaaaaacctccctaaaaatgcaactcaaag

SEQ ID NO: 10958 - DNA, 732 bp, Homo sapiens
ctggaaccaacaagaaaaccttaatatggaactgcaatgatgggaatttggggcattgaaagaagttgggttggcaacattgcttgggtgatttccttgctaacattgtactgtaaggtgtgagggcctttgcattagactctgactgggctctgtaaacctgagcctcattcttagaacctcttgagccccttgatgttgcccagtcaagtccatagtgactgtaggggctgaacttcaagggccacttttgcttatagccatcacctgagagcacctccagaatcaaaatggccttgggaagtacttgccccagagagagttttaaaaattattctgtcaatctgactcaattccttgtagatagttcatttccaggcatgtattttcttggagtttgttaaaaacaatggaaaaatcttatcttaaaagtacctcttgggccgggtgcggtggctcacgtctataatcccagcactttggaaggctgaggtgggcaaatcacctgaggtcaggagtgtaagaccagtctgaccaacgtggtgaaaccctgtctctacaaaaatacaaaaattaaccaggcatgatggcaggtgcctgtaatcccagctacttgggaggctgagatgggagaattgtttgaacctgctgcattccagcctgggcaacagagtgggactcaaaaaaaaaaaaaaaaaaaaaaaaaaacctccctaaaaatgcaactcaaag

SEQ ID NO: 10959 - DNA, 730 bp, Homo sapiens
ctggaaccaacaagaaaaccttaatatggaactgcaatgatgggaatttggggcattgaaagaagttgggttggcaacattgcttgggtgatttccttgctaacattgtactgtaaggtgtgagggcctttgcattagactgactgggctctgtaaacctgagcctcattcttagaacctcttgagccccttgatgttgcccagtcaagtccatagtgactgtaggggctgaacttcaagggccacttttgcttatagccatcacctgagagcacctccagaatcaaaatggccttgggaagtacttgccccagagagagttttaaaaattattctgtcaatctgactcaattccttgtagatagttcatttccaggcatgtattttcttggagtttgttaaaaacaatggaaaaatcttatcttaaaagtacctcttgggccgggtgcggtggctcacgtctataatcccagcactttggaaggctgaggtgggcaaatcacctgaggtcaggagtgtaagaccagtctgaccaacgtggtgaaaccctgtctctacaaaaatacaaaaattaaccaggcatgatggcaggtgcctgtaatcccagctacttgggaggctgagatgggagaattgtttgaacctgctgcattccagcctgggcaacagagtgggactccaaaaaaaaaaaaaaaaaaaaaaaaaccctccctaaaaatgcaactcaaag

SEQ ID NO: 10960 - DNA, 459 bp, Homo sapiens
tgggtcagacagaggactttattattcacagtggtaacagtagtcatgatatcagcatttgttttttgcaccagttcttcaagccctgattctcacagagcgacttgcagaaggccagttgtgcacacacagtgggttgcattgcaggaaaggaaccctgaatataaggtacccgaatctcttatactggactgcaagcatgcctgctttttgttcttaagggagatgctgtctctgtcttccaagtctgtaagcatacctgccctttgctctggaggaagacactattctctaagtctattcactataaaaatatccttgtaatgatagtccagaacaaagatagtcattgcctctgcttaaatcatgtacagaattgcaagagacccacggagaattatctaccaacaatatgcatcatagaaatttagaaaacagaagaaaagtcactacagtcct

SEQ ID NO: 10961 - DNA, 1025 bp, Homo sapiens
gtgaatccccagcctgaggtcgtgcttaagtgccacctgctcaagagagaaggcttcctgcccgcgcccatgatgtaagtccccccagatgctttccaccatcctgtcctttgtctgtaattgcgcttgtcgcttgaacagaatcctaattgtgctgattacatgtttaattttggtctcccctgtaagacaggcatgctttttggaggcagggactgaatgtcattcacatctgtgctcctagggtctaatacatgatggtgcattgtaagtattcagtatataacttgttgaataaatggatcgggtttagcattttcccccattggacctggattgacctggaaattggtggactgaacctgcaagtagagattaaaggacctaacaactgtagagtggctggtgaaggtagatataagtgcagtaagggagggagtcgttgatgttgttttggttcgtagtgcagaataaagctacttatggaaatatacgactcctactcttagtttctgctttgatgtggttactgctgttgtttagcgtaagcatataaacaaatcactggcttagtgggttaatttttcttctcttttgttaaacagctgagtttttgctgttttcaaagttagccaaaaattccattttcatgtttaaatgatttagaaaaatcatttttctttaaaaaataacagtacataaaaagaaaacattctcggctgggcgcggtggctcacgcctgtaacccagcactttgggaggctgagacaggcagttcacctgaggtcaggagtttgagaccagcctgaccaacatggagaaactccgtctctactaaaaacacaaaaattttagccgggcgttgtgccacgttcctgtaatcccagctactcgggaggctgaggcaggagaatcgcttgaacccgggaggcagaggttgcagtgagccgagatcgtgtcattgcactccagcctgggcaacaagagcgaaactccatctcaaaaaataaaaaataaataaaaaa

SEQ ID NO: 10962 - DNA, 459 bp, Homo sapiens; identical to SEQ ID NO: 10960

SEQ ID NO: 10963 - DNA, 1024 bp, Homo sapiens
gtgaatccccagctgaggtcgtgcttaagtgccacctgctcaagagagaaggcttcctgcccgcgcccatgatgtaagtccccccagatgctttccaccatcctgtcctttgtctgtaattgcgcttgtcgcttgaacagaatcctaattgtgctgattacatgtttaattttggtctcccctgtaagacaggcatgctttttggaggcagggactgaatgtcattcacatctgtgctcctagggtctaatacatgatggtgcattgtaagtattcagtatataacttgttgaataaatggatcgggtttagcattttcccccattggacctggattgacctggaaattggtggactgaacctgcaagtagagattaaaggacctaacaactgtagagtggctggtgaaggtagatataagtgcagtaagggagggagtcgttgatgttgttttggttcgtagtgcagaataaagctacttatggaaatatacgactcctactcttagtttctgctttgatgtggttactgctgttgtttagcgtaagcatataaacaaatcactggcttagtgggttaatttttcttctcttttgttaaacagctgagtttttgctgttttcaaagttagccaaaaattccattttcatgtttaaatgatttagaaaaatcatttttctttaaaaaataacagtacataaaaagaaaacattctcggctgggcgcggtggctcacgcctgtaacccagcactttgggaggctgagacaggcagttcacctgaggtcaggagtttgagaccagcctgaccaacatggagaaactccgtctctactaaaaacacaaaaattttagccgggcgttgtgccacgttcctgtaatcccagctactcgggaggctgaggcaggagaatcgcttgaacccgggaggcagaggttgcagtgagccgagatcgtgtcattgcactccagcctgggcaacaagagcgaaactccatctcaaaaaataaaaaataaataaaaaa

SEQ ID NO: 10964 - DNA, 459 bp, Homo sapiens; identical to SEQ ID NO: 10960

SEQ ID NO: 10965 - DNA, 1025 bp, Homo sapiens
gtgaatccccagcctgaggtcgtgcttaagtgccacctgctcaagagagaaggcttcctgcccgcgcccatgatgtaagtccccccagatgctttccaccatcctgtcctttgtctgtaattgcgcttgtcgcttgaacagaatcctaattgtgctgattacatgtttaattttggtctcccctgtaagacaggcatgctttttggaggcagggactgaatgtcattcacatctgtgctcctagggtctaatacatgatggtgcattgtaagtattcagtatataacttgttgaataaatggatcgggtttagcattttcccccattggacctggattgacctggaaattggtggactgaacctgcaagtagagattaaaggacctaacaactatagagtggctggtgaaggtagatataagtgcagtaagggagggagtcgttgatgttgttttggttcgtagtgcagaataaagctacttatggaaatatacgactcctactcttagtttctgctttgatgtggttactgctgttgtttagcgtaagcatataaacaaatcactggcttagtgggttaatttttcttctcttttgttaaacagctgagtttttgctgttttcaaagttagccaaaaattccattttcatgtttaaatgatttagaaaaatcatttttctttaaaaaataacagtacataaaaagaaaacattctcggctgggcgcggtggctcacgcctgtaacccagcactttgggaggctgagacaggcagttcacctgaggtcaggagtttgagaccagcctgaccaacatggagaaactccgtctctactaaaaacacaaaaattttagccgggcgttgtgccacgttcctgtaatcccagctactcgggaggctgaggcaggagaatcgcttgaacccgggaggcagaggttgcagtgagccgagatcgtgtcattgcactccagcctgggcaacaagagcgaaactccatctcaaaaaataaaaaataaataaaaaa

SEQ ID NO: 10966 - DNA, 5507 bp, Homo sapiens
ccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacaggtatggccttccaggacagcagaccagcagctgggttgagctgggtgtctttttttttttttttttctgagacagtctcactctgccgccccagctggagtgcagtggtgtgatctcagctcactgcaacctccgcctcccgggttcaagcgattctcctgcctcagcctcctgagtagctgggattgcaggtgcccaccaccacgcccggctaatgtttgtatttttagtagagatggggttttgccatgttggccaggctgatttcaaactcctgaactcaagtgatccgcccgcctcggcctcccaaagttctgggattacaggcatgagccactgcgcccggcctgagctggatgtcttgaccgttacttaggagtcgggattgcccctcttttctttgccactcataggcacccattctccttgtgcctgctgcttcagagccacctcccccaggtgaatagtggaggaacaccattacacatgaaacgttcatgatcctccttaccaacatcaacatcaacatactttttcttttttgagacagggtttcactctgtcaccccgggtggagtgcagttgttggatcacagctcactgtagcctcaaactactggcctcaagtgatcctcctgcctctgcttcccaggaagctgggaacacaggcacacactacaacgtccagctaattcctgtaatttttgtagagtttctccatgttgcccaggctggtctcaaactcttggactcaagtgatcctcctgcctaggcctcccaaagtgctgggattacaggcgcgagccactgcacccggccccaacattctttttaacaaacccccagcgctctgtgattccctagcgtttgtcagaggttctatccttagttcaatacaagataaaaacaatataaaatacaaatataatacaaagcaacataacagtgccagagagcactgtgtggattattcttaggtcacaaaacacagattctcaaagcaaatagcctcctactttctccccagatccatttccccataaaagcccacccaacaaagaaaagcaatgggaaagctgaggggaaattcctcactcttgagtgcctggccaggggaaggcatgcgtttttttttttaattattcatttatttagttattcatttttttgagatggcgttttgctcttgttgcccaggctggagtgcaatggctcactgcaacctctgcctcccgggttcaagtgattctcctgcctcagccttccaagcagctgggtttacagatgcacgccaccatgcctggctaatttttatatttttattagagacggggtttcaccatattggtcaggctgatttcaaactcctgacctcaggtgatccacctgcctcagcctcccaaagtgctgggattacaggcgtgagccactgctcttggccggcatgtagttttattttattttttaaataaagagatgggggtctccttatgaggcccaggctgatcttgaactcctgggctcaagggatcctcccgtctcagcctcccaaagtgctgggattataggcgtgagccaccgcgccctgccaggcatgtgatttaaaagttcatagcttgctaaatattagaagctattagtcttatgctgtagatgaagaaactggggctctaagagtattcttatatctctcagtggtactaagtggcagagctgatattttaccatgcttactgctttcttgaaaaaagaggccgggcgaggtggctcatgcctgtaatcccagtcagaagttcgagaccagcctggccaacatggtgaaaccccatctctactaaaaatacaaaaattagccgggtgtgatgctgtacatctgtagttccaggtactcaggagcctgaggcaggagagtcatttgaacccgggaggcagaggttgcagtgagctgagatcacgccattgctctccagcctgggcaacaagaacaaaactccgtctcaaaaaataaaaataaaataaataaataagggtaacgtgcattaaattctttaagaagtgtctgggacctaccatctaggaaccagaacatctagggtgctttgagaccctaacatctagcacagggcctggcacattttgttgaaccaaacaggctgagtgtcttggcatgactaagttcgatacacaaaagtaggcttgcagcctgtcttccggctgtcatcaaaattcagagcttggtgtgggacgccgtcatcctgtctgaatttgcctctggatcctagggcttggaccatcaaagtgctgttgccacggaagcagcggtacagtagtctgcgcttgcctattgagcgtcctttgcccgtcacagttacccttttcagtagccctcgttggaattttccttctggtggtttcttaacctccacttacttccccttttcgtttcgtcatccgcagaggctccggggagaccttggggacttctttgtcggctgcatcttcacggcagaactgagcactccgtttgtgtcgctgggcagggttctgattcaggcatgtatgaatgaaatgacagagagtgtgagggttctgattcaggcatgtatgaatgaaatgacagagagagtgagggttctgattcaggcatgtatgaatgaatggcagagagagtgaaggttctgattcaggcatgtatgaatgaatggcagagagagtgagggttctgattcaggcatgcatgaatgaaatggcagaaagagtgtgggagggagtggattctgcttttccttcggagatggtgggtgtggagaaatccctagtgccaggagagtgggatgagagatccttcaacagccttaaaggtcagctggtcatctcagccagtgggggtgaaattgtaggtttgatctaagtttgatagtttgatacagctcattctattttttccctggttacacacatactttaatccacggttcctgtactcctgtcagctgggtggcctgggtcaaattcaaaatcactattggagaaaatgaggttatttgcacatctcaatatgatagtgttcaagaatgtcttctccaagtgttagaaaactagacaaacgtctgggcgccagggaatctgacagccaaggtcttgatgagcacctgcacctgtgtggcatttactgtggtgggacttgggcccgtcgctccctgatgcccagcttcttggtgaccttacctttttccttcctcttctattgcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcaccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 10967 - DNA, 10785 bp, Homo sapiens
caggcacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggtaagagcccgggccggggccttgttgcaaatgtcacatttcagtagctcgcaggctctggctctcgcagcacacgcgctcagaaagctgactaatgggaaaagctggcaccacaatgggctccttcttcctctccggagtcttcgggcacccccagcttaggagaaagtccacggaaatgagggaggacgacagagtcggagtctgatttcaggtggtgtgagccagggatccaggtccttcatggaagagataagcgtggaagcatttacgactgggagtgtggcttgattcttgcagttggcttcactgggttctcactctggagcatcactggctaacagacgtccagtgtggttagcagagccccctccatggaaaggaaccaacccaccacccccttccacgcaaacgccgctcttgcttttcctgcagatttgctaaaggtgattgagaggttcccagcgcttagaacacggacttgtacgtctatcagaggtcagtccagaggcaggtcaggaaatgtgcacctatctgcagttccagtgaaacaaatcataaattaagaccagaatagtcgactttgtacagtagttagacctggacaatggtggtgcttttattatttcaagccttttttttccccaccggtcttgctggaatcacactcactttctcccaagttgaaggaccacagtcggatgtgcaggaagttgaacggcctttccaggccctgctctcctgtgggctctgccaagtcctgcttctcacctgctgagactgaactgcgaggggcctgagcaagctgtccgtctcactctagcctgcggtcttacctgggatcaatcctgctgtcatgatttttgtgcttttcttctgcctttttaaaaacaaaactggctattggcgatgaataagtagatgctacgatagatcaagtgacatcgattgtagacaccaaaggttaatattggtgtggctgggtacaatttttcttcttcttcttcttcttttttttttaaagacagggtctcactatgttgcccaggctggtcttgaactcctgggctcaagtcatttttctgcctcaccctcacaaagtgctgggattacaggcatgagccaccacacccagcaaattttttactttttttttttcctgtcgagacctcaggctgaggtgcagtggcataatgacagctgactgtagtcttgaactccagggttcaagccacccgtcttccttagcctcccaagcttggactacaggcacacactactacacctggctaacttttttttgttgttgttggtagagacaggggtctccctgcgttgcccaggctggtcttgaactcctgggctccaacgatcctcctgcctgggcctcccaaagtgttgggattataggcgtgagccactgcacccagccaaaaaaggcctttcagggttcatatactatatactgaatatttttctattatatgccttctcattttatgccttcacatagaatgcgattagatagaaggagttaaaaatccccccaaattataggcagaaggtggtatggggccaaggatttagtcagattcttaaaggattcagacactaaaatgacaaagtcacagctccaggtggttttctcaatttaagtacttaattcagatagtacgttgttgttttagacagggtctggctctgtcacccacgctggtctgaactcctgggctcaagccattctcccactcaggcctcccaaagtgcagggatcataggtgtgagccaccgtgcccagcctgtatagtaccttttaacatttaaaaggactccccctccccgccgcctttctttttattgagatggagtctcactctgtcactcagactggagtgcagtggtgaggtctcggctcactgcaacctccacctcccaggttcaagtgattctcctgcctcagcctcctgagtagctgaggttacaggcatgtgtcaccacgtctggctaatttttgtatatttagtaaagccatgttggccaggctggtcttgaactcctgacctcaggtgatccatccgcctcggcctcccaaaatgctgggattacaggcatgagccaccgtgcccggccgactttcccacatttaattatttaatcttcactgcagttttgacaggtaagacagacaaggattatcatcttcattttacaaagaaagttaaatcacaggctagtgatagtgaagattataatccagatctcttgctaataaatcttcagaggattctactcatgagtcacaatttcagatctcttctctgaattggtgaaaacatgaaaaccctaggttcccttcaaggggagaggccagttatatttcagctaaattttagtagctgtttataggtattttacttgaaattgcttgaagaaagcacctgagaccatagatgggcattggaataagtatggcatctttttggccaaaagaaacctagctaggtcgggtgcggtggctcctgcctgtaatcccaacactttgggaggccgaggtgggcggatcacttgaggtcaggagcttgagaccagtctggccaacatggtgaaacccccatcgctacttaaaaagaaaaaaaaaaagaaaatagccggacgtggcggcaggtacctgtaatcccagctactcgggaggctgcggcaggagaatcgtttgaacccacgagtcagaggttgcagtgagctgagatcgcgccactacatccagcctgggcgacagagcaagattttgtctcaaaaaccaaaaccaaaaaaaaaaaaaaaaaaaaggaacctggctaatgaattcacctacaagtgtgttatacttgccattacttgcttgccttatttgtttattcattatttacgccgtggtaagtgtggagttgctcaagagcacaaattcagatggcgcctccgtagactgtatttccagtgttgcagttcagcggactggctgcgtccgaaatcagagacaaagttaatacagatttcagggccctcggcttacaatttagaatctctggggactggagcgcttaacaagcactgcaggtgattctgatgttcaggtagtttgagaaccataaaacgaaatggttttctacctaatacgtggatgcgcatcaaacgtttgctgaccatgtgaatggaatcctcaaatagtacatgatttcaatttagatgtttcttcacagaaaacatctgtggaatgcttatcactgggaaccacattgtatgaattgtagaggcttcccttctaatctgctctaggacggtgatcaactatgatttccattcagcaaatactgattcagcccctttggataagtaaatgggaaaactgtcttttgacctagcctctctcctggtacctaaccgctgtaatgtggcccttgagctccaggctcatttccagacctgcttttttttgttgtgttttgtgtgttttttgagacggagtctcactcttttgcccaggctggagtgcagtggcgcgatctcggctcactgcaacctctgcctcccagattcaatcgattctcctgcctcagcctcccaagtagctgggagtacaggtgcacaccaccatgcccagctaatttttgtatttttagtagaaacggggtttcacaatgttgataaggcgagtatcgaactgctgaccttgtgattcacctgccttggcctcccaaagtgctgggattacaggtgtgagccaccacgcccagcctccagacctgtttttcttaatggaattgagattatctctagaattgctttttgggtttttttgtttttgttttttttagatggaatctcactctgtcgcccaggctggagtgcagtggcgcaatatcggctcactgcaacctccgcctcccgggttcaagtgattctcctgcctcagcctcccaagtagctgggactacaggtgtgcgccaccacatctgactaatttttgtatttttagtagagacggggtttcgccatgttggccaggctgatcttgaactcctgacctcaagtgatccacccgcctcagcctcccaaagtgctgagattacaggtgtgagccaccgaacccggccagctctagaattgtaaagaaaatggccagggttgcctcccagaaactccatagagtggggttgcatgcagacaagagaaaactcacaggttccaggatttaagttagtaaaacccccaactgttgagcagctaaggagttaaactagaaatgttggatttgtgatttgggacactttccaaaccagcttcttggtggggccgttgaatcatttgtatatctatctatatcaaaatcagttttatcacaaaatgccagaacatctactacaaattagtagctaagtcaggcaagtagtgacagcaagctgcttcaacaggcagggctgagtgaatgcctgctttttgcctttgacactcacgaattggccctgaaactgagagcaagtggtctactctccctgtttatcagtttcaacatctttattgtaaagtatttggaataataatagctgatcaagcaccaagcttggctgtgagccttcataatggatatccacaatgatttcacgggccattcatatgctttctttcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacaggtatggccttccaggacagcagaccagcagctgggttgagctgggtgtctttttttttttttttttctgagacagtctcactctgccgccccagctggagtgcagtggtgtgatctcagctcactgcaacctccgcctcccgggttcaagcgattctcctgcctcagcctcctgagtagctgggattgcaggtgcccaccaccacgcccggctaatgtttgtatttttagtagagatggggttttgccatgttggccaggctgatttcaaactcctgaactcaagtgatccgcccgcctcggcctcccaaagttctgggattacaggcatgagccactgcgcccggcctgagctggatgtcttgaccgttacttaggagtcgggattgcccctcttttctttgccactcataggcacccattctccttgtgcctgctgcttcagagccacctcccccaggtgaatagtggaggaacaccattacacatgaaacgttcatgatcctccttaccaacatcaacatcaacatactttttcttttttgagacagggtttcactctgtcaccccgggtggagtgcagttgttggatcacagctcactgtagcctcaaactactggcctcaagtgatcctcctgcctctgcttcccaggaagctgggaacacaggcacacactacaacgtccagctaattcctgtaatttttgtagagtttctccatgttgcccaggctggtctcaaactcttggactcaagtgatcctcctgcctaggcctcccaaagtgctgggattacaggcgcgagccactgcacccggccccaacattctttttaacaaacccccagcgctctgtgattccctagcgtttgtcagaggttctatccttagttcaatacaagataaaaacaatataaaatacaaatataatacaaagcaacataacagtgccagagagcactgtgtggattattcttaggtcacaaaacacagattctcaaagcaaatagcctcctactttctccccagatccatttccccataaaagcccacccaacaaagaaaagcaatgggaaagctgaggggaaattcctcactcttgagtgcctggccaggggaaggcatgcgtttttttttttaattattcatttatttagttattcatttttttgagatggcgttttgctcttgttgcccaggctggagtgcaatggctcactgcaacctctgcctcccgggttcaagtgattctcctgcctcagccttccaagcagctgggtttacagatgcacgccaccatgcctggctaatttttatatttttattagagacggggttttgccatattggccaggctgatctcaaactcctgacctcaggtgatccacctgcctcagcctcccaaagtgctgggattacaggcgtgagccactgctcttggccggcatgtagttttattttattttttaaataaagagatgggggtctccttatgaggcccaggctgatcttgaactcctgggctcaagggatcctcccgtctcagcctcccaaagtgctgggattataggcgtgagccaccgcgccctgccaggcatgtgatttaaaagttcatagcttgctaaatattagaagctattagtcttatgctgtagatgaagaaactggggctctaagagtattcttatatctctcagtggtactaagtggcagagctgatattttaccatgcttactgctttcttgaaaaaagaggccgggcgaggtggctcatgcctgtaatcccagtcagaagttcgagaccagcctggccaacatggtgaaaccccatctctactaaaaatacaaaaattagccgggtgtgatgctgtacatctgtagttccaggtactcaggagcctgaggcaggagagtcatttgaacccgggaggcagaggttgcagtgagctgagatcacgccattgctctccagcctgggcaacaagaacaaaactccgtctcaaaaaataaaaataaaataaataaataagggtaacgtgcattaaattctttaagaagtgtctgggacctaccatctaggaaccagaacatctagggtgctttgagaccctaacatctagcacagggcctggcacattttgttgaaccaaacaggctgagtgtcttggcatgactaagttcgatacacaaaagtaggcttgcagccttccttccggctgtcatcaaaattcagagcttggtgtgggacgccgtcatcctgtctgaatttgcctctggatcctagggcttggaccatcaaagtgctgttgccacggaagcagcggtacagtagtctgcgcttgcctattgagcgtcctttgcccgtcacagttacccttttcagtagccctcgttggaattttccttctggtggtttcttaacctccacttacttccccttttcgtttcgtcatccgcagaggctccggggagaccttggggacttctttgtcggctgcatcttcacggcagaactgagcactccgtttgtgtcgctgggcagggttctgattcaggcatgtatgaatgaaatgacagagagtgtgagggttctgattcaggcatgtatgaatgaaatgacagagagagtgagggttctgattcaggcatgtatgaatgaatggcagagagagtgaaggttctgattcaggcatgtatgaatgaatggcagagagagtgagggttctgattcaggcatgcatgaatgaaatggcagaaagagtgtgggagggagtggattctgcttttccttcggagatggtgggtgtggagaaatccctagtgccaggagagtgggatgagagatccttcaacagccttaaaggtcagctggtcatctcagccagtgggggtgaaattgtaggtttgatctaagtttgatagtttgatacagctcattctattttttccctggttacacacatactttaatccacggttcctgtactcctgtcagctgggtggcctgggtcaaattcaaaatcactattggagaaaatgaggttatttgcacatctcaatatgatagtgttcaagaatgtcttctccaagtgttagaaaactagacaaacgtctgggcgccagggaatctgacagccaaggtcttgatgagcacctgcacctgtgtggcatttactgtggtgggacttgggcccgtcgctccctgatgcccagcttcttggtgaccttacctttttccttcctcttctattgcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 10968 - DNA, 299 bp, Homo sapiens
gtagagacaggttatctctgttgcccaggctggtctcaaactcctggcctcaagtgatcctcctgcctcagcctcccaaagcactgggattattacaggtgtgagccaccatgcctagcccactctcaattttttttttttttgttttagacagggtctcactctgtcaccaaggctggagtgcagtggtctgatctcagcttactgcagcctctacctcccaggatcaagtgagcctcctgctttagaaccctgagtagctgggactacagctgtgtgtcaccacacctagctaattt

SEQ ID NO: 10969 - DNA, 102 bp, Homo sapiens
aggctggagtgcagtggcgcaatatcggctcactgcaacctccgcctcccgggttcaagtgattctcctgcctcagcctcccaagtagctgggactacaggt

SEQ ID NO: 10970 - DNA, 299 bp, Homo sapiens; identical to SEQ ID NO: 10968

SEQ ID NO: 10971 - DNA, 52691 bp, Homo sapiens
aactttcttttcctagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggtatgtactaaaaaaattaattttgagttgaagaagtgctttgtcatcatacctttttaattcttttaaaaaataatttataatcatacatatataaaaatcaagtgcatttttgtttgatttcttctatattaatagaaatttaaagtttcacttaaaggaggaattttatttattttttattttagattcaggggtatatgtgcaggtttgttacatgggtatattgtgtgatgctgagatttggacttctaatgatccatcgtccaagtagtaaacatagtacctgctaggtagtttttcagcccttgccctcctctctccctaaaggaggagttttaaaaacttctgagattaatccttttatctggttcctgaaacataaatttaaaaacatattgtactgaacattcaaaatcctctcttctagcttttcgaaaccctatctaaattattgttaaccatattcaccctacagtgctatagaacacttgaacagaagatacaaggggcaaaaaaacccaaaaatgttgtaggagaagcagctctggaagaagaatcagtagacctgaattctagtcccagatctttactgagtgtctgccatggtgctaggcactgggagacacagtagtgagcaaaatgggcgtggtcttagttttcacagaactcatagtgtagagtagcactttctcagactttagtgtacataagaatcacctgagaatttgattatgtgcagattctgattttatgtgagaccaaagatcctgcatttctaacaagttcgctagtgctactgatattactgattgggtagtagcaagggatcagcaagctttttcttgaaagggtagatagtaaataatataggcttgtggtccatatggtctccttggcagctcttcaaccctgccattgtagcacaaaagcagccacagataatgtgtaaacacatgggtgtagctgtgttccattaaaataacttacaaaaataggcaaccagcccttactttgttgatccctggtttagagaatacaggtaattgcaagcaattgcaataagaattttgggataaaggttttaatagggaattaagtctgtacaaagatctggtctaggggctgtcagggaaagctgttctgaggaagtggcatttaagctaaagtttaaagggtgagtaggcagaagggacagggaaggaagagtgttcattcagaaaagcaatacttgagatccaaaagcaagagagaacattcacattatgatgtattcagtaacctggaggaatttctatgtggcagtcagtggtaagacatgtggaaagagtcttatttttaaaacttttccttattttagcaagaagccattgaagagttttacacaggtaagagactcattatttcatggtttagaaggataattctagcagttagatgaattccagatacatctggaagatagattcaatgggacttggtatttattgcttggggggaaaggagaaagaagagtcaagaatgatactcaaattttaggcttggacaagtggtgaggttcttcactgaaatggggtacattggcgaaagaactcttgggaatggagaggggaaagatgatgaatttatttgggacatgttgaatttacgatgcctttaagacatccaggtggaattgtcctatgagtaggaggatgtttgtgtctaaagcctggtgttagaggtctgagttgggggttgttagtgtggagatggccactgaagccattggaatgaatttcagagcagcataagaagaaaagaaggcctagaacagaaaccagaacaccaagagtttagggataaacagagaaaaagggcttgcagacaaggctgagaaagagtagcaacatataggataaccaggattgtatgatgttattagaaggctagggaagggtgtgtttgaatgagggagtagttaatagtgatgtctgttagcaaaatgtcaaatacgtaaggatgtaagtttcaatgagtttaatgacaaaggactcatctatgaccttagctagagcaattttattgaaatggttgggtggagaccaaatagcaatggtttgaagcaggtaggaattgaggaagtggaactggtgagtatgggattctctttggaaaagaatgactatgaagggaagaagagagtgggccataaatgagatgttatcttagtctattccagctgctgtaacagaatactttatatcagttaattaacaaacaacagaagtttactgcttgcagttctggaggctgggaagtccaagatcaagatgctaatagatttcggtgtctagagagggggtgtttctcatagatggcaccttcttgctacaccctcacatggcggcaaagaaagggcactcccttcaactttttgtaaaatggcattaatcccacttatgaaagcagagccctcattacttaatcacttctgtggggataccaactttcagaccatagtgggtgttttccaagatgagagggacttgaccatgtttaaatgtaatgagtaggtgctagtaaggaaaagtgaaaataataggagagagaataattgactgggaaaaatccctaataaggtcttaatttgattatgttttttaaacatgtctgctctttgccaaaggttgttttaagaaacaaactacagaaacgtaaagccatatataattttaactgtagaatagcttttgtactttaaacagtttcaattataaggaagggggcatattactataacttcattcagacagtaaactgttcactgatttctactcagcataaatgaatctcgtacaaaaagtaaaagaatgcttatgcaactatcatgtttaattatacacactactgtataattaaaaatctggtttttttggaaagctttatagtgatttttccctgatgaaactgtttagtgtttgaactgatatatgttgtcttactgaaattaccaatagtgattatttaaaacgatagcaaattaaacatttgaaatgataaaaatctgtctttatttttataaggatagagttctgtttagttgtatgtttatttggcttctacttaccttgtttggtcatttattcatatctaattaatgagagtaagaagtaagctttactaaagctgcattaaaaattaatctgaattgatggccagtgcccacaagttaagaaggtgaatgggccgggcgtggtagctcatgcctgtaatcctagcactttgggaggccaaggtgggcagattgcctgagctcaggagtttgagaccagcctgggcaacacagtgaaaccctgtccctactaaaatacaaaagaaattagccaggcatggcagcaggtgcctgtagtcccagctactcgggaggctgaggcaggagaattgcttgaacccgggaggcagaggttgcaatgagccaacatcgcaccactgcactctagcctgggcaagagagtgagactccatctctaaaaaaaaaaaaaaaaaaaaaaaaaaaaaacgtgaatggtttgcatctgattctgagggtggtgtaaagtttaaggtagatttttttttttttctcttttaggttttacactcgtcatttgcccattgatctctcttatggaagaccaattaatggttttaaaacaattaggaatttcagcaaccatgttaaatgcttctagttctaaggtatgtttcagtggcttttttttttttaatgtaaactattcactgaaataggagctttacctgcagttgagttgcttataaaattataaactgttaactatttatatcaggagttacaaactactgctcttggccagttctggcccactgtctatttttgtatgtcccatgagttaagaatggtttttatatttttaaatggctaaaaaaaatctaaaaagaatattttgtgaaatgggaaaattatttgcaattcaagtttcagtatccataaataaagttttattgaaacaccaccatgctcatttgttgacatgttgtctatggctgcttttacagtataatggcacagtggagtagttgtgatagagaccttatagcccataaaacctaatatttttgtctgatactttacaggaaacatttgctgacctgttttgtattatccattctaaaatagtaagggagaattgctaattatgcagtgtaattaaatatgaaatatgaattattaagaagttaccctatacctgtggaatttcttgtatttaggaatggactgtcttaccctcatctgtagaataaagcatttcccagctattcttttttaaaaagcatattactgaaatcttcaaaaggagagagaatagcataaaaactgccatgtagccatttcccccttcaacagttatcaacatacggctaatctttttttttaatctgtatacctccagttttccctacccctttcctcttagtttatttattcagaacaaattccagacatcatattttaattgtaaattcttcagtacgtatctctaactttaaagaaaagtgctgtgccatcatcacatctaagaagtttaatcaattctttagaattataaaaaaaattcagatttctatctcatttttatgttttttttaaaaaaaaatatagcccagataatattcatgcattgtattgtatttggttgatatacccataggttctctttatatcttttatatttcccatgcaaattctttgttgaagaaactgggttaactgtcctgtatctttctacattttcctgattgcgtccttgtggtgttctttctttctctctttcttttcttttctttctttttctttttttttttttcagttctggggtccatatgcaggatgtgcaggtttgttacataggtaactggatccttttagttagatctaaaagcctgattgtatttggaatttttctttaacttttttttttttttttgcaagagtatacttactgtggtatcactcaagtggtacatagtacctggttatctttttgtgatgctaagcgtcagtgggttcaagtgatgtctgcctgatctctggttatcagtttttcatctaatggttttagcagccactgagtggcaccgtgagagccatgatttcattagggaggtgcaaaatggtgatatctaattctgtcactctttcttcatgtattagttatactttttctacaaaaataaactttttcctcattaactctgcatgatgaaaatgcttgatttttttttccctttctttatgagttttcagaaagagttggttttctagcattctccaaaggtggtcaacaagatttttaaggttttctttccccaagtatcactataaacttacaagctttgacgtataatatgattcacctttggaatcatatatatatatatatcaatatgtatatatgtaatgctgaaatagtcctgtccttgggcagtgagagcctctttaagttggttcctgaatcctttctcttaaccccattgcttctgttccttgctttcttttgcagtaagataatccatgttcattttatgcatttcctgcccagacctagagtcagccatacctctaagaagccctggttcctttagtttacccatatatttttgttttatttaaactccatgtcattctattataactgctccttcctccaacaaaatcaatctgtggagaaaactgccttctaataatgtactttcttaaaattgaaaaagaacataatagtaatagaaagtaatttagaaagttgcagataattacaagttcatgatatatccctactcttgaaagttggagagagaaaaaaagaacatctgtatcctagaatatatctaggagttaacaaactgcttctttgctgggatgatgaaagtagtttgactgtctctttctatctcattcactggcatgtttttatacttttttggtcctctttagattagaaggaaaaaaaatgacatctaatatgctaagtattgtatagaattgtatgagtactaagaatctaataactgttaccttttaagatttattattattatcttaatttaatgagtgatactttgtgaaaccccatggtctttatatttaaataaagagattaaaagatttgatggtatcatttgagaagttaataaataataaattttgttcacatacataaagggattataaatataatgttaaaattaataaaacccacctttataaccataacaattgcatctagctcacattttagaatatattatgaacaatttaggattatgccttcatagaataaatgctcttcattggagtatctgtttgtgttcttttttgtcaagtgagttttttttagtcatcaacaatgtagacgttagtaaataactagaatgctatttacacagctgccatgatgtttcgtactgagacatggtttcagttttaatgaactaaacatctgctcctagaagagccaaaggctattattgctttggagaaatgaacgttttcatttaccacctagtatttcagtctgctagcttagttttactatcattgtgtctatttttttcttttaataggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctggtatgtatgttttatctagaaaactttttgatgtcatagaccgtgtccttactcagcttggcatgatggaaatctctgcttctattaaaatcatcctcaagtagttacacattgaatatccgttatccagaatgttcggaaccaaaagggttttaaattttggatttttttggatttgggatgatcaacctgtattacttattttatcttgcctcattatgaggaggactgagaggcagaatgtttagtttcattccccactgtagtctgtagtttaattgcccttgtcaattatggacaaatatggacacatatgtttactagccaatagtggacatctttgtggcatttatgacatctaggtattccttcacatttgttgaagaatttgcatctgtttcaaagttgtcatctttagtcatcattctgagggtcttttcagcacccacatacaactcctcagcatgaaactttgatgagatatttttagtgacctttttcttcaccccaccacctaatcctacagtcatagcctaaagtaagttactcagaattgttatatgcaaaaaaatcttaaattcaaaaatccgactccctggcttcaacctgttttccttctgaagcttttcacacattaggatttgctggatccctcttttaatccctgcttatttatccaggctcctgtccctacatagcaatcactctgtttcccgtccagacactgtgctgttgccccttacttctgttatatttgccctggactgcctggccattctgccagtctgcttcaggcgttgtgcctgagatgctggattcatctagactttggctttccccattcctgctgcttggctactaaacattgtcaaaaaaacaaaaattgcataactccattcagcttttcattatcctcagccgtccttatacttgtccctatttcaactcctttatacatttcttccaacaaatgtctcctatcattaactttctattcaggccctaacttgtacttagcagatgctttctgcttcacagaaaatagatgccatcaggtatgaacagctcctctttctactttcaaacattagtaatcttttttttttttcttttgttaaggcagaaaagaccactgctttataaggctaaccatgaccactcccgtttcatcctttcctgccttcttaagatcttgcactgccaaattcctcactccttcaccttcaggctcttttgtcctctccctaaaaacagaaactaaaacacccttctgaccttttaatgttactgtcctctttctgttctttctgtcaccatcagacttctcagcttaccatctccatttttcacctttaacccattctgaactcattgaatcatgcttctgccaccaccatactactgaaacaggtcatcggtgacccacccccagatgagaccacttcatcaagtggtctcatcttcattcctcttcccacttcacttcagtaacattttatatattcacctctcaccttgccacattctactcccttggttactgtacagcagtgctgttcagtgtcttcccttccattctcacctccttcgctcttcctgtcttctttttaaatattagtgttccctagggttctgacctcagtctttaccctttcttacgtttctccagggatagtgagcttgtagcccgaagactgcattctctacctacagaattattatgggcattgtttttatttatttatatattttaaatagatttaaatgccttaaacgggatgtatacgcctttctattaagggcccctcttttcttaaccagatagcgccacatagttgttacctggtggccactgaagttacctgatttgtgactcttgccctattttcaacctaaatggtttgatcccttatgattatcacccttgcttaagtattaccatgacttatgttgtctctgtggatctgctgccaaagtgtaaaacattattcccatatctaattagctaactgctaaactttaaatttatactcctaattgtttatcagaaatgtgtatctaaattagcatgaccaaaactaaattcccccaaaagaactgctctttttcttctcaactgggaatattttccccataactctactcgacattctaaccaaaaactttttgttttcttcgcctttcctttctccgttctcctctctactcccaagcaatttccccttcagtcttctctgtcttaaaaaatcatccactcactcacatgtttgctgaagccaaaattttagcagttatctttatcatttaggttccagtcaggagacagttatttgaacagagagaattttttagaaagaattgtgaactaggtaaaaagtagctaaatagataactgaaaaagtaaaaagaaaacgaagatatcatggagttaaaaactggaagaagcaacaaccacctgtagggctgggagaacaggaagaaaagattggaacaaataagacttagaaacttaatgaagagggcttgtggaactgagctccctggtgctggagtctcttggtagaggcagaggtggggtacgtctgtgataaagctggttctccaaaggctgagaaaagtgccaactgtatttagttgctcttaaggaaagaagtgctgctgcagggatgagaagccttgcaggggtgacagtcacaggaacacaagcaagcccacaggaagcagttagggaggaagcagccatggtgtcttccatccagggccagcaggcaaagctgatgcgtagtgtgcagagtccttggtgcagcatcccaaagcacagtatagaagggtggggttagagatgacaaaaaaaaaatggatgacacaccgtccttgatttaccctccctttgcagatccagtccaccactaagtgttgtcagctctgcctctagaatgaatctcaagtttgtctactctctgtgcacctacgtcttacatacagttgagctcccttccactggtctactgcagcagcttcctaagtagtctttgattccgttcttacactttttgttcattctccacagagcaaccagtgatattttctaaatacacatcaaatcatgttacttccctacctaaactacccagtagctactgtgtacttagaataaaacccagcgttcttaactggggcccatagggtaatatgtgatctgcccccatctgtctacctgatttcctactcttcctctcttcttaagccccagcatactgggcttatcattatgagcacttaccactctctaatggcatatttattggtttactctttgtattgtcttgtttctttgcttgaattatagacacatttgcatagcatttttgtcttgttcatcactttatcttcagtgcctagggaaatgcttggcacacaattaaaaaggtgttcaacatttatctattgatgaatgggtaaatccagcactgtctccctcttccctgccacctccatatcccagtagtcactaggacctgtaggttcatgtatgtctctttactctttttgatttatcctgaatgtcatgtctcattttatattctgtattatttgttttctggtctgttactgccatcttttaactggttttccttcagtgttttgtctattccagtctgtattttgcactgtcaccaaaagatgatttatgaagcataggtctttaaaaattacatgatgggctcggtgcggtggctcacgcctgtaatcccagcactttgggaggccgaggcgggcggatcacctgaggtcaggaattcaagaccagcctggccaacgtggtgaaaccccgtctctactaaaaatataaaaattagccaggtgtggcggtgtatgcctgtaatcccagctactcgaaaggctaaggcgggagaatggcgtgaacccgggaggtggagcttgcagtgagccaagatcgtgtcactgcactccaacctgggtgacagagtgagactccatctcaaaaaaaaaaaaaaaaaaaattacatgatgattcctcatttcctgtaggataaagtctcagcttagaatcaactggttgaattgttcatagcttttcttaaacctgccttgtacataacagtgtcagtcagggttcaggcagagaagcagagtcacgatgaatgttatgggataacggttttactgtaggaagtagatcttgaacaattgtgggaggaactggggaagtgcaggtctgaagaggggagttggaggattagagaaaagtaatggattgatacctaagcactggtgcaggaggacgaggcggagcttgtagggaaatctgcagctggcatgtacagtggcaaaggggacccctaaagggaagctcgtggaaaggtctctggtaagctacttcctgtgagtagctatcgcctctgtgggtctgctgttgattggcaggacctgcagttgggaggaacagctgaatgaggaatggaaaagaactaggatgacctagaactggctgagcacttctgcatctgtccatcatcctctctgcgtgtaaagaccttgaaggagtgatgttagctggttcacttctgccaccaaatcttgcacaagtccctcttttgggtcagctctaacttggaacaggaaagagattctgggagatgtaattcacagcttaatggattggacagtaaatccatccaccacaagactctgtgacttagccccagtgaactgcttgctgttatctgaacatactaatttcatgtcagtgtatttgcagtgtatatgctgtttcctctgcgtgatgttcgtctcttcctagtgaacttctgctcattctcttaagacacaactcaagtattatctccttgaaatcttcacttcccaagcagctgctctgtcctctttgttttcatagtagtcctctacttagcatgtaagcaatttctaccacatttttttcagtttcctccaaatagtttaagtgacaatttatctagtgatgtagatgcttataacaagtttgagcctagaatggtttccgagaaataggttatatacaaagcagtgccgcccttaccaagatttttttggtctgatgacactaggtggtagcaggggtttgtctgatggcctgttttatcttttgttagttgtaataaattaaaacactgtggctatacccactgtctcttgagtccaccgtgaccaagagtaatgtctgaaataaacgtaataaagcctgcccatcaaagaggctaacacagaactgcaaatttactgctatagatggctgtggaaacaaaatcatagtagtcatcgattatctgcataatgttaaaagatataatttactctaactcttaaaggatagaaaaagggccactttgtttgttttttcagattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggtatgtaatttttatgtcaattccttacttttgtgaagaattacgcagaggggatctgcctttttattatgtttatttacatgagcagttaagtacttacaaaaatttttaacattaggaggtaattataagtagattctgtgattagggcttcattcatgtatcttttgctacataaacctttgttagattaaatggaagacacctgctaggtgatactttttataaaacatatgagtaagtcatatatctttgttaaatttctgtatgttcttttttgtataaagatggagagaaaggatggagtgatactaaggaccctaataacatctctgttcaaattaattactaagtgatagaagtattcatatgccattaaagatttgccaattctatttgaattttatttgataaacttgaaaatcaaataacctaacagctgtcttttctttctttctaaacccttttaagaatagatttaatatttttctgagttttcattaaagagttatttatgttacggtttgtttttataaaagtagcatcgcaaaataaaaaagtctgcatccttgcaagttattcactgctcatgtgcttgctcttctctggtaaattaaaaaaataaagatcaagaagagtctgggaggaggaacagatgagtcagatgggttgaatcctgtgagtaagtgaaagagtaataggaaaaaaaacactatggtcatgaaagaactgcatcctgaaagttgtacatagacagccacttggatggtactcattcatttactttttaataagttaagttttttttaggttcggcagaagccctcaaacactgaagattttattgaggatattgtaaagctcattaatgggagatacaaagggcaatcaggtaatgtaaaaacaaaccaactttggagacagagataactttcaaaaagtgacttcatatcatattgataattatactgataactgaataacaccaaaaaaaattaatgtatagcagaagatacttgaaaatacgtgataaaattaattcacttgatcttagaaattgggtgtgacatttgcttatgccatagattatgagtcgtcaaattgcctgatttatttttgcttatttacacttgctttagaatagacctgatgacttaatgttaattatcaacagcacatatttagtatgtatccactgtgtacaaaatagtggattaagcaactgatattctaaagggatagaaaatatactcccttacagtaaaggacacgttaaagcaataaataaatccagtagtacatactgaatagattaagcacagatcgagttgtgagtatatatacatggttttctgggtttaatgactaagcaaatgttactgaagcaaagaatttgtgtgaaagtagcattttaaactgttctatagattttcaggaggtagtcctgggtaaaaggagttctagggtcaaatgaatttgagaaaggttgcaggtatttattctgcctggatgttcacagggtgtatcagcaaactagaagctctgaccatccctgaaaataaagagagacacccatttaactttgttgaatgcaatgttctccaaattaatttgcatgcaaattaatctaaattaacccaaaattaatctggagaacactgcattcatagcacatttgttagcatcttacagacatcagtttgagaaatactgtttagtgggagataaagttaaagagagaaaagagataacaggaacaaaaactgatggctcaggctcatttctgctttaaaggaagctggtgctcaaatctggaattataccaaaatgtcaatatatgcacaaggccttgaaatttttcataattctttttttccttctgtgcattgtattaatcaatgtcctgaatgtgtgtgttgaaaaccatcttccaggaatatgccatatctatctaacaaatgcacatattttactgcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggttaggtctatatcttccatagaagcctaatttacctttaaaatatttaaacttgatttaattaactgataaaatgttaaaatatttcaggtagtagtggcaactgttgcatttggtatgggaattgataagccagatgtgaggtttgttatccatcattcaatgagtaaatccatggaaaattattaccaagagagtggacgtgcaggtatgtaggactcaaatccagaagtaaatttttagaaagcttttccaaaaaatacatgataaatgcttaataagtctgtatgttttatctttattggatagtatttttagaacaatgtatttttagcagtttgacacttacttgcatatggagaaatttttacttatgttctgttatctgaattgtttctttttatgtgtgttaagataatttgatgttcatctttgcctcctgaatttttaattagtgatttcaaatctataacttaactggattatagacacattttttaacttagtagagctgattattgatgtctctttagagttttttttaatttgagggtacccattacaaattaacttccacatctctaaaatttctagatgtagtataaaacattgcctgctaattttaccatatgtcatttttgcatattttgaatttgtaaatgtaattctgcaatctcaaggtttctcacaccacaggtcgagatgacatgaaagcagactgtattttgtactacggctttggagatatattcagaataagttcaatggtggtgatggaaaatgtgggacagcagaagctttatgagatggtatcatactgtcaaaacataagcaagtaagccacatacctttttataacttttatcaattaaagcaaatatgaaagtatatgacatcgtttttaagttcttactaaatacattggtggaacaccaaagtgcagatccataaaagcagatgttggagggtaggaaccagcacatcaacctgtatgatctgccttagttcaagaaaagatgccctatctttgagataatcctccaaaactacttttttaattgaaggtttttgagacacattgatagcaacttgaaggctttttttctctggcactgctgtacagttacatgatttaataattttgaaaaggtctatggttaagataggcattttgagagtcaagctcagtaacgtgccaccttgccagctcatgtgtcaatgaaataccaagtttctccttaagaagtaagtttaaatctacttagggtggctttagactagatagcttcctgaaagctttctgtcatagttatctttgtgcttttattgcctatcacataagaagtgctcagaaatgtcgaggtggtaaatagcagccagacagtgatagaaatgttctttctttccaatagatactacaataatctagttaaaagaaatgagaaaatgaaaatgtcttccaaaggccagtagagtctcatgaagcatattttaaggtttcaactcaaatattgctactttattaaaatataagaaactattttactgtcaagaatattctcctaatagttgcaaaacattgaatttaaaaatggaactcagacaattttttaaacagtgtttatcaagaatatgtggggaaaaaagtcctatgtcgggggcacaatggccccccaaagatgttcacgtcctaattcctaacctgtatgttacctcacatggcaaaaggaaagtagcattgcacatggaattaagactgttcattagctgaccttaaaatagggagattattttagattgtgtgatgtgagaagaacctgacactctgattttgatccagtgaaacccatagtacacttctaaatctaaaccacagaaatgtaagaataaatgtgtttaaagccactaagtttatggtaatattatggcagttataggaagctaatacagtatataactatgtaagctgaaatagagattcttaaaactttattatatcctttaataatttgtatctttaaatgtgtttgcagatgtcgtcgtgtgttgatggctcaacattttgatgaagtatggaactcagaagcatgtaacaaaatgtgcgataactgctgtaaagacagtggtgagtttgttgttttgtaaacctttataggctaatacagtcataatgcctagtgacagagatacgttctgagaaatgcatcactaggtgattttgtcattgtgcaaacatcaaagtgtacttacataaacctagatggtatagtctcctaggtgatatgttatagcctattgatcctaggctaccaatctgtacagcgtgttactgtactgcatactgcaggcagctgtaacacatggttaagtatttgtgtatctaaacatagagtaagtacagtaaaaatatggtattataacctgggtgacagcgagactccgtctcaaaaaaaaatatatggtattatataatctcttgggaccactggcatatacgtggtccatcaccgaccaaaatattatgtggcacaaaactgtatatacagctgggacatgagagaagtattagacttccaaatggatttaaaagattaaagtgtgaatcagattttccagaattaaaactatcaacatgaagttttgaaacaaaggtgaataaaaggaaaagtcttatgtgtatgcacacattttatattgctatactgaggatgtgaaatttttaataaatgaaggaaaatatttgaatttttctgaatagaaatgctattctataagaaaagggaaaccatgtgataatctctaatactttatagtcactaattgaaaagaaaatttagtgcaaaatagagactatagagaatcacttttgatccagttaatggctagtcatcggagatttacttaaaattcttttaaatgtagatcagcaggatttgttttctgagcattggtcacaaccctgctgatcaaaacaggatctggtcaaaacaagatatagcaaagaaactggcccaaacaagttagaactagaaaatataatgtatttgcatgatgtaagacactcccactagcaccatgacagtttacaaatgccgtgacaatgcccgaaaattacatggttctaggaactccctaaccttttctagaagattcatgaataatcttccccttatttagcatataactaaggagcagctataaataccgctagtgagcaatgtacagtgccactctgcctttggggtagccctgctctgtctatggagccgccattttcctatactctattgctaataaacttgctttgctttcactttactctgttggcttgctctcagattgtttcttgcatgaaactgggaaccctcctgggctgagtcccaattttcggatttgcctgcagcattttggcactatattttaactttttttcatccgtgtgttgtatttcaagatctggactagccagtacctcatggtaagaccttactgagttctgatgccttgttaggtggaagccactgtatttttaactttgcagacagagaaatttatgagtttattagactatcttataaaataacaagagtgttatatataaatcagagtactggtctcttaataattgggttatcagttgaggacattcttgttgctaaatcagagttcactcaggagcctatactagaacagacagggtctcctataaaacacacctcttagtaacttagtaatcatgtctggcagacactttctgatttctagagtatatggcagggcttctgataaccaatttttttttatatatatcactgtaaaccccacaatgcttacagagaccataacttggtctagtgacagagacttgaggaatagcctagtcttaattcagaatacatttaaaaatcaatgtttagggtggctcacattgataaccagctttaaaccagtttaactacttaagatagcctatctttgccctcatttctaaatcctaattacctgctaccatatttgttttattacagcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaagtatgtacaaactcattcattattctttcaggttgtctttatggtttttttttaaaaattgcaacagaataaacggttttgcagttattttgtgtgaacttttaaatgctatagaaagtaatttacctaaaacactcaaactttaatcactataaataaaaaaaagtaacgaaaatattttctttaaaggctttatttgcattcttgtaaattttattatttcaagtcaatgtgttaagaattactgcgcatatagttatttcttttataaatttgttttccgtgattccttcaaaagctttcttattgttggcctttattttctgcagagaagactacagttttacagcttatgctaccatttcgtatttgaaaataggacctaaagctaatcttctgaacaatgaggcacatgctattactatgcaagtgacaaagtccacgcagaactctttcagggtaaatggctattaattttcagttttatatattttaaaaagtatattaaagcctatgggatgcttttctgtcatattcccctaggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgttttaaaccaaatactatcaagtctgcaaaagcatgtcaagtcaagtgccattgtgtctaaggacatttgaggtctttagaacttctctcacaacgtagccccttttattcaaaatagagctcatatttgaatagaaatttgtagataaaaaactagacccctgtatacttaaaaagccaactgatacagaaagaatattttgaaatatttaatctcatgagaaaactgaatagctggatttttaccaaggtgcttgctttgttttttttttttttttgtaggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaacttagaatttatgtttttatatttttccactaatatcattatcacttctgtaattttcagtgtggtcatcattaactcaatacagtcattcattttattgacttgtgatttttctggtgtcatttggaactttatatgattcctgaagaaattccatttttagtcaaaataatcttctatatcaatatttggatctagcagatcttctccatatgatgaaagattcatttggtttaagattaggttttcaaatgtttcttctaaatcggtttcaccaattaagacagctcccatcattcgtccattttgcatgacgactttgatgtattctcgtcctttggtacatctcagcattaattcatgatctgaacctaagccctgtgcattgtattttcccagcagtacaacctatatttagagataaaaaggttattgtcatgagtatcataaagaaaatgtaatgggtagttattttgtgtcaagtttgaatagccgcagaaaacttatgccacaaaatttcataactaaaaatgttattggggagagtcccaaagaaaatgtttcaacagcatgcgttaattctacagatgacactatcacacactctacactgacattaaaaaattctggtgaatatagtcaaatgttaatgtttaatattttaacactaaaaatatctagtgaatataggtaggtgattctaccaatctatatgaacattaaaactatacagtaaatatataaatatgtaggatgtggatacattaaaccatgtggagtcgtggtttaaagatttggcaaggaactgaattagagctttcatggaaaagtttcttaatttccctgaggcttttgaatatgtttctccttctctgtaaattagggaaaaaaaaaaacccaaaacaacctttgtcaatgtgaagaggactgaataagataatagatacaggaaagctcttggtttatttttgagtacaacagcagttagttcccctcacaaagaaaggatgaatcacaagtaaaagttaaaaatgcaccaacaagtaacagatctagagagaaatttttttccctcttaactaaaatagaatagtggtaaggtggataattatcagatgattagggattaagactagcaataataccaggtattggtttgtaagaaatgaaaaatgtcatttttttgtagatgattaaaactatgtacgtttttattcaagcaagaaaatcacatgatttatcatagtcataagactaacaagcagagaaggcattaatatgcttaactatcttaccttatagttaaaaaattttgtcacatgagcaaacagttcaaagctgaaatccatgtcaatagagtctcctgaactcgctgcagccatgcactttgctgcataccatcccatctgtctagcctgggtccacagcctcatctgaaatgatgaaaaaatgttacacaatgtcatttttcatgatcattatctgaaaaatgttaaccttgtaaattcacttaaaggagttcaatgtttgacagtctttctgtcatctttgccacagaagcagtcaccaatggataactaatcagactgatttttggtatttgttaattctatctaaattactgcctctaaaattaaaagatgataccaatcacacctgttttagtagcatttctattaaatattatgaaactatattaagctataccaggtgagaaaaatgttttaattaaccagtcccttcttcaaaaatttgtcatcaccattaacagagatgtcaaattatcactgaagaatttgttctattttccagcaaccttcatttttatgcactacttaaggtctgctgtgctgttaacctcagtggttagacagactcttggtgcctcaccaagacaacataaatatctcagcaactgattctgggaagtcatttaaattgttttgcatgaccgtattaattcatctattgtatttttattttatttctatgaagttttgagactccctggtataaaagaacacggcctttgacaaaattcaacaacccttcatgctaaaaactctcaataaggtattgatgggacgtatctcaaaataataagatctatgacaaacccacagccaatatcatactgaatgaacaaaaactggaagcattccctttgaaaactggcataagacagggatgccctctctcaccactcctattcaacatagtgttggaagttctggccagggcaatcaggcaggagaagggaataaagggcattcaattaggaaaagaggaagtcaaattgtccctgtttgcagatgacatgattgtatatctagaaaaccccatcagctcagcccaaaatcttaagctgataagcaacttcagcaaagtctcaggatacaaaatcaatgtgcaaaaatcacaagcattcttatacaccaacaacagacaaacagagccaaatcatgagtgaattcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactgtactacaaggctacagtaaccaaaacagcatggtactggtaccaaaacagagatatagaccaatcgagcagaacagaaccctcagaaataatgcctcatatctacaactatctgatctttcacaaacctgacaaaaagaagaaatggggaagggattccctatttaataaatggtgctgggaaaactggctagccatatgtagaaagctgaaacgggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagtcaaaattaacaaatgggatctaattacactaaagagcttctgcacagtaaaagaaaccaccatcagagtgaacaggcaacctacagaatgggagaaaatttttgcaacctactcgtccgacaaatggctaatatccagaatctacaatgaactcaaacaaatttacaaaaaaaaaacaaccccatcaaaaagtcggcgaaggatatgaacagacacttctcaaaagaagatatttatgcagccaaaagacaaatgaaaaaatgctcatcatcactggccatcagagaaatgcaaatcaaaaccacagtgagataccatctcacaccagttagaatggcaatcattaaaaagtcaggaaacaacatgtgctggagaggatgtggagaaataggaacacttttacactgttggtgggactgtaaactagttcaaccattgtggaagttggtgtggcgattcctcagggatctagaactagaaataccatttgactcagccatcccagtactgcgtatatacccaaaggattataaatcatgctgctataaagacacatgcacacgtatgtttatagcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccattattctcagcaaactattgcaaggacaaaaaaccaaacaccacatgttctcactcataggtgggaactgaacaatgagaacacatggacacaggaaggggaacatcacacaccggggactcttgtggggtgggggtgcagcacaccaacatggcacatgtatacatatgtaacaaacttgcacgttgtgtacatgtatcctaaaacttaaatataataataaaaaaaaaaaacactgaccttgggagtcacagtggattttaatatcaacagatctacatatatatttaacttttctgggcctcggttcatttacctgaaacgtaaacataacactacctactctgtaactattgagagaattaaacaggttagcgtataataagcacttggtttccttctacctccctgtatgtgcatatgtacttaatgctgtcttttgtttgcagaaataatatcataatcatagacatgagttttaagcatttctagcagaagtgatagatttttttttttcaatctcctctgtaaacaaggtattatagatttgatgaagtgaaaggcagtttatggctgggggtcagaataaactgagcacagtaacaactagagaacagctaatacaagtggccggaaaatttgcatcttgaactgcataaattagtatccttattgcttgtgtaagccaagaaatggggcctataaggtgcactcaaaacaaggccatctgtttattttcggattttttcccctctttcagattataacacattaagatataatttaccctagagaattaaaaatgttaaaaaaaaaaaaacccataaactccaactctaagaatttgtgatagtcttgccacagaaatgacatagaatgaggcaggttagaaacaaaaaggctggaaccattcttactgatgtctctactgtctgtaagaacacaaaatgatggtgctgcctcttgaaatacttttagctcttctcctacttcacactgcataatctgaatgaataatgtccctaactgtggagctggtctttaacaaagataaatgttgcctggttcctttatttcaaacatctacctaggtctctacccctctgcacacctctggtcactgtctttatcttcctctagtatttttgttccaccgttaggaggaggtaggtaaagctgtgagggtaggaaaaagtctagatccagttgggacttgttaaggctcaggaaaggtgtttactacaggaatttttttttttttttttgagacagagttttgctcttgttgcccaggctggggtgcagtggtgcgatctcagctcactgcaacctccgcctcccaggttcaagggattcttgtgcctcagcctcctgaatagctgggattacagacgcacaccatcatgctcagctaattttttgtatttttagtaaagacggggtttcatcatgttgttcaggctggtctcaaactcctaacttcagatgatacacctgcctctcaccctcccaaagtgctgggattacaggcgtgagccactgcgcccagaacattttttagtaatgattaccacagggacagaataggatcataaaggaatagaatgcttttctatataatttacaatcttagtagtttttttaatctaaagttgtgctgtccaacatcgtagccacatatatttaaagttaatgagaagtaagtaaaaataattcagttcctcagtcacattaaccacatttcaagtgctcatgtgacatactgctggctacctgactagatggtgaggaattaaacatttccatcatcacagaaagttctcctggacagtgctgataagcaggtaagaatgaaaaacaaagtaatagcccataatttcttttaaagtaaaagatgtctcagtctaccattataatgataacttaccaaacagggaaatattctagttttttttttaaatatatataacaactgtgctagcttcctacttaagcagaaaagttggaaaaccagaagttggatttgttggtaacaaccgctttattttcagacagaatctctgatgaaaacatataattatatatgctagcttacctgctgccagactgggctcagctgccaggatgtagtacagatgtcaccggcagcatagatatcaggaagggatgtgtgcatatgatcatccactttcaggccaccatcttctcctagatcaaactaaacaacattcctcataagcgttaagtgttaagaaaaatgaaacgactttttccattttaaagtaaaagaacaaattaaattgttacactttgcatgctcatctttaatgagaaaatgaaaaatatcagcaaagtttagacacctgagctgaatttccatggatcaaattccaactaagactgatccataaaactgtcagaatttcaacatgaaaagtatccaataaccatgtgactaccttatccataactacaagaatattctttttttttttttgtaagcttcaagtgctgaaaagcaaaaaatacaagatggtttctctaaaagaatcatttttgagaagtcacgggaggtgtcagtctcttaccaacatttagataaataaattgtacattataaaccattactgatgacgcttatgcaaggatataactatgtaaggattttaagcagtaaaaaatactgtaaatcaagacaatgttttaaccaaactgtttccaaccatgttaagttacagttgtacactaaaataataattattcatgtttgagaattagagatcttcacaaaaatacttcaaatatattcacagctggacaaaaaaatttcaccttacactgttaccatggagaaaaggttctacatttggtgtaactcctgtagcactgacaatgaaatcgcagccatatatcttttcattggtcaattccacatagacaggccacatctctttaagaaaaaaaaaccaaaaaaacagactttatttgtaaatggaaccatcaccacagcagtgtatgtgactacaatgactagaaacaaagaaagaaaaagaaaggcaagagataactttgtaacacactccttagcaattattatgaggcatatttgctaaagcaattttaatgcaattagcatcatctcgtttgggtataattttaaaaccatggcattttaaatgtttttccttcaaatttggacacataaattttgacaaagtacatttaaattatttctaaattatttctctaaaaatcttttgtaatactttacactccacttaagtgtttagttcaactaggtgtcttccctcactactcatattcaaattcccctttcctatggaaaaattcaaagaattcagaacagtagaatatttcatatgctagttaactgagtgtatttcttcaaatcatggcaattctcagaggagttgtggaactggagttaggagagctgcatcttagtcccaaaaatatacattttcaatctgatttgggtgaaatcatgtcacctttaagagctctaggtttttgtcttattttgatttataatatattctgattgttggtcaaaacactcagctctatgtaagatgtaatgccctatacgatttaatttactagaaaacaacagacagtgaaatgaagtgagttaatgttattaaattatggttttatttttacttttcatgtttaaattttatatggaaatacgaagttatttttaatagaacacagcaggattaaattgttttccttttaattaagtggttatatatattttttcttatttcattacttgcctgtatcagctgtaactgacttatggtctcttggaaaagtgaaggactttttcttcaaaattctaaactcatcctgaaggtagattttctttacttcacacatagtttcaaggtgaatcttatgagaaaactaaaattaagaaaatactggttagcataatacttacagaaagaataacccgggttactaatgatgaagaaaaaacgtatacttgtagaaatgtatagaaaacataattcttataatataaatgaaaccacattgggtgccctaaaataagtctctctatgcacatgaaaggagtgaacaaaaattcattcagtaacttaagagatctggtagctgcattagcagatagcatcgagggaatgctttttagcctaggcctcattgataattacaaatgcattttttaaaaattacagtagttgttgggcacagtggctcacgcctgtaatcccagcactctgggaggccgaggcgcaggtggatcacctgaggtcaggagttcaagactagcctggcctatatggtgaaaccctgtctctactaaaattaaaaaattagccaggcctggtggtgtgcgcctgtagtcccagctactcgggaggctgaggcaggagactcgcttgaacccgggaggcagaggttgcagcgagccaagatcataccacagcactccagcttgggtgacagagcgagactctgtctcaaaaaaaataaataaataaaataaataaataaataaataaataaaaatttaaaaaatgacaacagttatggactataaaattttcttcaggtcagttctgacttactgtcgtatccctgaacattaataaagtcccacgtaggtagtaaatactcaataaatgcttattgaattaaactgttgaagttctcaggttaaaaatataatattaggatctgaaggtgcaagaagaagggactttgtgtaatttccatcacaaaaattagatacaccgtgcagccagctcccctcctacctactgaaagccaaaaaccaatgctctaaagaaatcacacaaagtaacgaaggactgcatgcatgcttcttacagcatttagatttcacagccctttaacaactattaaaaaatcaaaatatctaacaaaatgaggaaaagcaaatcatctccttatccaattagggtattaagtgtgtatttccaatccatctaataacttttgtaagtttactgcatgcatctgaagtgacctttgagaaaagattaatttaaaataggacaggagtattcactgtagtctgggtatagaaagctctatccctgatctgaggatataggaaaaaacaaactcagtttctcctactatagtctcacaacacagaatacttctgtgaccaaatgtgtgtggggtgttttctacacactaagcaagcaattaattctgcacaggacaccatctggctgtcctctaattcaattcagttctgatgttattatctacctggagatagcatcaggtcccacatgttgagggatcaatctcacaagactgtcttccacttccaataccaattgcatgccccgggtgttttaccagttggtctgactaaccaaccataaatcaaggggctcccacgagcccctttcttaggttcaattaatttattagaatatctcacagaatttggggaaacactttacttacatttactggtttattatcaaggatgtcacgaagaaacagatgaagaaatacataaggcaaagcatataagaaggggcatgaagcttctatgccctctccagatagaccaccctctagcaacttccacatgttcagctatccagaagctctccaaacccagtccttttgggttttcatggaaactgtgttatgtaggtgactgattaaattactggctgctagtgattggcttaaccttcaacctctttcccttcctgtaggttggaaagtctaaactctaatcatgtcttggtctttcctgtgaccagtccccattctgaagccacctaggggctaaccagtcaactcgttagcatacaaaaggacacatcactttggagatgccaaaaattttaggagttgtgtgccagaaaactgcagacacaacattttattgtgcttcactactgttttgcagatagtgtgttttttacaaattgaaggtttgtgacaaacccacatcaagcaagtcttatcagtgccatttttccaatagcatgtgctcactttgtgtctctgtcacattttggtaattcttgcaatatttcagttttcatcattattagatcttttatggtgatctgtgattagtaatctttgatgtactactgtaattgtcttggggtgtcatgaaccacacccatctaacacagtgaacttaatcgataaatgttctgtgttctgactgctccatcaaccagctgttgtcctatgtctctccctctccttgggcctccttattcccggagacacaagaatattgaaaccagggcaatcagttactctgtagtggcctctaagtgttcaagtgaaagtaaggatcacacatctctcactttaaatcaaaaggtagcaatgattattagggttattgaggaaggcacatggaaagccaggcctcttgccctgaacagatggccaaattgtgaatgcaaaggaaacattcttgaagtaaatctaaagtggtattccaatgaacacatgaatgatgagaaagcgaaacagtcttcttgctgacatggagaaagttttagtggtgtggagagaagatcaaatcagccacaacattcccttaggccaaagcctaacccagagtaagcccctaactgttttcaattctgtaaaggctgagagaagtgaggaagctgcagaagaaaaggctgaagctagtagaggttggttcatgatgtttaagtaaagaagccatctctacaacaaaaatatacaattgataactgatgaatgtggctacactaaacagtagattttcagtgtacatgaaacagccttccagtggaaaaagatgctatctaggaccttcacaactatagaggagaagtcaatgcctggcttcaaaggacaggcagactctcctgttaggggataatgtaactggtgacttgaagttgaagccaatgcctatttaccactgtgaaagttctagggcccttaagaactatactacatctaccctgcctgtcctctgtaaatggaacaacaaagcctggatgacagcattatatggtttgggcctggttctccacccaaatctcatatcaaattgtaatccccaatgttggaggtacggcctggtgggaggtgactggatcatggggacagtttctaatagtttagcaccatccttagtgctgttttcatgttagagttctcatgagatctggttgtttaaaggtgtgtggcaccagcccccttctctctcttcctcttgctctggccatgtaagaagtgcataattccccttcccccgtgattgaaagtttcctgaggcctccccagtcatgcttcctgtacagcccgtgggaccatgagccaattaaacctcttttctttataaatattacctactctcaggtatttctttatatactgtgagaatggagtaatacacagcacatctgtttacatagtttactgaatatttgaagcccaccattgagacctactgctcagaaaaaaaaaaaaaaagattcatttcaaaatactacactcattgacaaggcatttggtcacccaagaactcagacagagatgcacaaggagatgaatgttgttttcatgcctgctaatacaatatccattctgcagcccatggatccaggagtaattcttactttcaagtcttattaaagaaatgcatttcataaggctatagctgccacagatagtgatgcatctgatggatctgggaaaagtacattgaaaaccttctggaaagaattcaccattctagatgttattaagaacattcatgattcaagggagtaagtcaaaatatcaacattaacaaaagcttgaaagaagtttactccaaccttcatggatgactttgagggattcaagatttcaatggagaaaggcagatatggtggaaataacaaaagaactgtaattagaaatgaatcctgaagatgagactacattgctgcaatctcatgataaaatttgaaaagatgagttgttgtttctcatggatgagcaaagaacgtagttatctgagatggagtttacttctggtgaggatgctgtgagtattgctgaaatgatgaaggatttaaaatattacatatacttggtaaagcagtagcagagtttgagagaattgacttttgaaagaacttctactctgggcaaaatgctataaaacagcttcgcacgctacagagaagtctttcacgagaggaagagtcaattgatggggcaaacttgttattttaagaaattgccacagccacccaaaccttcagcaagcaccaccctgatgagtcatcagccaccaataccgaggcaaaactttccaccaaaaaaagattatgatttgctgaaggctcagatgattgttagcatattaagcaataaagtatctttaaattaacgttatgtgcattgtatttttagacacaatgctaatgcacatttaatagactgcagtatgttataaacataacttttgcaggcactgggaaactgaaaaattcgtgtggctcactttattgtggtatatcatttcctgtgatggtctgggactgaacctgcaatactccaaggtatgactgtatatatattacagtatcacacctcaagagttaaaacgtaggctgagatccagtcttcgatgctttgacattcagttttctttggtggccaaatggaccaactgcattggaggtcttttcctaacactatggattttaagtaaagtgacctaacagttcgttgactatatatttattaccagtctttaataaatggttcaagaatttaaaattacatttagacatgaccaattagtatatgaaaagatacctcttttgttcctttaagattcaagccttcatgccaatctggtcccaatgcacttcctacattatctgctttagatttgcttctagcttcctttttccttcctaaagagatgaaattaaataatataaaaattaccagatagagaaatatgttagtgttctgaagttttttatttaggcaatgtaatgattcatatatatacatacattacagcatgactaacctatgttatctatattaatcattttagtcattaatatttttctgatgtagagttacaaaacagataatctttcagttgtgtgttgagtataaacacactcaacttacgttttggatgttacacggttaactggaagggtaagaaaattagccttcaaatttttataattttatatatttttagcacctccaaaatgtacaaaactcttgtttaattttataatctaaaagtttttcaaagctatcaaacttaaaaaaatatgaagtttgtattagtttttcaactcactgcattttttacaaaacttcttcaggtattgccaaaatgtagtatctgtttgcaaagatgcagatgggctgagttattcaatttattttaaatttcttgttttaattatatatatatatataaaatacatacatatatataaaatagaaaatctgaaaacttcatgtaaagatatataaatatccatattactatttccaaaatttattttattaaattttcttgtagcccttttctatatggttttaaaaaagttttgtatgagaattaatgagctaggtgctacacttaccttcagttgtatatctggttcttttatgtgcaattttagcctctgatttttcagcaatgagctttgaagtcaagaattcagctgctcctgcatcgaagaaagtattccctatagctttatctttaatggcccaaatcacttcacagccttcaatttcatacctaaaaacaatgttaaagttactaagagtgatttcaaaagtctaagtaaaaaatctttgcatttgcaaataatgatctcctgaagcaaaagtagggaatacatttttaaggctaactgggaaagattgattataaagaggaatattaacgttctttacagatgttaagaattaaaaattgaatagtaaaagaatctgaagcagtttacagaaagaacctttaagtgacaaatacatgtactgaatatcaagtaaaatttcattacagtgtacatcattagaaaatgttcaatttctacaatacacttattatatgaatggcccccaggggtaagcagtgctttttaaaaaatctggttatagtgtaatcaagtaatggatggatggcacatagctataatattgagaatcagtcacttatttggtaacaactttttatatcttcaaagcacattacggaaagggatagaaaatggaaagaatcagagttataagctaaaaatcttaaggatcaagatcaaggatcaaggatcttagaggaaggaaagaatgaaaatggtatatataagccaccttctattactatttaccactaatgtaaggtaatgggcatgtgatattttattctaggtttagatgctaagaagtggttttcctaacaatattcctttcacaaagtccctgaagtccattataattaaggtgatcacataatttatcacctaacctgggatactatctgctactaataatcatttttggtacaactggtggaaatggagacaatcccagacaaacaagatatatggccatcctaactataataggattttatctaaacttgcgatactaataaaatactgtaaaaagttaaggtattaatttttcacatttctttacggtacaaagtattgtcatctttatttcacagactgatataacataggttacacgacttttcaagactaatcaataaacagattacgaaaaaaggtttagtacatctgaatccaggtcacttgatattcatacttttcaacatatggtgataaggaactccttgctttacctaataagtcttcgtttttccagctcttctatgtcagtaaacatagaagattattgggtgaacattctattttatgttactctggtcatatagcattactgaccagcggaaagtggaatacacacaaatttggtaataaagtttgtatttcaatttacatacaggcatacagttatcatgtaatgctttctttttgaaaaactgggaatttctctatattaccatttttaaatttaaagtaatattacactataacacctatcagtgcacttcagcatactgatgactgactagcagacaaagttattacaagtaaccacaagaaacttcagtacttgctctacctcctaggacaccttctaatcctcttttcctgacttgaactatgttctcagcaagatgcacagtttgacgattatcatcacacagaggggaaatactgctttcattttgaaaatgactctacagaagcagacaatgagatattacggttttgtgaagttatgaaaaacagtatctgtttgaaaaggaaaggattaacttacacttagaaaggagaaaacagataataactgaaataaatgtataatgaagaacattagtattagtttcactgaaacacagtgtagaaagggtatgggtatgccaagtttcacgagagacaaagacctaatcacgcagcagacctcaagtcagagaataacattatgtgggtccatttttaattaccaaagaagagcttactaaatacaaaactatgagttttatccaattatacagtcttcaatctccaacttaaagaaaatgatgaataggattaaatgtaagactctgaacatttttgaacataaaatttttaaatgtaaataacaattataataatagtaagtgatactttggtgagagctgatagagaaaatctggcatgtatatactatacacaaggatttgaagccccatttacaataaatctatacctcttccctcttggcccacattttggttttgaccctttctctgtatttctccatataatgccacaaacttcataataacaataatgactgttacccatagtactcaggcaatttaagaactcttacaggcttccactgggtgagatcatccgctaaaagaggggcaaaaacctagtctgagagttggattgaatgcaagtgagcaaagatatggctttggcagagtccttattttgattcaaatttgtcctctttgtggtttgactcaactttatggcctgaaaaagatccagactatttcatgtcaatcatctgctagaggataaaatcatgaagtgaatcaatcttctgcaggacacagcaggatatttctcaatggtttttgaacttgtaatatcgtcttaagatgaaaattaattaatgtgttcacatttcccaagctaccaaaaaaagagctgcaagaaccacatatcctaaaacaggagtcacaaacattttgggtgacactggccagacaggtaacataaatgagtgtagcaggatttatcatataagcaataaaaagtggtgagggctatcactagaaatctcaaaaggtgtaaatatttgaattatttttaaacataaaatatacttataaaacacatttatgggccaaatttggccaatcaccttgagacctaaagcattcccaaaacatatatattttataataaaatttctacaattacggattccacaagagctaaaaaaatatggtggatttttccccttgaaaacatatgaaaattatatttatctttgattttcagaataaaaaacattttccagtctgccaacaaatcacaagaatcacaaagcaattgtttaatttaaaaacaaattatttttaaacaatttaaatgttatcatatttaaaaatatatacttacactaactcaagtgcaataccaccgttccctatgatcattattcttttagctttagtaagctgtttctgaaattcctatgttaaaaagaaaataatgaggtagtattttgtaatagtgggcaataatctgaaatatgaggcttcgataatattctaaaaatgtaaatattttattgaatttgtaaaggaaaaaaatgaatctcactttcccactgtatcagggtacatcctctcaattaatataacaaaagtccccctttatgctttatcccaagctgcctttatagcaatgcctctcctgattttcctttccttttaggtcattacatttacagtacttcagaatttcggcaggaggcactattaacttaccacattcccaattatttgaccaaatcaattattctttcttttcacctagactctcagtttccctagagttactcaacacttaaaacttctaggaatgagaagctcagcagcatagtggttaagagcacagactctggaagcactggctctagcaattactaactgaatgactttgggcaagttgcttaccctatctgcatctcaggtccttcaactataaatggaaataagggactatatatcctaatgtttctgtaaggattatgtgagatgacacagacaaagctggtaggagtagcacgcacccaataatgtcaaacttctactaaaaaaaaaaatgttattaacattctaagacagatacattgatgcctccaccccccagaaaaaaaagatcacaatgagcttagagaagccagtggtaaatgtaaatgacagttaaagggtgcagcacaccaacatggcacatgtatacatatgtaacaaacctgcacttggtgcacatgtaccctagaacttaaagtataataaatatagatatattaaaaaaaaaagagagagagaagccagtggtaattctttgggcactttcagaagtatagaatagtcccactgcttcagaatgacatctggccctcctactaaatttatattaaatttatctccaaacttataatattcactgaagctgacatctttaaaattctccaagaaaaaaacaactgaagtttatttcagtttgtccttcattgaggatattgcaatttaagaaacatctgcaagagcactggacctagaggtgaaaagcacaagtttaaattgtgtatctgatagacttaacagctaaattagtatagatacatacttaatctcttgacctcagtttcctatttgtaaattgggagtaataatcgtcacacaggattatcatgaggattcaatgagttcatgtatgtagaggaccgagctaaaacagttatgagctcaatctctgataatatgaacttaaattgtttataagaagataatcaagttcctttaattttctctcaattcctaattattaagagaataggctgaaagaaaacattattaaattttcagaatataaattatattaatgcaaaatcatcatgtcatgagacagaacaacgaacttgaggttagacatagtattgtgaaaccaggaagagcttcttggcaataagggttaataagccctgaattaaattaaattaccaaaaggaatttgtataatgctccaaaaacagatgtttcaccttattgggatagtttatctagggcagaacaataagccaagtgaccttttctgttctatgattctatcatgattttgtaccacaaagatcttttgaattttttttgctggagaataagatcagtacattttgaatacgcttcacctttttggaaaaaattgttatattatttaggttgcaaatcacatattccccaagtagagtaatgaatgtgtgtgtaatataagttgttaatattcagcacagtcattatatctgggttatctcacgctgataacacatcagcatgaacttaaaaacatagtgtcaactaaaaatataaaattggcaggaataggctgggcacggtggctcacgcctgtaatcccagcactctgggaggcctaggtgggcggtcacgaggtcaggagatcgagaccatcctggctaacatggtgaaaccctgtctctactaaaaatacaaaaaaaaaaaaaaaaaatcagccaggcgtggtggcaggcacctgtagtcccagcttctcgggaggctgaggcaggagaatggcgtgaaactgggaggcggagcttgcagtgagccgagactgcgccactgcactccagcctgggcaacagagcgagactccgtttcaaaaaaaaaaaaaaaaagaaagaaaattggcaggaataaaacataaccactctgtggtttactggtcatgaaacaaaaatttcccttctgcccttacagtttaggaattgtaagtggaacactttaattcaaatgtagaaaattcttttattttccttctcacgatccaaccttaaaatgttacctgagcactgtctgtatcacggattcctaatacataaggatttccttcacatatcaactttggtttagctccagcacacagacagagtttcttatatacgtgctgattgccatcttctgttacaatgcactgtaaatacatcaaacaatgaaagaaaagggagacacataatcaacatggatacaacttcactttaaactaaaaattcaataaggcaaaagcaaaacataatatattaaggttgcctcttggtggcactcagttctttgttatagcaattacaaaactaagcatgagaatacatgtactaatccagttattcttaaatcattttaagctcatgaaccattttgagatctcctgaaaactagtctttctcccctggcataaaaaggtacattcacacaaagttttgtattaaacttcagggaatcccatgttggttgaaaaggtatgttgaccccacgttaaaaacaaaacttcaagaaatttttaaatttaagcattctcattatacctgtgacaggccttgatgaagatttctgatctcaagggaagttactgtaagaagacctagtaattctaaccatatcctaccttcatatctattatgagtacagaaaagcagtgagtggaacaagaggttatggtatgtcttcttaatctaaaaagactagaagtgcttaaaaaaaatagtacttatattcttaagtacaaataatgactttacgagcaaaccaaatgcttttggggtatattttagtataagtaaaaaatatgataatctttaatcctagcatgtattggctttaaatttatattaattaataacataaatgggtctaaaactacatatcagagatatattgcttttgttctttaatactgaatgaaaaaccacatataaatagtagcctttagaaaacatttaaacataaatgcatgctactatgagagatgctcaactttgttcgaatgatttaggggttaatgtttgtgccaagtgtttgacttacaaaccttgttaaactgtatcatagcacttaacatccaatgagacatttataactcaaattaattcttcagttccataacaaatacataaaaccagtaatccagcatagcataatccatgtagaaattttatacaagtcttcttttaaataatctggttagaatttcaactgacaagaacaaaagttaattataggcactgacaaaactttaaaaataatttgcatttagctgctgtaaaaacaaatagcacaaacaaacacaaaaactctttccattagctactgctaaatttttggcaagagacgtgaaagtaaaacatactatctctaattcactaaaaaatgtaaaggacacttctccagacggaagtgagccacacactctgcgtcctcgcctcactaggaaactactgaagttcctggggaagcacagtagcatttcataagaacaaaatggatggggaagagaaaacctatggtggctgtgaaggccctgatgccaggtatgtgaaattgatatcatctgatggccatgaatttactgtaaaaagagaacatgcattaacatcagacatgataaaagccatgttgagtggcccagctcagtttgctgagaatgaaaccaatgaggtcaattttagagagataccttcacacgtgctatcaaaagtacgcatgtgttttttttttttttagatggagtctcgctctgtcgcccaggctggagtgcagcggcgtgatctcagctcactgcaatctcccgggttcatgtcattctcctgcctcagcctcccaagtagctgggactacaggcgcccgcccccacgcctggctaatttttttttgtatttttagtagagacgggatttcaccgtgttagccaggacggtctcgacctcctgacctcgtgatccacccgccaaggcctcccaaagtgctgggattacaggtgtgagccaccgcgcctggcagtatgcatgtattttacatacaaagttcgctacactaacagctccactgagttcccgaattcccaactgcacctgaaatagcactagaactgctgatggctgccaacttcctagattgttaaataaaagaaattataataaactgttaaaaaaacaaaaatgtaaaggacaatggataagagaaggcagacatgcactgcatgtgggatatttttcaaatggtaacgggaagcactctgattcattcaaatgccctaacacataaattccctgacaatccatttagcatattttgagagcccacctcaatttacaaataaattgacaaatatattacttggaatatgtaataccactataagtattagaaacttatctggtttggggattcagattttttattttttcctgataaaattcagtacttttttctctcaaattacttgtgtttcaaatgtggtatatatgtgttttatccctaaaggagataaaacacatctctaatttatgagctagaactcataaattagaactgcttatagaaacaactacaaatctacttctcatcttacctgaagctcatctgaggatactgtaaatcatctaacaacatcctttcctgagactgccttcttcattctcatgtaaagggttattgagtcctgccaaatttatagcagaaatctcactcaaatctgggatattttttacaactacattgtccctgtctcagttcagaccttacatcatttttcaaatcaattttttaaaaattattattatcctttttgagacagggtctcactctgttgcccaggctggagtgcagtggcgcaatcacagctaactgcagccttgaactcccaggctcaggtgatcttcccacctcagtcaccaaagtagctgggactacaagtgcacgccaccatgcctgattaactttttgtatattttttgtagatatggggttttgctatgttgcccaggctagagtcgaacttctaggctaaagccatccgtctgccttggcctcacaaagtgctggggattataggcatgagcctgtacataatttcctgactcttcacataatttttgactatcataaccaccttctagtttggttggctactagccacttgttcatgctcaacactcctatcagatgtatcttccttaaaaaaaaaaaaaaatctattttatcattgatgccccagctcttaaaatcaccttacaatttctcccaaatataaaacaaactcaacttctctcttttttttgagaaggagtctcgctctgtcgcccaggctggagtgcagtggtgcgatctgggctcactgcaagctccgcctcccgggttcacgccattctcctgcctcaagtctcccgagtagctgggactaacaggtgcacgccaccacacccggctaattttttgtatttttagtagagacagggtttcaccatgttagccaggatggtctcaatctcctgacctcatgatccgcctgcctcagcctcccaaagtgctgggattacaggcgtgagccaacgcaccggcccaaactcaacttcttatagtgtgacattaaaaacccttcaggttctcacttacttatcttctagccttgattgccaatctcctttacttaaccacaccctaatccctttgacatctctattcttcatatttcttttcctttctttgggtctttgaacattcaatctccccttcctggaatgcctctttccacctggggaactcttaatttcactcatctgttaatacccccctcattttactctctctgtaaagtcttccttaagccctgatatcagagctttgatagtatttcagtgactgtgttttttatatgtcaatataattatagtatgcatgttcatattccctttgacactgacagttcctaggagccaacacctcgtattaaccctactgcatcccagcacctaatgcagtatccagaacacagtggacactttataaacattaatgtaatttgaaatgtgaagactaaaatcccaaatctaattatataattccaataaacttacaaaaactgtattttttctaataatactggaaatcaatgtcactaaactttacatgttaaaaacttaaatggtggtggtagtagagctggagtgaaaagaggcaggcaaaacttcatcaagattcaacaatggaaaatgttattaagaaaacaattatcttacgtgttcttcactcttcagttgctttacgccagattctataaccttaatgttgggaaagcgttttcctaacatggtacttgattgttcttcaacatcgaattcttccaatattttagaaatctgtatagatccaagagattaaaaatgtatatttttaaagtattttctttcaagaatcttaaataataaaaatactttgcttttacacactattttgtgtttataaaacaaacaagttagccaactgcactatatagagtggaaagaggactagactcagcatttagagacttaaatatttgcttggccgctcctgggcaagtcaggtgctacaagccatagtttcctggctaataaaatgagagctgacctgtaaaatgaggggtaacaccacttacatttctacagtttagccaaacagcttatttatttccttatccttcaagctttctctatttactagcagaccttatggtcatctagtctttgcactcttctttcctgttctataaaaccatcagtattctagactcactttcctttctgtccagctaaagttcaattgtgaatcatttcaccttttccctaaatcctttacttccttgctctcttatcctaaactgttaacctgaaaaccctcaaccctataaactatctgcttgctctagtcctaagcccagtttgctgcagaaagaccacacagccttacagattgatattcaacctcagctgctccttaaaaactgcatggaaatcttactgcatggccctgacagttctcaaaccttttggtctcatgacccctttacagtcttacaaattatgtaagaacctacttctagggttatttaaggatcatagaatagatctgaaacctttagaaggccacttgatgcatggtaagcacttaataaatgtgaattattagcagtaatcttttttctcctttaaaaattatacaagtcatgaatcatgctctttgtaacactaaacaaacaatacataatacagagtaaatgttaaagtctctatcactcttcatatctcatccttaatccctcaggataagcactagtgactttttggtgttatgttctatacttttaatctccttatcttatgtgcctagcacattggttaatatataatataggtactcaataaatcataaagataatgccatttcctactgctgtacacagaatagctgatatttgtatatttgttattggcacatttaagttcacaaccctgtgaagtaagcaaggaaagtattaacctaatactacaggtgaagcagcttacagagatcttccaaggctacccgaccagtaaataagaggcctagaaaccaagctttttccttctgttgtatataacttacaaaaccggcaaaaactgaattcaagtctcacaactcttggattattatactgaattaggtcttctggaaagatacttatgagacccagctatacatccttctcttatgtatacagtcttagcttgtcattaaatatgtacttttaccttttaaagattaatagctataatttttcctctatttctcccaaactccataactctttggctatacctaagtactaagctatcatatgtatctctatttaggttataaagggacaacatggtatatgccactaaactacccttggtcttatgggtttacaacatgagaaaattatattccattatcaggatattaccagagacatcgtattaaatgaagggctatggtagtagtcttcactgaagggtgggaagaaagatcagaatgtacgtttttcgacattttagaaattttattttgcataggctttataacatttataattgtagttctgtagctcatacacataacttattagtatacatatattgggatgtcagggcaaaactttttaacagttgagctacaggaaaaaaaaagtttggagatgacttttctatgatactattacccaactgttcttagactcctactataatgtgaatataaattaatggaatacaaagtattctgagacactaattatctataagtataaacttggcttggaagcacttttctgatgtgtaaacacacacacacacccctacccatattgataataaatatcatgtatatttgtacccattttagatttgcagagcatctttcctgaaaattttttattggaaactttctcaaaagtaattctaagtggaaggaaaatggagaaaaagaatagaagattaaaaatttagtatcattctgggagcttctggtattctatctgaataattctcaactcgagcttttttaaaataactctcaaaagaatatttgtaattttaaacaattaaaacactccagaatacatggaggtattgtcatcaagatggctaagtaggagataccagccttcattcccccattaaaaaaaacaaatatagacaaatcttcacaagccaaaatagcccaaagagggctcaacggcccattaaacaatctgcagcaacacagtggagcatgaaaatggagaataaccacataaaagaatcaataatgaccctggcatacctgagaaactaggagatagctaggagcaaagaaaggcagaggctatcagtatcagccacatggtggggaccactgtggtaaatggtggcctgcactgcagaggaaactggcatcccttgctactgtgaggggaccaacaaccattcctgccagggaaccctagagtgggagacatggcggcatatcttgtctccacaaagaagtggccaatgtcaagatgctttggcaaaggagtcactttgtcctcaaccctgtgagtgttccaaccccagggccatggtcactctgagaatgcctacacctcagacccaggttctacggcccatactgggcccacctacatctcagacaccagagccatcaccatagtaagctagtttgcactttggggcctgcaaccaatcctcactgcacatgtctgcaatctaggcactggctcagctgccattgaaagctaggccctgccctgacactgaagctgctgtaactctgagcacacatgtgttcccattcttggtttccctggctgcctcacaagcatcctcacctcatattctattaccaatatagcagtacgggtacctgcaccctaggcaccaatatcattacagtcccagatcccagaactttaattcctccgtgtatgcctgtgttttgggcctcagctctatctgctccataggcaccacttatcagacaccagcgctgctgccactgaacccagaaggcagactcagtgccaacagggatcccctaagccacaacttcctttgtgggagaagaaaagattgggaggctattagcagccattgacattgaaaaccccaacaaccctcactaccactgcagacatccagagttggatgctgaggatccctgcaatcttcaacaacaattaactcagctgacggagctgcacagactacaaagtgggcaccctcactggtgccagaactgctacatcccatctagcaagcagccctccccataggggaaggtctttccacagcaaaactagcccatacttctgaaaacagcaagtgtgtcatcaaatgtgcaaacatcaacataaggcagtaagaaacatgataaaccaagaagatatgccaccaaaagaacacaaatgtcagaactgcctaagaattcaaaataattgtttaaagaagctgaaggaacttcaagaagttacaaacaattcaattaaatcagaaaaacaataagcaaccaaaacaaaaaatttaaaaagttatttaaaaactaaagcagaaattctgacgatgaaagatgcaatgaatgaaacaaaaaaaaatgcaacagactatgtcaacaagagaactgatcacacagaagaaaacatctgtgaatctgaagacagattatttgaaaatatacagtcagaagggaagaagaagaaaaaagaatgaaaaagaacatagaagtagggaattaaaggatggcatcaaatgagcaaatctttgaattataggcgttatagaaggagacaagaaagacaaaggagtagaacatgtatttaaagaaataacaacagaaaactttccaggctgggcgcggtggctcacacctgtaatcccagcaatttgggaggccgaggtggatggatcacgaggtcaggagttccagaccagcctggccaatatggtgaaaccccgtctctactaaaaaatacaaaaaattagctgggcatggttgcgggcgcctgtagtcctagctacttgggaggctgaggcaggagaatggcgtgaacccaggaggcggagcttgcagtgagccaagatcgtgccactgcactccagtctgggcaacagggtgagactccatctcaaaaaaaagcaatcaattcaccataatcaagtgggatttattcagggatgcaaagatggcttaaaatatgcaaatcggtaaatgtgatataccacattaacagaacaaaggacaaaaatcatgaccatctctacagatatagaaaaaatattcaacaaaattaaacgtcttttcataataaaaacccaacaattaggtatggaaggaaagtaccacaacaaaaaaatggtcatatacaagcctatagctaataatatattgaatggagaaaagctgaaagcttttccaagatcaagaacaacacaaggatgcccactctcacaacttctattcaacacagtactaaagtcctagctagagcaattaaattaggtgacagaaagaaataaaaggcatccaaattggaaagattttaaatagcttgacttagccattccacaatgtatacatgtatcaaaacatcatgttgtacagcatataactgtacttgtcaatttttaagaaagaaaaaaatacacaattaccctaactgctatgcaagttattgcaattttttcaaattaatattaacaagttatacaaaggttcttacctgcttgaaatttgtaactgctttaataacaggagaagctgttaccaagagaatatcttccgatggaaagtgagtagccaacttatttttaaaaagagagaaaaaaaattaggacaaattactttaagtactggtatatatggtttggggttgagaataatgcaattttaataatgtaattaatctagaaaattaaaaacccactgttcctcatctaaaggtctccattatccttggtcttgatggggcaatggtgaataatattaaactctgatactgagaaaataatatttacagtaaacactaacaaagaactcctgaacaagaaaagtgatataaagaaatatcctttatttacttcaactattttttataccaatttagagttataatgcagaggatgagaataaactatcttcctaattaccagttaaaccaacttctatttatcttaaaataatatttcatttgtcttcaatgggatgaaattaaagcaaaccctcaatattaaacacttagaatattggtctaactttccccaggtgctctggcactcctattctgcctcttccagtcagtacatattgtgggacgataaagccattttaataattgcttccacaaaatttagaggtataacttgttaatgtttcattattttcctttagctacaacctcggtcttcttcactctgtacctgaaagcattttcttatctcaaagtctggttcctcgacaccaccaccctcaataatctggcttctattcctactccatcactaaaacagcatgtttgagggatctatgaatccttaaaatccaagggattatttattttttttttaatggagatgggatcttgccatgttgcccagtctggcttcaaactcctggactcatgcaatcctcccaccttggcctcccaaagttctaagattacaagtgtgagctatcgtgcccaacacccatgcgattcttctcagtctcattttatttgaactttctatatttgacaatatcattactctctccatctttctttcctctgtatattctgtaatttatatctctgctgtttccattgctagatgaggtcctcaaaacttctttatactactgaaatcaccttcgaattggctctccagtttcacgtataaaccagctgcctctgccacaaatacattgtaactaatcatctttcaagccttttcatatgatcaagttactccactgctcaaaaacatttgactacttgtaaattcttgttaagttctcagcatgctaagactccttatgatctatgctttaagctttactgctccctgatgatccatgcttttccactggagatgacattcttttcttgaatacttggtaaactttcactcattctttcataatgagattttaaaaataccttctttgattaaaaaaatttcctcttccctaattcactccctacatactccacaggcacctctaagataaccgttgatatctcttgcatagacatacaatattgtaatattgtctcttccagcaggctgtgagtccccagcatggtatataccatgctgttcatagttgaacactcagcccttaatacggtgcctgcatcatatatgtttacttagtgaataaacggaaaatacgcatccaacgatggaaacacttgagtttcttccactatttcttatgacttcagtgattgctcatgtttactttatatcaacaaaataatgtagaactttttggaatacacacatgtatctgaatatatatggtctggctattcagtataatcaagaaagcaagccctacatgcatttaatccttcgctgattattttacaaaactttactagaaataaagtttcttctatcttgggagttcgaagtatagaaaacttacatatgggattctttattaattagttaagatgcactaaagacttggcaactatctggaaactaaactcaatcacctacgataattaacaaagggggctgagggccgggtgctgtggctcaggcctgtaatgccagcacttcggtaggcggaagcgggcagactgcttgagcccaggagttcgagaccagcctggccaacatggtgaaagcccgtctctactaaaaatacaaacattagcggggcgtggtggctggcgcctgtaatcccagctacaggctgacgcaacagaagaatcgcttgaacccgggaggcaaagcttgcattaagccaagatcgcaccactgccctccagtctgggcgacagagtgagactccgtctcaaagaaaaagaaaaaaaaataaaaagaaagggggctgaattttttgtctaaatacaaagtcctcatgtctgctctgacattacaaggatctgagcacggatcagccagctttggtttctcggctataatttgcctcccactcctccctgcgcctaagagaaagctagtgaggtcatctgaggaccaccaagcagtttctaaaatctgggagcaataagtgcggaaaagggcgcagcaaaaaaggaacccggaagaagaaaaagggagggggtgggaggaaggcctccagtgctatcccctttggggtcggggaaagaggcggaaccgcctgagcaccgccctacctgctccgcacaagtgacgcccgcgatgccgccgccgaccaccacgaacttccctgccgtcgggggagggcgcgctgcctccatgctgccggactcccagtggtttactga

SEQ ID NO: 10972 - DNA, 503 bp, Homo sapiens
cagctgtttctatggtaattttttgttcattgttatcacttatagcttactctattatggctttttaaaaaaaaaatctctgtatattttcttatccttacttgtttgcttacttttctaaccattagtctaaattgacatttaggtaaatttgcttttaagttgaatacttaagccaatgattcagtcattttgtcttttctggggtgggtagtgcctactagacatttaattgtgctgcattttaatatttcttaccattcattataaactttttttttttagacaggctctccctccgttgcccagactggagtgcagtggcaccattttggctcattgcatccttaacctcttgggctcaggcgatccccccaccttagcctcctgagtagctgggactactggtgcgtgccactgccatgccttgctaatttttgtaccttttttttttttttctgtagagatgggattttgccatgttgctcgggctggtcctcgag

SEQ ID NO: 10973 - DNA, 503 bp, Homo sapiens; identical to SEQ ID NO: 10972

SEQ ID NO: 10974 - DNA, 305 bp, Homo sapiens
attaatttatgagcagctgttgctgtatacatgtaattatgtttgactacaaatgcatctttacaaaatgggcctagtggaatcataatataaatggttcagattaacttaattcagattaagaaaattgtttcatactgaggtaagcgattgaaaaattgtctatttaaaaatgcagtgcattttaaagagttactatttgaggatctaaaatatacagagaaggctgcatattttactttgatcttattaccatccaaaagaaagcttacatagaaatgatttgtcactttctgctttctgaa

SEQ ID NO: 10975 - DNA, 305 bp, Homo sapiens; identical to SEQ ID NO: 10974

SEQ ID NO: 10976 - DNA, 16807 bp, Homo sapiens
aggatgtgctgatggagctccttgagcagtgcgcagatggactctggaaagccgagcgctacgagctcatcgccgacatctacaaacttatcatccccatttatgagaagcggagggattttgaggtatgagagtgcctttttgtttttttcctatttgagagcatgacgctgtgacatatacccagacctgcatatatgtgagagaggaagcaggccatgggccagagatgagtgggggtctctgaccctccacgttacgctgaaggtggtggccagtcatcatctccaaatagtcatcgggtatcacccagacctgggccctacctctgtggagacccccacatctcaaactacagagtaaccggcactccactttcgaaaggctgccatgaacagagttttgtgatcaccagttgtcccttttctgagaactcttccttactccacctgcgtgaaaaaatggtgtcccttccgtccatcctgggcttgggaggtcatccagtttctctaggcatatcaaacagagcaggaaaagcaaaggccaagaatcacgttggggaaccatctctgacatcgcatcttaacttgaaaacagagtttgcttactctaatgtggaaatgtgatgggtcctcacgtgtgggctggcctttgggtaggaaatgttaccattcattaatgatcactacaagttgtgcagccaaaatgtgtgtgtgtgtatttttattcaagttcaaggacttttcacctccattatcacatttgttattttaaaatcgattctcctctttgcacatgggaagaaatgggctttgttctgctttccagaggctggcccatctgtatgacacgctgcaccgggcctacagcaaagtgaccgaggtcatgcactcgggccgcaggcttctggggacctacttccgggtagccttcttcgggcaggtgagcctcctgtccattctgcagactgtcctaagtcctttaaaaaaaaacaaaaacaaaaacaaaaaaaaaactataataaagttatatcttataaattctctgttttctgtaattgctaatttgatgaatttgtcatatttagtatgattcttatcttcctcagtagtaaactttctgctttttttctttcttcctgtcttttctttattactttcttaaggcagcggtaagttcttcctccttaagacattcttagcaacatctttggtacttcagtgtggtttgcaagtttgcttttcaagtctgtatgtttatctgtctagttattacaaactccaaaaaaattaacattttattccatttacagaaataaatcacctgttttcttatatatctatattgcatgttttaaaccaaaattaagactttctggtgtcctttgtgcctgtgcatctttatcctttgtagtataatatctccacaagtatatttacagtttttcagaaaccctataggaaagggtttatctaaatttaacttaaattttaaccttcgagtcccttaacattattaaatggtataaattataatacatatatttagggcgtgtggttttctatgagcattatataaccttcaatttattctgttattgtcttttataactttatagcaataccagtttacagacagtgaaacagatgtggaggtaattacagtaaatgcctaaaaagcaagtaatatagtgaaattactgcgtctaaactcctagtttgatgtggatgttttttgtttcatgctagcttgcatttttttttactgttttgtgcaccattttctctctcttaatttacgtgagaaactttaaaaaattttcttttaaacattaaccccagttggactttttaattttcaacctttttcacttcccatgcaattctaagccttgtagtcaaacatgattggtgctaaaacagatgatgactggtgatatgaaaatattttctgatattgagctacaggtctttaatatttttttctcatcggtaaagcaaaatacaatttatacaagctttacctaacttttactaaacttactccagacccccaaacgcttcagttcatgccataaaatcctgtgtgcatgggagccatcaggagaagggaggcatgtccacttctgagcctgcctgtcgtgggctgctcatcattttctagtgagttctgcttcttgggaaagtgaaacaggcttgactcccattagacttccctgggacagcttagtcttgtatccaaaatctttcatttcactcaacacttaatgactgcattcttgaataagtttgcaatgttgtgtttttcctttacctttgcacctagacttcatgttattagcattttctttctcattcagaaagcccatttcagcaggatttttagacccattcctttttttcccccttgtaataaaagaacgcttcctaggtggtaagccctgggcttacgttcagggatagctctaattgtgctttatgtcacagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtatgaccatgtttggataagtttcatagcaatgtaatgttgtgattgattacatattatatatttttaaatgtatatagaaaaaaacacaagaaaaatattaaggattgttggccgtgagtggcaggtgtattttcttcctgatacctttagtgctttccattacatgcttgacattaaaaaatctttatcgcctaatttttgaaacatctaattttacaaaataattaacgtctgacaggatatgtcatttttagtccagctatttagaaactctgacagaatgaggcccgtggcttcgctactcactgcacctcttcctgcatgtagcacatgacttgccactctgtcactgacggctggatgtaaggacaggtgaacagatgggcggatgggtgaatggacacatggacaggccaaggaatgaactcaccagcagcgtgactgtgggaatggcgatcattttctgcttagagagctgtcctctggcattctgttctcatgaagacccttttggaacctgcacctttgtcctgtacctttgtgtgtcccaccctcctcaggacatctccaggaggtcaggtctccctctgcttcctgaaggtgaaacatggggcaagacggtttcactcccactgcctttaaattattcctgctaaagaaagttaagttttaataggtttggatacaattagaatgaatggccaaatggctttttctaaaatacaaataataactttttttttttttttgagatggagtctggctctgtcacctgggctggagtgcagtggcgctatctcagctcactgcaatctctgcctcctgggttcaagagattcttgtgcctcagcctcccgagtagctgggattacaggaacgcgccaccacgcctggctaatttttgtatttttggtagagacagggtttcaccatgttggccaggttgttctccaactcccgacctcaagtgacctgcctgcctcggcctcccaaagtgctaggattataggcgtgagccaccgagcctggcccaaataataactttctatgactttatgtattttcttctaaagtttcaggcacttttccatctgttttttcatttttcttcacaatcgtctctgttttgagaacagttctctttcatttgcctgccttataccagtatggtctccatgtgctctgcacagccatttcttttgtgtccctttttattgctctagaaggttaaatacaattaaaatgtgcaaaattgatttgttgatttgtcttcctaataaattagcttttgtttctgcataggaattgcctatgtttaattctctatcatgtcacagaaatgaaagtaccaccaattctagcaatgtggttttaaaagcatttatatgttaaatagaaactaaatttatcattagattagtctagattaatctgtacctgtattaaattaattgatctgcagctgttgcatctaatctcagctgtctgtagattaatgataatttggaggcctagcttccaaacattattcctaaaataaacatttatctctctaagccaaatatattaaaaatgcagtttaagaaacaatcagagaaatccagactggaggtcattcaataagaaaaccagcactttgggaggccaaggcgggcggatcacctgaggtcgggagttcgagaccagcctgaccaacatggagaaaccctgtgtctgctaaaaatatataattagctgggcatggtggcacacacctgtagtcacagctacttgggaggctgaggcaggagaatcacttgaacgctggaggcagaggttgcagtagctgagatcgcgccattgcactccagcctgggcaacaagagcaaaactctgtctcaaaaaaaaataaaataattcaatgttatgggaaaaatgaatgatagggaattcttctaaattaaacatgactagggacataacaactaaatgtaaagtgtgattgttgattagattctgatccaaacacaaatatctataactaacattctggagacatttgagaaaatgttaatatagactgggtattggatggtattagggaatcagtgttaatttgggtaggcatgataatgtattgcggttatagaagcaaatgtccttatttttaggagaagctgactgtagtatcctgacgtgtaccacttactttgaaatggttctactggaaaaaaaaaagtctgtatgtctgtgtgtgtgtgcacatccataagtgtatgtgtatgtatatttgaaacaaatatagcaaactgctagcagttgttgatccaagtggtggatatgtggatgtttgttgtactcttctctccgttatatttacaaataaaatgttggaaaataccacgtaggtaagaactgagtgattccttcatggagcaccaatctcccattgtgctgtttcaattaaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacaggtatgggccccagaagccgcatggacacgagcccggacacctcgccaaagagctgtccagagggattcagaagcttcaggactggaagggtctttcgagctcagttagccacccccacacccatttcagtttcacatttatctagtgcttccttttgaatacttgggatgtttttctgttgatctgttgacacttccttcttccacaagaccagaagctcatatccaatctaaggtcacttacccttctgagaatctgatgaaaatggcgtgccttatgtgcctagatgcttttgcacacagtctaaggtgacttatggactccaggtccagcagccacacccagtcctgggtctccgcacagggagggacccgtctcacacacctgtctcaggttctagcatggcctgctcagcggtctcaggctgtgagtaaatgggatgtgagcttggatcgccccacgctgttgcccccgggggctggccagctgccacttgaatgcctcctctgccaggaagctcactgcattcagtggctatccacgagttcagcttaggcagttttcactgatccctttggcactgtttagccagtgataacccactctgggaaatgtgttttgcatcatttcccggtccctggcaagtgtctagtcatcctggggtgatttttaccttctgtgggagagcttgacccatccctgcctcattagggtcagcgacatcactggggtaacctaacataaaatgctttcttgaccaagaaatatcagtgggagggccgttgagaatgccaggtgtgccagctttcaccacacgtcttccaaagagtggccctagttaagtcagaccaggaaagggcctgctccccggaagttggggttgttgagtttctgtctgggtaataatacacactatcataataagcggaaggagcgctgtggagatgctgcacccaggtgcttatcagctctcaccggcgaagcgtatgctttaaaaagagagactggatggcgtggggtttatatctcagtaaagctgttacaaaaaaaaaaaaaaaaatacaggtttttatgaattagcccaggacagcgtattgcagggagcttttcacactccctatgagggaaaagagatacaagttaaaacaaaactgtgttcttaaagtgtccctaatcctgcttgtaaaataagaagacagcatatataaagcacaaataatattgtcctcacaaacatcaccccaccccaaataatttaattatttttttaatgcacacatcagtagcaaattctcattaagccaaataactgcgcttccagatggaatcactttatgggaatcaccagcttacagtgtttatggttcagctgtgataactttccttctgaccctttaagtcagtggttacccaaggttggtccaggaccagcagcatcagcacccccagggaacttgttagagatggaagttccaggtccccacctccgaaactgctggatcagaaactctgggggcggggcccagctctttgtgttcaacaggccctcccggttatcctggtgcatgctcagattagagaactgctgcctttaataaacctagttcactgctgagtcagggtcaggattttttagtatggttattgttaaggcagtgtacggattcataaacattcattaccataggctgttttcccagggcacatttctccagggttacaggtcatcattttgttagagactactttagattagataaagcacatgagcaatgctctgtatctgcgggaacaaggggacagagagtgcgcttcagagagaggtggggcagacacctgtgttgttggcttggggattgccgtccacagctgtgggttgagacagcctaagcaatggcgaggctgtcctgggggtcctgtaggcctgggtcacagcctcattgtgtgaccttgggcaggtcactcttcctctctatgccttagtttcctcatctgtaaaatgcaagttaggacacttatctcattatattgtcataactttgtaaatagtaagaagcaagggaaagagcgttcttcattttttgctagatttcatccgctgttgagctagatacacacaccagggcgttctgaaggctagacctgagggttttccctcaagttatcaacccctcaggttcttcttccattgcattgctttgtacctaacctttggccttccaaaggtcaaagggagcccaggccttccctgccctctacaccaggaaaaggctcacctttctgggtagttcccagtcagctgactgtaactgtgcaatcatttgaaaaacctcatgatcaccctccagcctccttcagtggaaatttctgagcctgtcccaaagaaggggggcgaggagaagcctcctccacttctttcatggaacttttgccaaggagtttcttcccagtcactattccagagtcttccaaacctggattagcttccggccctccactttctattcaagacacacagaccagcagtcaccatacttatcactgggccttccccgtcctcctttctaaagggctggctcagtcggtcacctaattgtccaccttccagagccagtttggactctcatgcagccatttgggcagtaatgcattcattcattcaacaaaatgtattgcacactgaccatgttcccattggcaggctaatgaaacagacatctgtgggcctgtgcagctggcattctagccagaggagacagatgataaacagtacccagatgagtaaatataaccgtggtagaacgtgatctgtgttccagacaaagcaaaaggagactgggaacctggagttgacctccttcctcagaaacaggaaggcagccccactcttcccctgaagcacagccccctgtccaaatacaagcaggcatctgccagcactgcctccctgactagggagcagcgaggccgagtcctcaccatcctaccagggagctttgtggatccccagtgctaccacttaaaatctgtgaaaccaagtcgggaacccttcacctttcactgataaaacattgtgaaaaggcaacaggcctataagtacgtgacatatgaggttgcctcagggtggacatgttttccgcttttgtccagatgttgggtggcccatcggaactctgtgtttcacaggggctgggcctgtttcccatcctgtgatgagtccttcccaattgaactcttccctagccagttgctaactagagaccaggaccactcccatctgacgtttgcttgttcaaaaaaaataataagcttttaagtacatatctacctgcctattagtaaatatatgtcaagtgagaatattatagatatttctatattatatagagcaataagaaatgtgaaatagtaaatgagaacctgctgtttttctgttcatttttaaattaactcctttgtgttgatgtttaggtatctcattatgataaaggaaaacaatattaatcagatttttttggttaaaaaatatataagaaaaagtaaatatttttatttttatttcttattcattgctgtaagtttcaaaatacctttattagcactacagctccaaaagtttgtgaatttctggttcatgaaatcctttgcttaggagtatattctttgtgtttttttggtttgggttttaggggaatggtttttgttttcttttttgagacagggtctcactctgtagcccaggctggagtgcagtggcacaatcacagctcactgcagctttgacctcctgggctcaagcctcctgtgtcagcctccccagtagctgggactacaggcatataccaccacactcagctaattttttgtattttttacaaaattacaaaaattaggtttttgccatgttgcccaggctggtcttaaactcctgggctcaagtgatctaccagccttggcctcccaaagtgctaagattacaggtgtgagcactgtacccaccctaggaatatattcttacttattattttctactgatttctcagctttgtgcaagcttagcatgtgattcaaagttattctatggacaaaaatgaattttctcaaggatatttttatggaactattttctggacttaatctgttatgtagtatctcaaaattgtttagtcttttttatgttgtcaaagtcatcttatatccactaactcattcaaacctcagagcttccaaggaaggtttgagtggggaatgataacctcatttatttaaagacacgcttgtcacattaaaaggataacaaggacccaactctcttgactttacgagacacacgattgtaaaggaagacaatattctagctccatcaagtactagtatgtgtctttggcaagctttgggttccttattttaaaaatgtaagtaataatgacatgtataataatcacttctaataataatcagctcaataacactaaagctcgtgcaagccatgcagtaattctggggcttaccctctgcagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtgagccaggcacagcaggccggagggcagcaggggacgtccttgcccctgggtgacttgagagtcgtttccactaacaaggtctacttgagagcctcggtttaccaagtgatccctgctcccttcccccaacgtctgtgacatttctcctgatatcagagggggaggaaacctcatgatccctgccccccgccccatgaggactgactgtggggacaagagccagatctcatacactaccctgatttgtcagtatttggggaattctgggtgcctgattagaagcatcaagactcttctaaatacaaagaagtgtggagagcagtagattttcctataaaactgttgtttgctgttttctatgaaaattgtatccaaaaaagtaccttaagttttaccctcttaatggtatcttttgattaatgaattcattattttaatatagcccaatcaatcaatttttctttattggtagcatttttatgttctctttaagaaatctgtgtctactccaaaatttcacagatgttctcctaggttttcctcctttgctcagcatccacatccaggtctgcagtccatctggaattgatttttgtatatgttatagtgtaagggtcaggatatattttttccatatgaccttccaagtgatatacacaatttattgaaaagatcatctttgatctagatactaacatatatgttcagtttgtgaaaattcatcaagctgtatacacttgtgatatatgcgctttcccgtttgtatattatactttagtaagaggtttttaaaaagttatcttacttacatggtttcctagttaattggtaagtgttaaatcactccctccagtaacaagtatgactcttattttctggtatttttaagtgtatatagttcaagcacatgtttgttcatatgtatatgtacatgtgtgtatatatgtatttgtatatcctattgttttatctttcaagaagggtatgtttatgaaagttacatgtggattataatacataggttttggtttttttggttcattttctgaaattatattttgtcaacttcccatcagatccacgctaaagaaccgtgagttgttgcccaacatttttgtgtcattcaccacaaaagcatttacagatgtttttaatctctttccttatagtctcaaagacatatgtgccaaaataagttagcaagtgaacataagtattccagcaacatgagtgattatgtaacaggtccagaggccacaattttctgtagctaaaaacaaaaccactcaatcaacatgatcttggaacatccagcccctatggaaaggccgctggaggggtgtggcaccagtccagggtagggctggaccattgagctttgtaaaaggcaaaatatgccctgctaatttgatggtaaacttagcattttataaaattcccagtcatcttaaaaagcaagaaattccatgttgaaatgagaagattaagtttatactcatacctaccaaagtaacaacaaagttgcagccagaggaaattaactttatcattttatttgcgtatttctgtaattgtttcatcaagcagctcactggcgctgcagctttactgggcagagccgtctgcggagcttcttgtcattgcactccaagatcttgctattagaccttatggagtctcatcagccttcctctttctatcttcttcaaatacagaccgtcttgtatcattttagatgatcagtcattttggtcgtcttcaggtgatgaatacagttccccccacgcaccagcctggtgctgagttccaccctcaacgcaccttgggctgttcacccattgcccccggctcagaggtccccctctgaccactgtggctggaacctggaaccctcctgtgtctccacgtctggtgtgagttcctgtggctcagttttcctgccattgctagacaagtcctgcctaccatgggtcagaaccacacacggggagctcccctaattccttgctaagctcaccagaccttccgggaaatatcaagcagtgaccacatagtcacgttcttccccaggctgtctcagacgcctggaacattcttcttcccatcccagtgtgtccagccttctttctcaccacgttcttacctttccttacttatccagaatcagcagacccttcttagctgcttgcaagggtggtgcagggttctggttcactcaccgtgctgtctgctcctaacatctagctctccagcacaccgcaaacgctcacttcatcccaggatagcaaatcagtttgcccatggctgtctatacaattcaatgaaatgaacagttgggtttcaaaaactggaatagttactgcatttttcaatttttcactgaattcaccagattggcctgttagttcagtgtagtgcagcacaaatcccagtgactaaacaccttggaagtaagaatccttgacctggatttggaagacctgggctgtgatctctggcgttttgcttattggctcttcaaacttcaacaggcccctaagttttccaagcattggtttcttcttacataaagtaaaccatcatcacaagtgccctgaagatggctgagatcatggaatcaagtggtgtgcaacagagtgaactttgtggtttctttttgggcttaagttcctggaaggcagggattgtgagtagctcacgcgaacgggctttttagtgcctgcaaactgaaactgagcagatggtcatggtgattttcttcctagtggaactgaaaatctttgctctttgtctaggtcaatgctggcccactagcatatgcgcgagctttcttagatgatacaaacacaaagcgatatcctgacaataaagtgaagctgcttaaggaagttttcaggtaaagcacactgaaagcatctttttctcttcgagtattgatcatttctgtactcattcgggaaggagatgctgctggttggactcatgccttatcctctgcgtgcctttgtttctcccgcctgtaccattccaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagggccgcactggctccaacaacttggagttcttggttaggggtttcaagtacaccctatcatgacttaggccgcctgatatccttccagaactgtgacatctgaaggagaatgtagcataccacactcctgccatgctctagccccaggtcatttgggaacagctaacagattgcccatatgctgttatctacggcaagcaggggagagcgggcccgcctcctcgtggctctaagaggtggccatgtttcctaagctttctctctccccacccccgtctagccaaaaagaaaagaaaggaaaaactcacacgaaaatatccatactgttctgacaactttattcctttaatcctttgaaaaaagcaggacttgccaacctggtttaaggaattatctgttgcattcaatgtttttgctgtttaaaaatacagactgattccatttttgatgatgtacagtgggccttggcgccccagtggattcttcctttaagttccttgtcactatgggcatcttccctgattattttgctgttatctctttcctgtgggtttcttcagtaggattctatgtgtgggctcagttgtcacagaggagacagtgtcccatacccagggaatgcctagagcagcatccacattgttttttttgtgaggggtctgtctcagtcactgtcctttctttataattgacattagcaccttgataacacagaactgctctgtctggcccctccattatcgtccttcagtctggcacagtggaagccagggccgtttgtggagtgatcctatcccctgacagtttagttagtacattttcattgcaggaaacgaacgtcagtgtgtgagctttaactcacttgctttttttctcctccatgctaacacgttcagctgggatggtaatgtcatttttaaacattatttttctgataatctgacttagaaaaagctattacttttttgagtttgagcaactacagacattggcataatgacagtacatgggcagaggaaagcaccctcttctggacattttaaaaagtagaggccagacatggtggctcactcctgtaatcccagcactttgggaggccaagatgggtggatcatctgaggtcaggagttcgagaccagcctggccaacatggtgaaaccccatctctactaaaaaatacaaaaattagctgggtgtagtggcacataccctagtctcagctactcgggaggctgaggcaggagaattgctggaacccaggaggtggaggctgcagtgagccaagatcatgccactaccctctagcctgggccacagagcgagactccatctcaaaaaaaaaaaaagtagaaaaaaattgaaacgattagagaaatgaatgtctgaataattaagcagaacaggagggactcatgggaaccgattttcagagaaaacttgagatcttttctgtggagcctccagattcctatagaatggagagtttggtcagtgggtgccgacattgggcactagagaagatgaaagtagtaagagatcataggctgaaactgttaaactcccaaagtacagggatatttaatgcacttgctgtcagctgcaccttgaacttcccattatgccaacagctgtgaagactgagcccccgtgaacccctgaagggccgtggcgggggtagacttgctttcgatgtttccaggggagcctctgctggaggtgaagacctacactcagatccttccaggcaccactgggcatggaaagatacttgttcagggtcagaggagtagccaccctctcccaagacaaaatccgtaagaccctgagaaaaggaggcaggagagaaacacaaatgcttcaaattcatttttaaaggctttttcaaggtcaaggctaggttgtgtcccagtcaagcacatgtaagtagacctcacgttgccttaagtagacctcacgttgccttatgatctggtgagcgtagaaggctctccattcactagctttgtaaaagaaacaaaatgtgctgttcttgactttctccttataatcctcacctgaaaacagtcatttatgagataagctgaacatctccctctgtaaaccagcagccaggctttccggctgcacatcactcacgtgatggagtgagtgtagacttgtgtgtgtgatgtggggtgcaacacattgagaaatatctgcttgcatccttatactcagtaacattgtgttgcacgtggcaacattgccttaaactctgtaacattttgttacacttggtaacattgtgtcacacatggcaacatggcattgcatatggtaaccttgtgttgccctcagtaacgttgtgtttctgtcctcaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 10977 - DNA, 16793 bp, Homo sapiens
  misc_feature (13408)..(13408): n equals a,t,g, or c
  misc_feature (13809)..(13809): n equals a,t,g, or c
  misc_feature (14012)..(14012): n equals a,t,g, or c
aggatgtgctgatggagctccttgagcagtgcgcagatggactctggaaagccgagcgctacgagctcatcgccgacatctacaaacttatcatccccatttatgagaagcggagggattttgaggtatgagagtgcctttttgtttttttcctatttgagagcatgacgctgtgacatatacccagacctgcatatatgtgagagaggaagcaggccatgggccagagatgagtgggggtctctgaccctccacgttacgctgaaggtggtggccagtcatcatctccaaatagtcatcgggtatcacccagacctgggccctacctctgtggagacccccacatctcaaactacagagtaaccggcactccactttcgaaaggctgccatgaacagagttttgtgatcaccaggtgtcccttttctgagaactcttccttactccacctgcgtgaaaaaatggtgtcccttccgtccatcctgggcttgggaggtcatccagtttctctaggcatatcaaacagagcaggaaaagcaaaggccaagaatcacgttggggaaccatctctgacatcgcatcttaacttgaaaacagagtttgcttactctaatgtggaaatgtgatgggtcctcacgtgtgggctggcctttgggtaggaaatgttaccattcattaatgatcactacaagttgtgcagccaaaatgtgtgtgtgtgtatttttattcaagttcaaggacttttcacctccattatcacatttgttattttaaaatcgattctcctctttgcacatgggaagaaatgggctttgttctgctttccagaggctggcccatctgtatgacacgctgcaccgggcctacagcaaagtgaccgaggtcatgcactcgggccgcaggcttctggggacctacttccgggtagccttcttcgggcaggtgagcctcctgtccattctgcagactgtcctaagtcctttaaaaaaaaacaaaaacaaaaacaaaaaaaaaactataataaagttatatcttataaattctctgttttctgtaattgctaatttgatgaatttgtcatatttagtatgattcttatcttcctcagtagtaaactttctgctttttttctttcttcctgtcttttctttattactttcttaaggcagcggtaagttcttcctccttaagacattcttagcaacatctttggtacttcagtgtggtttgcaagtttgcttttcaagtctgtatgtttatctgtctagttattacaaactccaaaaaaattaacattttattccatttacagaaataaatcacctgttttcttatatatctatattgcatgttttaaaccaaaattaagactttctggtgtcctttgtgcctgtgcatctttatcctttgtagtataatatctccacaagtatatttacagtttttcagaaaccctataggaaagggtttatctaaatttaacttaaattttaaccttcgagtcccttaacattattaaatggtataaattataatacatatatttagggcgtgtggttttctatgagcattatataaccttcaatttattctgttattgtcttttataactttatagcaataccagtttacagacagtgaaacagatgtggaggtaattacagtaaatgcctaaaaagcaagtaatatagtgaaattactgcgtctaaactcctagtttgatgtggatgttttttgtttcatgctagcttgcatttttttttactgttttgtgcaccattttctctctcttaatttacgtgagaaactttaaaaaattttcttttaaacattaaccccagttggactttttaattttcaacctttttcacttcccatgcaattctaagccttgtagtcaaacatgattggtgctaaaacagatgatgactggtgatatgaaaatattttctgatattgagctacaggtctttaatatttttttctcatcggtaaagcaaaatacaatttatacaagctttacctaacttttactaaacttactccagacccccaaacgcttcagttcatgccataaaatcctgtgtgcatgggagccatcaggagaagggaggcatgtccacttctgagcctgcctgtcgtgggctgctcatcattttctagtgagttctgcttcttgggaaagtgaaacaggcttgactcccattagacttccctgggacagcttagtcttgtatccaaaatctttcatttcactcaacacttaatgactgcattcttgaataagtttgcaatgttgtgtttttcctttacctttgcacctagacttcatgttattagcattttctttctcattcagaaagcccatttcagctggatttttagacccattcctttttttcccccttgtaataaaagaacgcttcctaggtggtaagccctgggcttacgttcagggatagctctaattgtgctttatgtcacagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtatgaccatgtttggataagtttcatagcaatgtaatgttgtgattgattacatattatatatttttaaatgtatatagaaaaaaacacaagaaaaatattaaggattgttggccgtgagtggcaggtgtattttcttcctgatacctttagtgctttccattacatgcttgacattaaaaaatctttatcgcctaatttttgaaacatctaattttacaaaataattaacgtctgacaggatatgtcatttttagtccagctatttagaaactctgacagaatgaggcctgtggcttcgctactcactgcacctcttcctgcatgtagcacatgacttgccactctgtcactgacggctggatgtaaggacaggtgaacagatgggcggatgggtgaatggacacatggacaggccaaggaatgaactcaccagcagcgtgactgtgggaatggcgatcattttctgcttagagagctgtcctctggcattctgttctcatgaagacccttttggaacctgcacctttgtcctgtacctttgtgtgtcccaccctcctcaggacatctccaggaggtcaggtctccctctgcttcctgaaggtgaaacatggggcaagacggtttcgctcccactgcctttaaattattcctgctaaagaaagttaagttttaataggtttggatacaattagaatgaatggccaaatggctttttctaaaatacaaataataactttttttttttttttgagatggagtctggctctgtcacctgggctggagtgcagtggcgctatctcagctcactgcaatctctgcctcctgggttcaagagattcttgtgcctcagcctcccgagtagctgggattacaggaacgcgccaccacgcctggctaatttttgtatttttggtagagacagggtttcaccatgttggccaggttgttctccaactcccgacctcaagtgacctgcctgcctcggcctcccaaagtgctaggattataggcgtgagccaccgagcctggcccaaataataactttctatgactttatgtattttcttctaaagtttcaggcacttttccatctgttttttcatttttcttcacaatcgtctctgttttgagaacagttctctttcatttgcctgccttataccagtatgggctccatgtgctctgcacagccatttcttttgtgtccctttttattgctctagaaggttaaatacaattaaaatgtgcaaaattgatttgttgatttgtcttcctaataaattagcttttgtttctgcataggaattgcctatgtttaattctctatcatgtcacagaaatgaaagtaccaccaattctagcaatgtggttttaaaagcatttatatgttaaatagaaactaaatttatcattagattagtctagattaatctgtacctgtattaaattaattgatctgcagctgttgcatctaatctcagctgtctgtagattaatgataatttggaggcctagcttccaaacattattcctaaaataaacatttatctctctaagccaaatatattaaaaatgcagtttaagaaacaatcagagaaatccagactggaggtcattcaataagaaaaccagcactttgggaggccaaggcgggcggatcacctgaggtcgggagttcgagaccagcctgaccaacatggagaaaccctgtgtctgctaaaaatatataattagctgggcatggtggcacacacctgtagtcacagctacttgggaggctgaggcaggagaatcacttgaacgctggaggcagaggttgcagtagctgagatcgcgccattgcactccagcctgggcaacaagagcaaaactctgtctcaaaaaaaaataaaataattcaatgttatgggaaaaatgaatgatagggaattcttctaaattaaacatgactagggacataacaactaaatgtaaagtgtgattgttgattagattctgatccaaacacaaatatctataactaacattctggagacatttgagaaaatgttaatatagactgggtattggatggtattagggaatcagtgttaatttgggtaggcatgataatgtattgcggttatagaagcaaatgtccttatttttaggagaagctgactgtagtatcctgacgtgtaccacttactttgaaatggttctactggaaaaaaaaaagtctgtatgtctgtgtgtgtgtgcacatccataagtgtatgtgtatgtatatttgaaacaaatatagcaaactgctagcagttgttgatccaagtggtggatatgtggatgtttgttgtactcttctctccgttatatttacaaataaaatgttggaaaataccacgtaggtaagaactgagtgattccttcatggagcaccaatctcccattgtgctgtttcaattaaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacaggtatgggccccagaagccgcatggacacgagcccggacacctcgccaaagagctgtccagagggattcagaagcttcaggactggaagggtctttcgagctcagttagccacccccacacccatttcagtttcacatttatctagtgcttccttttgaatacttgggatgtttttctgttgatctgttggcacttccttcttccacaagaccagaagctcatatccaatctaaggtcacttacccttctgagaatctgatgaaaatggcgtgccttatgtgcctagatgcttttgcacacagtctaaggtgacttatggactccaggtccagcagccacacccagtcctgggtctccgcacagggagggacccgtctcacacacctgtctcaggttctagcatggcctgctcagcggtctcaggctgtgagtaaatgggatgtgagcttggatcgccccacgctgttgcccccgggggctggccagctgccacttgaatgcctcctctgccaggaagctcactgcattcagtggctatccacgagttcagcttaggcagttttcactgatccctttggcactgtttagccagtgataacccactctgggaaatgtgttttgcatcatttcccggtccctggcaagtgtctagtcatcctggggtgatttttaccttctgtgggagagcttgacccatccctgcctcattagggtcagcgacatcactggggtaacctaacataaaatgctttcttgaccaagaaatatcagtgggagggccgttgagaatgccaggtgtgccagctttcaccacacgtcttccaaagagtggccctagttaagtcagaccaggaaagggcctgctccccggaagttggggttgttgagtttctgtctgggtaataatacacactatcataataagcggaaggagcgctgtggagatgctgcacccaggtgcttatcagctctcaccggcgaagcgtatgctttaaaaagagagactggatggcgtggggtttatatctcagtaaagctgttacaaaaaaaaaaaaaaatacaggtttttatgaattagcccaggacagcgtattgcagggagcttttcacactccctatgagggaaaagagatacaagttaaaacaaaactgtgttcttaaagtgtccctaatcctgcttgtaaaataagaagacagcatatataaagcacaaataatattgtcctcacaaacatcaccccaccccaaataatttaattatttttttaatgcacacatcagtagcaaattctcattaagccaaataactgcgcttccagatggaatcactttatgggaatcaccagcttacagtgtttatggttcagctgtgataactttccttctgaccctttaagtcagtggttacccaaggttggtccaggaccagcagcatcagcacccccagggaacttgttagagatggaagttccaggtccccacctccgaaactgctggatcagaaactctgggggcggggcccagctctttgtgttcaacaggccctcccggttatcctggtgcatgctcagattagagaactgctgcctttaataaacctagttcactgctgagtcagggtcaggattttttagtatggttattgttaaggcagtgtacggattcataaacattcattaccataggctgttttcccagggcacatttctccagggttacaggtcatcattttgttagagactactttagattagataaagcacatgagcaatgctctgtatctgcgggaacaaggggacagagagtgcgcttcagagagaggtggggcagacacctgtgttgttggcttggggattgccgtccacagctgtgggttgagacagcctaagcaatggcgaggctgtcctgggggtcctgtaggcctgggtcacagcctcactgtgtgaccttgggcaggtcactcttcctctctatgccttagtttcctcatctgtaaaatgcaagttaggacacttatctcattatattgtcataactttgtaaatagtaagaagcaagggaaagagcgttcttcattttttgctagatttcatccgctgttgagctagatacacacaccagggcgttctgaaggctagacctgagggttttccctcaagttatcaacccctcaggttcttcttccattgcattgctttgtacctaacctttggccttccaaaggtcaaagggagcccaggccttccctgccctctacaccaggaaaaggctcacctttctgggtagttcccagtcagctgactgtaactgtgcaatcatttgaaaaacctcatgatcaccctccagcctccttcagtggaaatttctgagcctgtcccaaagaaggggggcgaggagaagcctcctccacttctttcatggaacttttgccaaggagtttcttcccagtcactattccagagtcttccaaacctggattagcttccggccctccactttctattcaagacacacagaccagcagtcaccatacttatcactgggccttccccgtcctcctttctaaagggctggctcagtcggtcacctaattgtccaccttccagagccagtttggactctcatgcagccatttgggcagtaatgcattcattcattcaacaaaatgtattgcacactgaccatgttcccattggcaggctaatgaaacagacatctgtgggcctgtgcagctggcattctagccagaggagacagatgataaacagtacccagatgagtaaatataaccgtggtagaacgtgatctgtgttccagacaaagcaaaaggagactgggaacctggagttgacctccttcctcagaaacaggaaggcagccccactcttcccctgaagcacagccccctgtccaaatacaagcaggcatctgccagcactgcctccctgactagggagcagcgaggccgagtcctcaccatcctaccagggagctttgtggatccccagtgctaccacttaaaatctgtgaaaccaagtcgggaacccttcacctttcactgataaaacattgtgaaaaggcaacaggcctataagtacgtgacatatgaggttgcctcagggtggacatgttttccgcttttgtccagatgttgggtggcccatcggaactctgtgtttcacaggggctgggcctgtttcccatcctgtgatgagtccttcccaattgaactcttccctagccagttgctaactagagaccaggaccactcccatctgacgtttgcttgttcaaaaaaaataataagcttttaagtacatatctacctgcctattagtaaatatatgtcaagtgagaatattatagatatttctatattatatagagcaataagaaatgtgaaatagtaaatgagaacctgctgtttttctgttcatttttaaattaactcctttgtgttgatgtttaggtatctcattatgataaaggaaaacaatattaatcagatttttttggttaaaaaatatataagaaaaagtaaatatttttatttttatttcttattcattgctgtaagtttcaaaatacctttattagcactacagctccaaaagtttgtgaatttctggttcatgaaatcctttgcttaggagtatattctttgtgtttttttggtttgggttttaggggaatggtttttgttttcttttttgagacagggtctcactctgtagcccaggctggagtgcagtggcacaatcacagctcactgcagctttgacctcctgggctcaagcctcccgtgtcagcctccccagtagctgggactacaggcatataccaccacactcagctaattttttgtattttttacaaaattacaaaaattaggtttttgccatgttgcccaggctggtcttaaactcctgggctcaagtgatctaccagccttggcctcccaaagtgctaagattacaggtgtgagcactgtacccaccctaggaatatattcttacttattattttctactgatttctcagctttgtgcaagcttagcatgtgattcaaagttattctatggacaaaaatgaattttctcaaggatatttttatggaactattttctggacttaatctgttatgtagtatctcaaaattgtttagtcttttttatgttgtcaaagtcatcttatatccactaactcattcaaacctcagagcttccaaggaaggtttgagtggggaatgataacctcatttatttaaagacacgcttgtcacattaaaaggataacaaggacccaactctcttgactttacgagacacacgattgtaaaggaagacaatattctagctccatcaagtactagtatgtgtctttggcaagctttgggttccttattttaaaaatgtaagtaataatgacatgtataataatcacttctaataataatcagctcaataacactaaagctcgtgcaagccatgcagtaattctggggcttaccctctgcagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtgagccaggcacagcaggccggagggcagcaggggacgtccttgcccctgggtgacttgagagtcgtttccactaacaaggtctacttgagagcctcggtttaccaagtgatccctgctcccttcccccaacgtctgtgacatttctcctgatatcagagggggaggaaacctcatgatccctgccccccgccccatgaggactgactgtggggacaagagccagatctcatagactaccctgatttgtcagtatttggggaattctgggtgcctgattagaagcatcaagactcttctaaatacaaagaagtgtggagagcagtagattttcctataaaactgttgtttgctgttttctatgaaaattgtatccaaaaaagtaccttaagttttaccctcttaatggtatcttttgattaatgaattcattattttaatatagcccaatcaatcaatttttctttattggtagcatttttatgttctctttaagaaatctgtgtctactccaaaatttcacagatgttctcctaggttttcctcctttgctcagcatccacatccaggtctgcagtccatctggaattgatttttgtatatgttatagtgtaagggtcaggatatattttttccatatgaccttccaagtgatatacacaatttattgaaaagatcatctttgatctagatactaacatatatgttcagtttgtgaaaattcatcaagctgtatacacttgtgatatatgcgctttcccgtttgtatattatactttagtaagaggtttttaaaaagttatcttacttacatggtttcctagttaattggtaagtgttaaatcactccctccagtaacaagtatgactcttattttctggtatttttaagtgtatatagttcaagcacatgtttgttcatatgtatatgtacatgtgtgtatatatgtatttgtatatcctattgttttatctttcaagaagggtatgtttatgaaagttacatgtggattataatacataggttttggtttttttggttcattttctgaaattatattttgtcaacttcccatcagatccacgctaaagaaccgtgagttgttgcccaacatttttgtgtcattcaccacaaaagcatttacagatgtttttaatctctttccttatagtctcaaagacatatgtgccaaaataagttagcaagtgaacataagtattccagcaacatgagtgattatgtaacaggtccagaggccacaattttctgtagctaaaaacaaaaccactcaatcaacatgatcttggaacatccagcccctatggaaaggccgctggaggggtgtggcaccagtccagggtagggctggaccattgagctttgtaaaaggcaaaatatgccctgctaatttgatggtaaacttagcgttttataaaattcccagtcatcttaaaaagcaagaaattccatgttgaaatgagaagattaagtttatactcatacctaccaaagtaacaacaaagttgcagccagaggaaattaactttatcattttatttgcgtatttctgtaattgtttcatcaagcagctcactggcgctgcagctttactgggcagagccgtctgcggagcttcttgtcattgcactccaagatcttgctattagaccttatggagtctcatcagccttcctctttctatcttcttcaaatacagaccgtcttgtatcattttagatgatcagtcattttgtgatgaatacagttccccccacgcaccagcctggtgctgagttccaccctcaacgcaccttgggctgttcacccattgcccccggctcagaggtccccctctgaccactgtggctggaacctggaaccctcctgtctctccacgtctggtgtgagttcctgtggctcagttttcctgccattgctagacaagtcctgcctaccatgggtcagaaccacacacggagagctcccctaattccttgctaagctcaccagaccttccgggaaatatcaagcagtgaccacatagtcacgttcttccccaggctgtctcagacgcctggaacattcttcttcccatcccagtgtgtccagccttctttctcaccacgttcttacctttccttacttatccagaatcagcagacccttcttagctgcttgcaagggtggtgcagggttctggttcactcaccgtgctgtctgctcctaacatctagctctccagcacactgcaaacgctcacttcatcccaggatagcaaatcagtttgcccatggctgtctatacaattcaatgaaatgaacagttgggttttaaaaactggaatagttactgcatttttcaatttttcactgaattcaccagattggcctgttagttcagtgtagtgcagcacaaatcccagtgactaaacaccttggaagtaagaatccttgacctggatttggaagacctgggctgtgatctctggcgttttgcttattggctcttcaaacttcaacaggcccctaagttttccaagcattggtttcttcttacataaagtaaaccatcatcacaagtgccctgaagatggctgagatcatggaatcaagtggtgtgcaacagagtgagctttgtggtttctttttgggcttaagttcctggaaggcagggattgtgagtagctcacgcgaacgggctttttagtgcctgcaaactgaaactgagcagatggtcatggtgattttcttcctagtggaactgaaaatctttgttctttgtctaggtcaatgctggcccactagcatatgcgcgagctttcttagatgatacaaacacaaagcgatatcctgacaataaagtgaagctgcttaaggaagttttcaggtaaagcacactgaaagcatctttttctcttcgagtattgatcatttctgtactcattcgggagggagatgctgctggttggactcatgccttatcctctgcgtgcctttgtttctcccgcctgtaccattccaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagggccgcactggctccaacaacttggagttcttggttaggggtttcaagtacaccctatcatgacttaggccgcctgatatccttccagaactgtgacatctgaaggagaatgtagcataccacactcctgccatgctctagccccaggtcatttgggaacagctaacagattgcccatatgctgttatctacggcaagcaggggagagcgggcccgcctcctcgtggctctaagaggnggccatgtttcctaagctttctctctccccacccccgtctagccaaaaagaaaagaaaggaaaaactcacactaaaatatccatactgttctgacaactttattcctttaatcctttgaaaaaagcaggacttgccaacctggtttaaggaattatctgttgcattcaatgtttttgctgtttaaaaatacagactgattccatttttgacgatgtacagtgggccttggcgccccagtggattcttcctttaagttccttgtcactatgggcatcttccctgattattttgctgttatctctttcctgtgggtttgttcagtaggattctatgtgtgggctcagttgtcacagaggagacagtgtcccatacccacaaaaaaactagagcagcatcaaantatttaatttgtgaggggtctgtctcagtcactgtcctttctttataattgacattagcaccttgataacacagaactgctctgtctggcccctccattatcgtccttcagtctggcacagtggaagccagggccgtttgtggagtgatcctatcccctgacagtttagttagtacattttcattgcaggaaacgaacgtcangttgttagctttaactcacttgctttttttctcctccatgctaacacgttcagctgggatggtaatgtcatttttaaacattatttttctgataatctgacttagaaaaagctattacttttttgagtttgagcaactacagacattggcataatgacagtacatgggcagaggaaagcaccctcttctggacattttaaaaagtagaggccagacatggtggctcactcctgtaatcccagcactttgggaggccaagatgggtggatcatctgaggtcaggagttcgagaccagcctggccaacatggtgaaaccccatctctactaaaaaatacaaaaattagctgggtgtagtggcacataccctagtctcagctactcgggaggctgaggcaggagaattgctggaacccaggaggtggaggctgcagtgagccaagatcatgccactaccctctagcctgggccacagagcgagactccatctcaaaaaaaaaaaaaagtagaaaaaaattgaaacgattagagaaatgaatgtctgaataattaagcagaacaggagggactcatgggaaccgattttcagagaaaacttgagatcttttctgtggagcctccagattcctatagaatggagagtttggtcagtgggtgccgacattgggcactagagaagatgaaagtagtaagagatcttaggctgaaactgttaaactcccaaagtacagggatatttaatgcacttgctgtcagctgcaccttgaacttcccattatgccaacagctgtgaagactgagcccccgtgaacccctgaagggccgtggcgggggtagacttgctttcgatgtttccaggggagcctctgctggaggtgaagacctacactcagatccttccaggcaccactgggcatggaaagatacttgttcagggtcagaggagtagccaccctctcccaagacaaaatccgtaagaccctgagaaaaggaggcaggagagaaacacaaatgcttcaaattcatttttaaaggctttttcaaggtcaaggctaggttgtgtcccagtcaagcacatgtaagtagacctcacgttgccttaagtagacctcacgttgccttatgatctggtgagcgtagaaggctctccattcactagctttgtaaaagaaacaaaatgtgctgttcttgactttctccttataatcctcacctgaaaacagtcatttatgagataagctgaacatctccctctgtaaaccagcagccaggctttccggctgcacatcactcacgtgatggagtgagtgtagacttgtgtgtgtgatgtggggtgcaacacattgagaaatatctgcttgcatccttatactcagtaacattgtgttgcacgtggcaacattgccttaaactctgtaacattttgttacacttggtaacattgtgtcacacatggcaacatggcattgcatatggtaaccttgtgttgccctcagtaacgttgtgtttctgtcctcgagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 10978 - DNA, 16808 bp, Homo sapiens
aggatgtgctgatggagctccttgagcagtgcgcagatggactctggaaagccgagcgctacgagctcatcgccgacatctacaaacttatcatccccatttatgagaagcggagggattttgaggtatgagagtgcctttttgtttttttcctatttgagagcatgacgctgtgacatatacccagacctgcatatatgtgagagaggaagcaggccatgggccagagatgagtgggggtctctgaccctccacgttacgctgaaggtggtggccagtcatcatctccaaatagtcatcgggtatcacccagacctgggccctacctctgtggagacccccacatctcaaactacagagtaaccggcactccactttcgaaaggctgccatgaacagagttttgtgatcaccagttgtcccttttctgagaactcttccttactccacctgcgtgaaaaaatggtgtcccttccgtccatcctgggcttgggaggtcatccagtttctctaggcatatcaaacagagcaggaaaagcaaaggccaagaatcacgttggggaaccatctctgacatcgcatcttaacttgaaaacagagtttgcttactctaatgtggaaatgtgatgggtcctcacgtgtgggctggcctttgggtaggaaatgttaccattcattaatgatcactacaagttgtgcagccaaaatgtgtgtgtgtgtatttttattcaagttcaaggacttttcacctccattatcacatttgttattttaaaatcgattctcctctttgcacatgggaagaaatgggctttgttctgctttccagaggctggcccatctgtatgacacgctgcaccgggcctacagcaaagtgaccgaggtcatgcactcgggccgcaggcttctggggacctacttccgggtagccttcttcgggcaggtgagcctcctgtccattctgcagactgtcctaagtcctttaaaaaaaaacaaaaacaaaaacaaaaaaaaaactataataaagttatatcttataaattctctgttttctgtaattgctaatttgatgaatttgtcatatttagtatgattcttatcttcctcagtagtaaactttctgctttttttctttcttcctgtcttttctttattactttcttaaggcagcggtaagttcttcctccttaagacattcttagcaacatctttggtacttcagtgtggtttgcaagtttgcttttcaagtctgtatgtttatctgtctagttattacaaactccaaaaaaattaacattttattccatttacagaaataaatcacctgttttcttatatatctatattgcatgttttaaaccaaaattaagactttctggtgtcctttgtgcctgtgcatctttatcctttgtagtataatatctccacaagtatatttacagtttttcagaaaccctataggaaagggtttatctaaatttaacttaaattttaaccttcgagtcccttaacattattaaatggtataaattataatacatatatttagggcgtgtggttttctatgagcattatataaccttcaatttattctgttattgtcttttataactttatagcaataccagtttacagacagtgaaacagatgtggaggtaattacagtaaatgcctaaaaagcaagtaatatagtgaaattactgcgtctaaactcctagtttgatgtggatgttttttgtttcatgctagcttgcatttttttttactgttttgtgcaccattttctctctcttaatttacgtgagaaactttaaaaaattttcttttaaacattaaccccagttggactttttaattttcaacctttttcacttcccatgcaattctaagccttgtagtcaaacatgattggtgctaaaacagatgatgactggtgatatgaaaatattttctgatattgagctacaggtctttaatatttttttctcatcggtaaagcaaaatacaatttatacaagctttacctaacttttactaaacttactccagacccccaaacgcttcagttcatgccataaaatcctgtgtgcatgggagccatcaggagaagggaggcatgtccacttctgagcctgcctgtcgtgggctgctcatcattttctagtgagttctgcttcttgggaaagtgaaacaggcttgactcccattagacttccctgggacagcttagtcttgtatccaaaatctttcatttcactcaacacttaatgactgcattcttgaataagtttgcaatgttgtgtttttcctttacctttgcacctagacttcatgttattagcattttctttctcattcagaaagcccatttcagcaggatttttagacccattcctttttttcccccttgtaataaaagaacgcttcctaggtggtaagccctgggcttacgttcagggatagctctaattgtgctttatgtcacagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtatgaccatgtttggataagtttcatagcaatgtaatgttgtgattgattacatattatatatttttaaatgtatatagaaaaaaacacaagaaaaatattaaggattgttggccgtgagtggcaggtgtattttcttcctgatacctttagtgctttccattacatgcttgacattaaaaaatctttatcgcctaatttttgaaacatctaattttacaaaataattaacgtctgacaggatatgtcatttttagtccagctatttagaaactctgacagaatgaggcccgtggcttcgctactcactgcacctcttcctgcatgtagcacatgacttgccactctgtcactgacggctggatgtaaggacaggtgaacagatgggcggatgggtgaatggacacatggacaggccaaggaatgaactcaccagcagcgtgactgtgggaatggcgatcattttctgcttagagagctgtcctctggcattctgttctcatgaagacccttttggaacctgcacctttgtcctgtacctttgtgtgtcccaccctcctcaggacatctccaggaggtcaggtctccctctgcttcctgaaggtgaaacatggggcaagacggtttcactcccactgcctttaaattattcctgctaaagaaagttaagttttaataggtttggatacaattagaatgaatggccaaatggctttttctaaaatacaaataataactttttttttttttttgagatggagtctggctctgtcacctgggctggagtgcagtggcgctatctcagctcactgcaatctctgcctcctgggttcaagagattcttgtgcctcagcctcccgagtagctgggattacaggaacgcgccaccacgcctggctaatttttgtatttttggtagagacagggtttcaccatgttggccaggttgttctccaactcccgacctcaagtgacctgcctgcctcggcctcccaaagtgctaggattataggcgtgagccaccgagcctggcccaaataataactttctatgactttatgtattttcttctaaagtttcaggcacttttccatctgttttttcatttttcttcacaatcgtctctgttttgagaacagttctctttcatttgcctgccttataccagtatggtctccatgtgctctgcacagccatttcttttgtgtccctttttattgctctagaaggttaaatacaattaaaatgtgcaaaattgatttgttgatttgtcttcctaataaattagcttttgtttctgcataggaattgcctatgtttaattctctatcatgtcacagaaatgaaagtaccaccaattctagcaatgtggttttaaaagcatttatatgttaaatagaaactaaatttatcattagattagtctagattaatctgtacctgtattaaattaattgatctgcagctgttgcatctaatctcagctgtctgtagattaatgataatttggaggcctagcttccaaacattattcctaaaataaacatttatctctctaagccaaatatattaaaaatgcagtttaagaaacaatcagagaaatccagactggaggtcattcaataagaaaaccagcactttgggaggccaaggcgggcggatcacctgaggtcgggagttcgagaccagcctgaccaacatggagaaaccctgtgtctgctaaaaatatataattagctgggcatggtggcacacacctgtagtcacagctacttgggaggctgaggcaggagaatcacttgaacgctggaggcagaggttgcagtagctgagatcgcgccattgcactccagcctgggcaacaagagcaaaactctgtctcaaaaaaaaataaaataattcaatgttatgggaaaaatgaatgatagggaattcttctaaattaaacatgactagggacataacaactaaatgtaaagtgtgattgttgattagattctgatccaaacacaaatatctataactaacattctggagacatttgagaaaatgttaatatagactgggtattggatggtattagggaatcagtgttaatttgggtaggcatgataatgtattgcggttatagaagcaaatgtccttatttttaggagaagctgactgtagtatcctgacgtgtaccacttactttgaaatggttctactggaaaaaaaaaagtctgtatgtctgtgtgtgtgtgcacatccataagtgtatgtgtatgtatatttgaaacaaatatagcaaactgctagcagttgttgatccaagtggtggatatgtggatgtttgttgtactcttctctccgttatatttacaaataaaatgttggaaaataccacgtaggtaagaactgagtgattccttcatggagcaccaatctcccattgtgctgtttcaattaaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacaggtatgggccccagaagccgcatggacacgagcccggacacctcgccaaagagctgtccagagggattcagaagcttcaggactggaagggtctttcgagctcagttagccacccccacacccatttcagtttcacatttatctagtgcttccttttgaatacttgggatgtttttctgttgatctgttgacacttccttcttccacaagaccagaagctcatatccaatctaaggtcacttacccttctgagaatctgatgaaaatggcgtgccttatgtgcctagatgcttttgcacacagtctaaggtgacttatggactccaggtccagcagccacacccagtcctgggtctccgcacagggagggacccgtctcacacacctgtctcaggttctagcatggcctgctcagcggtctcaggctgtgagtaaatgggatgtgagcttggatcgccccacgctgttgcccccgggggctggccagctgccacttgaatgcctcctctgccaggaagctcactgcattcagtggctatccacgagttcagcttaggcagttttcactgatccctttggcactgtttagccagtgataacccactctgggaaatgtgttttgcatcatttcccggtccctggcaagtgtctagtcatcctggggtgatttttaccttctgtgggagagcttgacccatccctgcctcattagggtcagcgacatcactggggtaacctaacataaaatgctttcttgaccaagaaatatcagtgggagggccgttgagaatgccaggtgtgccagctttcaccacacgtcttccaaagagtggccctagttaagtcagaccaggaaagggcctgctccccggaagttggggttgttgagtttctgtctgggtaataatacacactatcataataagcggaaggagcgctgtggagatgctgcacccaggtgcttatcagctctcaccggcgaagcgtatgctttaaaaagagagactggatggcgtggggtttatatctcagtaaagctgttacaaaaaaaaaaaaaaaaatacaggtttttatgaattagcccaggacagcgtattgcagggagcttttcacactccctatgagggaaaagagatacaagttaaaacaaaactgtgttcttaaagtgtccctaatcctgcttgtaaaataagaagacagcatatataaagcacaaataatattgtcctcacaaacatcaccccaccccaaataatttaattatttttttaatgcacacatcagtagcaaattctcattaagccaaataactgcgcttccagatggaatcactttatgggaatcaccagcttacagtgtttatggttcagctgtgataactttccttctgaccctttaagtcagtggttacccaaggttggtccaggaccagcagcatcagcacccccagggaacttgttagagatggaagttccaggtccccacctccgaaactgctggatcagaaactctgggggcggggcccagctctttgtgttcaacaggccctcccggttatcctggtgcatgctcagattagagaactgctgcctttaataaacctagttcactgctgagtcagggtcaggattttttagtatggttattgttaaggcagtgtacggattcataaacattcattaccataggctgttttcccagggcacatttctccagggttacaggtcatcattttgttagagactactttagattagataaagcacatgagcaatgctctgtatctgcgggaacaaggggacagagagtgcgcttcagagagaggtggggcagacacctgtgttgttggcttggggattgccgtccacagctgtgggttgagacagcctaagcaatggcgaggctgtcctgggggtcctgtaggcctgggtcacagcctcattgtgtgaccttgggcaggtcactcttcctctctatgccttagtttcctcatctgtaaaatgcaagttaggacacttatctcattatattgtcataactttgtaaatagtaagaagcaagggaaagagcgttcttcattttttgctagatttcatccgctgttgagctagatacacacaccagggcgttctgaaggctagacctgagggttttccctcaagttatcaacccctcaggttcttcttccattgcattgctttgtacctaacctttggccttccaaaggtcaaagggagcccaggccttccctgccctctacaccaggaaaaggctcacctttctgggtagttcccagtcagctgactgtaactgtgcaatcatttgaaaaacctcatgatcaccctccagcctccttcagtggaaatttctgagcctgtcccaaagaaggggggcgaggagaagcctcctccacttctttcatggaacttttgccaaggagtttcttcccagtcactattccagagtcttccaaacctggattagcttccggccctccactttctattcaagacacacagaccagcagtcaccatacttatcactgggccttccccgtcctcctttctaaagggctggctcagtcggtcacctaattgtccaccttccagagccagtttggactctcatgcagccatttgggcagtaatgcattcattcattcaacaaaatgtattgcacactgaccatgttcccattggcaggctaatgaaacagacatctgtgggcctgtgcagctggcattctagccagaggagacagatgataaacagtacccagatgagtaaatataaccgtggtagaacgtgatctgtgttccagacaaagcaaaaggagactgggaacctggagttgacctccttcctcagaaacaggaaggcagccccactcttcccctgaagcacagccccctgtccaaatacaagcaggcatctgccagcactgcctccctgactagggagcagcgaggccgagtcctcaccatcctaccagggagctttgtggatccccagtgctaccacttaaaatctgtgaaaccaagtcgggaacccttcacctttcactgataaaacattgtgaaaaggcaacaggcctataagtacgtgacatatgaggttgcctcagggtggacatgttttccgcttttgtccagatgttgggtggcccatcggaactctgtgtttcacaggggctgggcctgtttcccatcctgtgatgagtccttcccaattgaactcttccctagccagttgctaactagagaccaggaccactcccatctgacgtttgcttgttcaaaaaaaataataagcttttaagtacatatctacctgcctattagtaaatatatgtcaagtgagaatattatagatatttctatattatatagagcaataagaaatgtgaaatagtaaatgagaacctgctgtttttctgttcatttttaaattaactcctttgtgttgatgtttaggtatctcattatgataaaggaaaacaatattaatcagatttttttggttaaaaaatatataagaaaaagtaaatatttttatttttatttcttattcattgctgtaagtttcaaaatacctttattagcactacagctccaaaagtttgtgaatttctggttcatgaaatcctttgcttaggagtatattctttgtgtttttttggtttgggttttaggggaatggtttttgttttcttttttgagacagggtctcactctgtagcccaggctggagtgcagtggcacaatcacagctcactgcagctttgacctcctgggctcaagcctcctgtgtcagcctccccagtagctgggactacaggcatataccaccacactcagctaattttttgtattttttacaaaattacaaaaattaggtttttgccatgttgcccaggctggtcttaaactcctgggctcaagtgatctaccagccttggcctcccaaagtgctaagattacaggtgtgagcactgtacccaccctaggaatatattcttacttattattttctactgatttctcagctttgtgcaagcttagcatgtgattcaaagttattctatggacaaaaatgaattttctcaaggatatttttatggaactattttctggacttaatctgttatgtagtatctcaaaattgtttagtcttttttatgttgtcaaagtcatcttatatccactaactcattcaaacctcagagcttccaaggaaggtttgagtggggaatgataacctcatttatttaaagacacgcttgtcacattaaaaggataacaaggacccaactctcttgactttacgagacacacgattgtaaaggaagacaatattctagctccatcaagtactagtatgtgtctttggcaagctttgggttccttattttaaaaatgtaagtaataatgacatgtataataatcacttctaataataatcagctcaataacactaaagctcgtgcaagccatgcagtaattctggggcttaccctctgcagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtgagccaggcacagcaggccggagggcagcaggggacgtccttgcccctgggtgacttgagagtcgtttccactaacaaggtctacttgagagcctcggtttaccaagtgatccctgctcccttcccccaacgtctgtgacatttctcctgatatcagagggggaggaaacctcatgatccctgccccccgccccatgaggactgactgtggggacaagagccagatctcatacactaccctgatttgtcagtatttggggaattctgggtgcctgattagaagcatcaagactcttctaaatacaaagaagtgtggagagcagtagattttcctataaaactgttgtttgctgttttctatgaaaattgtatccaaaaaagtaccttaagttttaccctcttaatggtatcttttgattaatgaattcattattttaatatagcccaatcaatcaatttttctttattggtagcatttttatgttctctttaagaaatctgtgtctactccaaaatttcacagatgttctcctaggttttcctcctttgctcagcatccacatccaggtctgcagtccatctggaattgatttttgtatatgttatagtgtaagggtcaggatatattttttccatatgaccttccaagtgatatacacaatttattgaaaagatcatctttgatctagatactaacatatatgttcagtttgtgaaaattcatcaagctgtatacacttgtgatatatgcgctttcccgtttgtatattatactttagtaagaggtttttaaaaagttatcttacttacatggtttcctagttaattggtaagtgttaaatcactccctccagtaacaagtatgactcttattttctggtatttttaagtgtatatagttcaagcacatgtttgttcatatgtatatgtacatgtgtgtatatatgtatttgtatatcctattgttttatctttcaagaagggtatgtttatgaaagttacatgtggattataatacataggttttggtttttttggttcattttctgaaattatattttgtcaacttcccatcagatccacgctaaagaaccgtgagttgttgcccaacatttttgtgtcattcaccacaaaagcatttacagatgtttttaatctctttccttatagtctcaaagacatatgtgccaaaataagttagcaagtgaacataagtattccagcaacatgagtgattatgtaacaggtccagaggccacaattttctgtagctaaaaacaaaaccactcaatcaacatgatcttggaacatccagcccctatggaaaggccgctggaggggtgtggcaccagtccagggtagggctggaccattgagctttgtaaaaggcaaaatatgccctgctaatttgatggtaaacttagcgttttataaaattcccagtcatcttaaaaagcaagaaattccatgttgaaatgagaagattaagtttatactcatacctaccaaagtaacaacaaagttgcagccagaggaaattaactttatcattttatttgcgtatttctgtaattgtttcatcaagcagctcactggcgctgcagctttactgggcagagccgtctgcggagcttcttgtcattgcactccaagatcttgctattagaccttatggagtctcatcagccttcctctttctatcttcttcaaatacagaccgtcttgtatcattttagatgatcagtcattttggtcgtcttcaggtgatgaatacagttccccccacgcaccagcctggtgctgagttccaccctcaacgcaccttgggctgttcacccattgcccccggctcagaggtccccctctgaccactgtggctggaacctggaaccctcctgtgtctccacgtctggtgtgagttcctgtggctcagttttcctgccattgctagacaagtcctgcctaccatgggtcagaaccacacacggggagctcccctaattccttgctaagctcaccagaccttccgggaaatatcaagcagtgaccacatagtcacgttcttccccaggctgtctcagacgcctggaacattcttcttcccatcccagtgtgtccagccttctttctcaccacgttcttacctttccttacttatccagaatcagcagacccttcttagctgcttgcaagggtggtgcagggttctggttcactcaccgtgctgtctgctcctaacatctagctctccagcacaccgcaaacgctcacttcatcccaggatagcaaatcagtttgcccatggctgtctatacaattcaatgaaatgaacagttgggtttcaaaaactggaatagttactgcatttttcaatttttcactgaattcaccagattggcctgttagttcagtgtagtgcagcacaaatcccagtgactaaacaccttggaagtaagaatccttgacctggatttggaagacctgggctgtgatctctggcgttttgcttattggctcttcaaacttcaacaggcccctaagttttccaagcattggtttcttcttacataaagtaaaccatcatcacaagtgccctgaagatggctgagatcatggaatcaagtggtgtgcaacagagtgagctttgtggtttctttttgggcttaagttcctggaaggcagggattgtgagtagctcacgcgaacgggctttttagtgcctgcaaactgaaactgagcagatggtcatggtgattttcttcctagtggaactgaaaatctttgctctttgtctaggtcaatgctggcccactagcatatgcgcgagctttcttagatgatacaaacacaaagcgatatcctgacaataaagtgaagctgcttaaggaagttttcaggtaaagcacactgaaagcatctttttctcttcgagtattgatcatttctgtactcattcgggagggagatgctgctggttggactcatgccttatcctctgcgtgcctttgtttctcccgcctgtaccattccaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagggccgcactggctccaacaacttggagttcttggttaggggtttcaagtacaccctatcatgacttaggccgcctgatatccttccagaactgtgacatctgaaggagaatgtagcataccacactcctgccatgctctagccccaggtcatttgggaacagctaacagattgcccatatgctgttatctacggcaagcaggggagagcgggcccgcctcctcgtggctctaagaggtggccatgtttcctaagctttctctctccccacccccgtctagccaaaaagaaaagaaaggaaaaactcacacgaaaatatccatactgttctgacaactttattcctttaatcctttgaaaaaagcaggacttgccaacctggtttaaggaattatctgttgcattcaatgtttttgctgtttaaaaatacagactgattccatttttgacgatgtacagtgggccttggcgccccagtggattcttcctttaagttccttgtcactatgggcatcttccctgattattttgctgttatctctttcctgtgggtttcttcagtaggattctatgtgtgggctcagttgtcacagaggagacagtgtcccatacccagggaatgcctagagcagcatccacattgttttttttgtgaggggtctgtctcagtcactgtcctttctttataattgacattagcaccttgataacacagaactgctctgtctggcccctccattatcgtccttcagtctggcacagtggaagccagggccgtttgtggagtgatcctatcccctgacagtttagttagtacattttcattgcaggaaacgaacgtcagtgtgtgagctttaactcacttgctttttttctcctccatgctaacacgttcagctgggatggtaatgtcatttttaaacattatttttctgataatctgacttagaaaaagctattacttttttgagtttgagcaactacagacattggcataatgacagtacatgggcagaggaaagcaccctcttctggacattttaaaaagtagaggccagacatggtggctcactcctgtaatcccagcactttgggaggccaagatgggtggatcatctgaggtcaggagttcgagaccagcctggccaacatggtgaaaccccatctctactaaaaaatacaaaaattagctgggtgtagtggcacataccctagtctcagctactcgggaggctgaggcaggagaattgctggaacccaggaggtggaggctgcagtgagccaagatcatgccactaccctctagcctgggccacagagcgagactccatctcaaaaaaaaaaaaaagtagaaaaaaattgaaacgattagagaaatgaatgtctgaataattaagcagaacaggagggactcatgggaaccgattttcagagaaaacttgagatcttttctgtggagcctccagattcctatagaatggagagtttggtcagtgggtgccgacattgggcactagagaagatgaaagtagtaagagatcataggctgaaactgttaaactcccaaagtacagggatatttaatgcacttgctgtcagctgcaccttgaacttcccattatgccaacagctgtgaagactgagcccccgtgaacccctgaagggccgtggcgggggtagacttgctttcgatgtttccaggggagcctctgctggaggtgaagacctacactcagatccttccaggcaccactgggcatggaaagatacttgttcagggtcagaggagtagccaccctctcccaagacaaaatccgtaagaccctgagaaaaggaggcaggagagaaacacaaatgcttcaaattcatttttaaaggctttttcaaggtcaaggctaggttgtgtcccagtcaagcacatgtaagtagacctcacgttgccttaagtagacctcacgttgccttatgatctggtgagcgtagaaggctctccattcactagctttgtaaaagaaacaaaatgtgctgttcttgactttctccttataatcctcacctgaaaacagtcatttatgagataagctgaacatctccctctgtaaaccagcagccaggctttccggctgcacatcactcacgtgatggagtgagtgtagacttgtgtgtgtgatgtggggtgcaacacattgagaaatatctgcttgcatccttatactcagtaacattgtgttgcacgtggcaacattgccttaaactctgtaacattttgttacacttggtaacattgtgtcacacatggcaacatggcattgcatatggtaaccttgtgttgccctcagtaacgttgtgtttctgtcctcaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 10979 - DNA, 1263 bp, Homo sapiens
tgttaagtccatttagcaagatcacaggatacaagattagtatacaaaaattaacttcttcattcttatactatggttttactgtatagttcatgattacttaatgtaatttttagaaacaaataagctggatgatatttaatcttattcaaacaaagcactttcctttaaagtgatcatcaaaactttaaaacagtgctatttacaatagcataaaaaatatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgcttggcagcactctgtaccctgtggagtactcagtaccttttgtttgatgttgctgacaagacctgaaaaaaaatcccttaaaaaaaaaacccattaaagtgtagcaaaaccgaaaaaaaaaaaaaaaaaaaaaatcctgtggtttgacacaaggatgggcacatatatcaatggaacaaaacagagagtccagaaatggacccacacacttatgatcagttgatttttgacagaggttcaaaggcaatccaatagagaaagcatagtctctcatcgaatggtattgaaacaattggatatacatatgcaaaaaagaatatttatacttcattagaaaataacccaaaatgggtcatagtctaaaatgtaaaatgtaaaactataaagcttctgg

SEQ ID NO: 10980 - DNA, 376 bp, Homo sapiens
tgggaagagataaagaggtagcaaagggtcgccacgacccaccagaatccacagcccacttatgcactcatgacgccattgggacttacccagcatacgtttgttccatgtcgctgacatcccagccggggctaataaaccttaaggcaaacatcagcatgtctgggagaagagcctggcgctgagctggatcgtctagtcataaatgcctcatccagaaaccataaaactcaagtcaccatgtagtaagataaatagaagtctagaaagagcccatgtcagataaaggtaagtttggaaggcgaccaagccttgcttatgacaggagtggagagaggagccatctctaagttgggaacatcctgcagggaaacat

SEQ ID NO: 10981 - DNA, 1261 bp, Homo sapiens
tgttaagtccatttagcaagatcacaggatacaagattagtatacaaaaattaacttcttcattcttatactatggttttactgtatagttcatgattacttaatgtaatttttagaaacaaataagctggatgatatttaatcttattcaaacaaagcactttcctttaaagtgatcatcaaaactttaaaacagtgctatttacaatagcataaaaaatatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgcttggcagcactctgtaccctgtggagtactcagtaccttttgtttgatgttgctgacaagacctgaaaaaaaatcccttaaaaaaaaaacccattaaagtgtagcaaaaccgaaaaaaaaaaaaaaaaaaaatcctgtggtttgacacaaggatgggcacatttatcaatggaacaaaacagagagtccagaaatggacccacacacttatgatcagttgatttttgacagaggttcaaaggcaatccaatagagaaagcatagtctctcatcgaatggtattgaaacaattggatatacatatgcaaaaaagaatatttatacttcattagaaaataacccaaaatgggtcatagtctaaaatgtaaaatgtaaaactataaagcttctgg

SEQ ID NO: 10982 - DNA, 376 bp, Homo sapiens; identical to SEQ ID NO: 10980

SEQ ID NO: 10983 - DNA, 376 bp, Homo sapiens; identical to SEQ ID NO: 10980

SEQ ID NO: 10984 - DNA, 1263 bp, Homo sapiens; identical to SEQ ID NO: 10979

SEQ ID NO: 10985 - DNA, 18007 bp, Homo sapiens
tcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggtaatgcttgttcaagttcgcttaagtgttcactcagcccaacacgcgggttgggcttgaggttcggcacccgggcagcctcaccccccgcgtcaggcgcgcgcacacagtaggtccgcgacccttagccctccactaggcagcccgcggggatgggtggccgggccgcccacacgggcagcaccggcactgcgcatgctcggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggtaacctggccagggggctcgagggtggacgccgcggggcgggagcgtggtgtgcagaggggccgggcctagggctgggggtcggcggggactctggggaggagtgggagcttcacggctgccacccgttagagggccctggcctgagaaggagtgcgtcggggggcggggggtgccaaccctggcttctccccaggattccttcctgctgagcctccccaacccccgccgagctcgatgtgaggaggagggtttgcaggacagccggggaaaatgtcccttctcggctcactgagtatattgaaccagtctcggtcctctcaagggattttatcagaagcattgagcatagattgaggtaagctgtcacagcgcctgaattcgggagggagctctggcaagaggagacacttgttgattgctcttctgcggaaaagccaggcccaccgacagtccctgccggcaccttgaggagccctgggtgtaggacgcatctgccccgcgaggcgtcattccctgggaggatgttggcaggcggtcctggcggagtggggttggagggttcgtctccgcggcgtcggtgccgtccaaatgagagactgagctaagttgcagagcttgacagtgcagattccatgagactgttccatattggaatacgtagtctctgccctatgcctttctttggtttagaataaattgttcatctgagaaactaatctctggctggggcttaaagaatcagggatgcaataattccaaacgatttaatttatagtggactcaaatatttattgcataaatgaatggctgaatttatttttattaaattaatctggaggatagaaaaggcaattgcccctgcccctaaactttcagaagtagttctctgaccgggattaagtacttagcctttataatttattaatcgcacctgtgaaacaggagtaacatgatgaagacatggactactcatacacatgagctattcaagtgaaggtgatatttaggtcaaactcgattatgaaaaataaaaggaaaacctccaggtggcatctgaggccctacttatttcaagtagtagttgaattgaccaaatgtcaactcagccgatcccagatataatagtttgtttttgtgatcatactgtcaaaatcaaagtaagaatggtttagagctccactgtaacacaggggagaagaaagatgctgtctatattacacttctcccatttcctttcctcatccttcagatacacattatccagatggcattttatttgtcgattcagccaatatttttgagtacctattagcctggcatagtgtgagactctggtacaatactagatcttcaatataaccaaacctgcaaggtgatttatgataaacttttaatcacagaatgtcacatgaaaagggacctcagtagatcaccatacctctttatagatgtcccatagacatgacagctgaggcctagacaggcctttactacaaatcaagcaatgtgtttgaccttatggttacagaggtaactgagatgtgttcctgtcctggatgccttaaatctagtaaatgaaacagccaacctcagtacaaatgttgtgataaaagtaagcacaagtgttatgggaacacaaaaatgttgaaaaatgcttctgactaagatgaaccctgagctgaatcttgaagaatgagtagaaatagctaagtgaggaagaaggcattccagatagagcaagcagcgtatgcaagccaactggacagagcaggggaagctcttgaagtcagtttagaatgactgctaggcaagagttagaaaactaaattacaaaggataccccacagaactcaggtcccctcgcattacctgtacttagagtttgcaataataaagcagactcttgagaagagagagaaatacacttctcagtgggatttatacgctcagtctttcattacatattttcctactaatggtgttcttagtaggaaaagctcccaacttaaagaaactaaaaaataatgtatttgacaatacattaatccttaaattttccatttttctagaaattcatctgagttcttgatctcatttatttcttcacagatgtgtgctttacagtgtgcccagcattttaccatatactaactggttcaagtctgaaaggcacctctgctttgagtctgcttgccagagataagataggaggcaaggctaatttatgttctgtaatatagtgcaagtatatctggtagctgtgttaaagatgtgtgttaatataaacattaccctcccccccctggccgccctgaaataacatatgactaaaatttgcaattgtaaaacttaccatctttggaaccagtaaaattaaatgggttttattattatctagcttaccttgaaggccatttccctgattgccacatttctttacagtaagtgttgagcaagtttcatttcctaataaatctattagctaacagactgaactgaggcaacatgccattttcactggaaggtaggatttagtttaatttagcaaacatttattgagaataaaaggataaaattaaagtcatctgattgaaacctttattaggctccaagtcacacacagtaattccagtctagctttattccactgaagccgatccaatatataaaaattggatttatagacagataaaatagaaggggtttctttacaaaagcatttactattaaaagtctttgactaagctttcctagtacatataaaatacacagaagtcatattttcatagaacacatttaataacatgctagctgtataaaagaagtgacatcatcttacggaatatatatatatatgtgttttttttttttttttgagacagggtctctctctgtctcctgggttggagagcagtggtgcagtctcggctcactgcaacctgcatctcccaggctcaagcaatcctctcacctcagcctcccgagtagctggggctactgtgtaccaccaccccctggtaatttttgtattttttgtagagacggggtcttgccatgttgcccagccttgtctcaaactcctgggctcaagcagtccttccacctcagccttccaaagtgttgggattacaggcatgagccaccacaccctgcctggactgtattctcttaagtgatccatgaagcaaaaactatctgctacagccaggtatggctgcacaagcctgtagtctcagctactcaagaggtggagcagaaggatctttggagctcaggagtttgaggccatcctgggctgcataaggagactctgtcccaagaaagcaataactatttgctgaactccataggacaactaaatgttactattttctgaaacaaagttgttatttttagccacctaacaatacattttaacctagaacccagtggatttgtttattctacagtatcaaaaaaaattcaagtatcaagttatatctgattggtatcattaaacttacctgtgaagaagataactataaagaagcaatgttgtatttcattaacatgaaacattagagtattttctgttttgggacttgtagaagtttatggacactaaaattatttgggctttttgccttagactcaattatgtttggaacatctgtcacagcaccttgtcaactgcattctagaacatttctcctcctgatggaaaatacaacatgacctatgaggcagtcttgcaaaagaaaaaagaaatagcagaatctaatctagcctttcaagatcctgccacaatttataggaaataagagtaagaggtcaaaggaacatatttattgacacctcagcaaaatctagcttctacagaaaaacgacccagtttcatcccaaataaattacaagaaaaaagagtgaggattacaaaagacttgagacatatcaagcaattacaatgtggactttatttgaatcttgatttcacaaactgtgaaatatatgtattttacatatgacatcttgagaaatatgaatactgtgacttgatatttgatctaaggaattacattgataattattgaagttgggtcatgagtacttagggattaattctctttaagtgtttttctcataaaaagttttaaagtcttgtagaactaaaaaaataccaaagatgttctaattttatttcatttttttctaagaagaataatatttttcttttcttttttcctttttttttttttttttttttttatgatggggtctctgtcatccaggctggagtgcaatggtgcagtctcggctcactgcaacctccatctctcaggctcaagcaaccctcccacctcagcctcccaattagctgggaccacaggcgtgtaccaccacgcctggctgattttttgtatttttagtagagatggggtttcactatgttggctaggctggtcttgaactcctgacctcaagtgatgctcctgcctcagcctcacaaagtgtggggattacaggtgtgagccaccgcacctggccagaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattaggaaaaatatactacaagaactatttacatggcatttacattataagtaacctagagatgacttaaagtatatgagaagatgtgcataggttatatgcaaatatgccatatgagggactggaaaacccagggattttggtgtcctgggggctcctggaactaatcacctgtggatactgagggacaactgtaattaaattgatttttggatggatgcaactgatgttaaatttggcgggggggaaatgttaggattcacaataacgtgagtactgtgggttggagtagagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcatgtttcttcaattgtgtctttgatttttattccattgttcccatacatatgcagaaattgatcataatcatgggtatttgtaggttattactgtttgcatggaatttaactgtttccatactggtttatagaatacttaaaactatgttatggctttctttgtgaaaagaaatatcaataatggttgcttgtagtttaacatgggtttaaagtattcaaactaaggcttacgcatgactcaaaacccataatcttaaaaagattgatgggtttgaccacctaaaagtttaaaacctgtgtataagaaaaggcatcataaataaagttaagagaaatagccagctggaaaaactgtttattatatatgggcagaggattcatctcattacatagagcactcatatatttggaagaacagaggataaaaagatatgagtggactgttaatggcaaaataatacaaatggccattaaatatttgaagagataattagcctcattaataatttaatcagattggtgaataatgtgcatcgctgtccaagctgtgagaacactcatgcagtgtacatgaaaatgtaaattggtacagctttctggagggcagactggtgatatggatcaaaatgaaaaacatgcattcccttgatacagcaattctacttccaggaaattaattttaaggaaatagtggggaaagtaaatatgcaactataaagatgtttagtatagcattgtttatctggaaaaacatcatacaacttaaatattcattacctgttattaagtaatgatgcatccatacagtgaaaacactacagccatttaaaaggatgaagtaaatctttatacattaaaagagaaaaaaagttgctgtaactagttaagtgtgtctcactgcacttgtaaggttaataataattatttggaacagctcatctagtagacattgaatgctgctaaagattctgcaggtcagagatctatgtgtaacaggttaaaagcgtagcaacaaagcagtgtacagaatatagagaaaaattaatttaaaacattctagatacgtctttttttaaaaaaaaaaaaggaagccaggaataacatatgcatccctgttagcaatggctgcctttgggcagaacgtgtaacccagtttgggttccccaggaagcagactaggtgaagattgctgtgcaggaagtttattaaggagtattcttgggatcaacacctatggaagggagagagggaaacaaatgggcagggagaagaccagctgcaatgcagtcttaatggactgcttagccatcctcgagggagttctgaagatgaaataccctttcagagatgacctgagttgcaaagagccaagactttattagccgttgatcagtcattgggtggggattgagaggacagtgtgattttgctgaggcaatacccaaaagggctgacaactcaagtgttttcagatagaactctcagcagtttgggtaacaagttctttatttctgaaagggaatctgggcaacacaccagagtctaccttatagggttcactttttatgtgcttttaattttttttttttttgagatggagtctcgctccattgcccaggctggagtgcagtagcacgatctctgctgactgccaacctctgccacccgagttcaagcaattctcatggctcagcctcccaagtagctgggattacaggtgcccgccaccacacctggctaatttgtttgtatttttagtagagacagggtttcaccatgttggccgggctgttctcgaactcctgacctcaggtgatccgtctgcctcggcctcccaaagtgctgggattataggcatgagcctctgtgcctggcctttacatttttgaaataacaaatatttgaaaaaacattttctttttgaaatacagaatgttaatagattttgggcttacctacagaatttttggcagcattcttaatgtctactagatgatatagtcattaaaaaattattggaagcttataacttcagtctgtaagtgatggcttatattttcaattctaattaaaatttggttttccaatataatttgacttttggtgtactgacatgtattttatgctaattttcttgattctttaagttttgagcagaaaattattttaaaagatgtatttaatggatatttaataattcagaagacagtgatttctggacttagagtaataagtatatacgtggaagtagatagatgttggacatattgatacattgttccagagttgagctacccttccttgatgagtcctaaaatgctgttctccccataggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacatttttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaaccaaaaagaaaaaacagaattttctaaatttattaatagaaccaaaaagattgctcacatgttaatgtctttccagaggtcttaatttcatgcagtattttgttatattttgaattgatcagcttacaataatgcattaatcatttccttattctggaaaattttgaaatattttcacactgaaaatattttgaatgctgtctaacattcatatctcttctggtacttactcacacagagtaggcacagcataccatttcatttcttattcttcttccatagaggctgccatctttttaccatcagatccaagtttgtgtttataattagtcatcaaataattggcattaccatgatgacttaccttctatctcctcttaatttttattttgaaataattacaggtccacaggtatagggaagtcctgtgtgccctttaacctcctccgatggtaacaacttgcataactatagtacaatatcaaaaacgaggaaatagacattggaacaatccacagtttacttggatttcctgagtttacaagcacttgtctgtgtgtatgtgtataaatagttgtttgcagttttattacaaggtagcttcatgtaaccaccaccacaatcaagatacagaactgttttatagttatatactccctttccctagccattcgtaaccactggcaaccactagtctgttctccattttgtaattttgatattccaagaatgttgtataagtggaatcatccagtatgtaaccttttgagattggcttttttcactaagtataattccctcaagatcagtccaagttactatgtatcagtagtttgttcctttttattgcagaatagtattgcatggtatggatgtaccccagtttaaccatttattggttgaaggacatttgagttgtttccaatatttggctgttatgaatggagctatggaaatatgtgtgtaggttttctcatgaacataattttcacttctctgggatgaaaccccaagagtacaattgctaagttctatagtaagtacatgtttgattttaaaagaaactgccaaagtgttttctagagtatcttatattaagttcccaccagcaatgtatgagtgatccagttcatcctcatcagcatttagtgttgctactttttaatttaatttaattaatttatttatttattttaagacagagtctcactttgtcgcccaggctggagtgcagtggtgtgattccagctcactgcaacctctgcctcccgggttcaagcgattctcgtgccttggcctcccaaatagctgggattacaggccccgtcagtaacgctgggctaatttttgtatttttacaaatttgtattttgtatctagaatgcaaaaagaacttccaaaacacaatattaaaaatattagcaatctagctgggtgcggtggctcacttctgtaatcccagcactttgggagcctggggtttcaccatgttggtcaggcttgtctcgaactcctgacctcaagcagtctacctgcttcagcctcccaaagtgctgggattacaggagtgagccactgcacctggcctttaattttattaatagccattctgataggtatgtagtggtatctcattgtcattttaatttgcatttctctaatggcttgtgatgttgaacatcttttcatgtgcttatttttcatctattaatatatattctctctctgaaatatctgttgatgtcttttctaattggattacatatatatatataattatttttttttttttttttttttttgagatggagtgtcactgtgtcaccccaggctggagtgctgtggcacgatctcagctcacagcaagctctgcctcccaggttcaactgattctcctgcctcagcctccagagtagctgagactgtagacgtgtgccaccacaaccggctaatttttgtatttttagtacagatggggtttcatcttgttggccaggccagtgtcgaactcctggcctcaggtgatctgccgacctcagcctcccaaagtgctgggattacaggcgtgagccaccgcgcccagccagatgctaatatttttgatgttgtgttttggaagttctttattctagatgcaagtcttttattgaatatgtggcttgtaaatattttcatcctcttaacagggcatttcacagagcaaaaatttttaattttgacaaggtccagtttatcagtttttccttttgtgaatggtgcttttggtgtcaagaactctttgcctagtcctaggtctccaagattttctttgttttcttttcttctaaaaggtttatggattttacatttaagtccatgatccagtcaagttaatttttatgtaaagtatgaggtttaggtcaaggttcattaatttgcctatgaatatccagttattttgcacaatttattaaaaaggctctccttctgccatccatactaatttttaatgcaggttttcaaaaatttttactttatatttttataggctcgagaactcttcctaaaagcagtagaagaagaacaaaatggagctctctatgaaggtaaaaattcagagcccaggttcatatcataacatttctgaataatgactctgttattaaccatatttttttttctataacttatttggtatagaacatcacttttcttaatacattcttccttcagtactcattggaaattggttccaggaccctttgtagataccaaaatgctcaagtcctttatatgaatggtgtaatatttacatataacttacttattatgtaaatagttattatactgtattttttttttaaatttgtatttattttaaatatttttgatctgtagttggttgaatcagagaatgtgaaacccatgaatacagagggccagctatatttgaaattgttttttaaaaaataaaaaatagaaattgtttttctatataacctgtctttttgcaaaaaaatattgctgggaaacatcatcatgttggtaggatgagcaaaataacttttttttacatttagctttagttattcttcattaataaagtatttaaaaattattcattttaaaatatgctctttttataggtgaaaattgcttcagaggatgggaatataaaggataaattgaggaaaaaatacatgtttttctttctaagttccaatttacatattaccaacagaaatatgtggtaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatatgtggtaatatatgtgtcagctttgtgtcttttattaacccaatagaaatgtgtaaataaagtgataggactatttgccatattaggtttgtaattatgctttccttttgtgatagtaaagataataattgatgcataggaaaaatccttgtgcttgaatcgtttgaaaatgccccaaaactaacatcattcagagttactgcatttatatgcaagtttcttctagtgatatttttctttagatttttagaaaggcccagttgatcaagtccctgtgcagccttcattggtttgtgaaattcgcatctccacttagtgtatggtgtaattcatccagaataatagaacatggcagaatatattgaatcataaactcctttgtagggaaaaagaactagtcagcctctacagctccaagttctactggtgtatctctgtggggagagttattgaatattacagctctaaactacctgtctaggaaatttgtaaaaaataagttttgaagattacttaggtaaataagaggcagctgggctaaaagaagttaaatttaaaggataatttaaaaacaaaaacaaaaactattctttattccacccagtaggaagcatttaattttcctcaactctgtgtcttagaaaagtttgcttagaagtgtttttggccaggcatggtagctgacacctctaatctcagcactttggcaggctgaggcgggaggatcgcttgaacccaggagttcaagaccagcctgggcaatatagcaagatgttgtctctacaaaaaatttaaaaattagctgagtgtgctggctggggcatgcctgtagccccagctactcaggagactgaggtgggagaatcacttggacctgggaggtggagtctgcagtgagccaagatcgtgccaactgcactccaacctggacaacagagtgagaccttgtcttaaaaaagagagaagtatttttgttggctatagcaattgcatcttcagagcccaaagaaagacaactatttaaaaatcatgatacgtaagagggtgaggaaaaatatgggaagggctaatatataagagtaaaatacaacatcttaagtttagggaaaagtttctttctgagcattaaggtttggaaatagttttgtgtcactgaactgctgttgcatgtagaaaaacagaatttggccgtttgtaaagaaagttaccaaattaaaccacagttaagggtaatcaaaggaaatgacaaaaatgtgtggtcacagctaatttagctttatttcttcttttagccatcaagttttatcgtagggctatgcaacttgtacctgatatagagttcaagattacttatacccggtctccagatggtgatggcgttggaaacagctagtgcgtatataatttgatagatagtaatgcatagagtttgttaaagttaagcatctttgccctgttgactcttaagatggtgctaattctgttgagctctatactctttagtatatctttgtttataaagttgtagaaattttttaattagggaaattgcaagataacacatagaaatgcaccttttaaacagatacaaaaataaacagatacaaaaataaacagatacaaaaaaacggtttaaaaaaataaaagcagtagttactgaaaggagtaaattaaaggacacatttcaactttctgaaacctatttgaagtagaaagttttaaaatgtaattaggctaaatttggcaaaatattaataatggttaaaattgagtgatgggtacatgggagtttattacactagtttccttacgtatatgtttgaaattttacattttaaaaaaggcttctaattaggaaaatgctgaactataaaagatgttattattctcttaatgtttttagtaaaacattaaaactctaacatttatttaaaagcacaggtgcagaatatattcctaaaagaaatcatgtttgaattgtatagttgccactgcatcaaagccatgaagtagcattggttttatatggataaagatcaagaaaacttatttttaaggcaatacttttgcaagacaattataaaattgttttggcttaattgcactatctcccaaaactcaatttgctgatattagaagagaagggagtctgtacccatgagagaatgtcaggttaaaaatagacagtacagagaaaaaagttttggtaatgaaatattatattagctattatattaatatattccctctgtcatgaaataattgtcacctttattgataacatatgcttattgccaatgttttttaactgcatatggtattaacacttaagctttggataagtcatattaaaaacattcccaacaaggtcaatattaatagcctgtttaaattttcagctaataatattgttcaccaaattagagttaacagtatgaggtagttcatacttaaaatgaatcacttgggttttttctaaaccttctttaaatttgggtagagtcgtttagactcagctcttagccagttttataaatatgtgccagatgctgttaagaaagattgtattaaaatattaaagaggcatttcttttctttcccattttttatacaaacccagacgctatgaaagttctttaaggattcatcttttttttttaaataagatctgataagccctaaaagtttgcctttttttttctttcctgtaacatgtttgtagaatagccattgagtccatctagcctcaaccacacttatattttgttgtattacaaaatgcccttcctggtttttttttttgtttttttgttttttttaagtctacatcacttgaaacttcctggttttctaacttcgccttcatccaatcctctttgtaagtctgatcatctttaaggtttacttcagtaaaaatagaaagctcatttttctagcaccattcactacacatttgtgtatactggtagatgatttgtgaaccctaagatgttttcaaagtaggtattttcctctctaaaggtaggctgataaggcaaatctgttagaaaacccttggtaagtaagtacctcagatgacgtctgtagatttggtttttatccagttagaataaattaaggttaaagaacatactacgttaagatttttgaaaccatttgaaagcttgcagtaactcataaaatctctactttacaataaaattagttaaatctcaacacctgtatccaaaaattctaattctttctggatgataattactgaagcttttttctttgaaaaacttgatacagtattcctttgcaagacaggataaattcatcacatttaaaaatgtatcacatgttgaataagctttaggtgactttttgtaaagcaaatttgaaaatgctatgaaaaatcagtttctaaactgtacgcttgtagactgaggcacttaatttattcacctcccttttttcagcattgaagataatgatgatgacagcaaaatggcagatctcttgtcctacttccagcagcaactcacatttcaggagtctgtgcttaaactgtgtcagcctgagcttgagagcagtcagattcacatatcaggtgtgaatacttgtttttcataactcagtgagaaatatcttaaccttaaagatttccaaatttataaggtcagataatttgccagataactgctgctttagttcagaatatggtggaagatctagttataattatcatttgcatatactattaagctgttttgtgttttgttttgtcttgttttgttttttgaaatggagacgtgccctgtcacccaggctggagtgcagtggtgcaatctcggctcactgcaacctctgcctcctgggttcaagcaattctgctgcctcagcctcccaagtggctgggattacaggcgtgtgccaccacacccagctaaatttttgtatcttcagtaaagacagagtttcaccatgttggccaggctggtctcgaactcctgacttcatgatctgcccaccttggcctcccaaagtgctgggattacaggcctctgaggcactgcgcccagcccagtagtaagctgctttacaatctgaagcagaacagtttgtagtgctgttgtttaaggatgccatacctttttcagtaaagatctaacagggtaagtctgagttgttgaggtagccctaagaaaactggaggaatactggtatcatgaagcatttcagccatgttggacaattgtcctgagacagactgaatgtttaggaattaatggatttttgttcgggcatggtggctcacgcctgcaatctcagcattttgggaggctgagttgggaggatcacttgaggccaggagttcaagataagcctggccaacatggtgaaaccccacctctactaaaaatacaaaaattagctgggcgtcgtggcgcatgactgtagtcccacctacttgggaggctgaggcacgagaattacttgaacccaggaggcagaggctgcagtgagctgagattgtatcactgcactccagcctgggcaacagagcaagaacctgtcacaaaaaaaaaagaaattcatgtatttttaatatgttaaatattgtttggttcggggctttttcagaggaggacaattaaaagttttcaaggagatgaaaataactttagtgttaatagatgcaatatggatcacacacacatagattattttcctaaaacatttattttaatatgtctggcaaaataatcttatgagggaaaagagtgctttataaaaagtagcttcagatctatactgaaaaaacaaagatatttatgtcttgatgttaagaaccattattattattgagtagctaaatacattcatgctttagctctgagcaatacagagggtgtgattataaatttctaggaaggtataaatgtactgggaatgtagttgtgacaatagaatgacatagaggagagtcactgaaggatgattttcttttgcagtgctgccaatggaggtcctgatgtacatcttccgatgggtggtgtctagtgacttggacctcagatcattggagcagttgtcgctggtgtgcagaggattctacatctgtgccaggtactaagtttttgtttttgttttttaaacaactgaggcaatggtgaaaagaaagatggtcctttgccaatcctgataaaattacttgattggtgttctgagttaaagcttagaataaacaagttttgctaagctgtacttaactttctcaaataacttagaatttaaaggctagaatatgctaggtttctagggtatagaataatatgtaggacagatgtagtaacccatactactaccatagagtttacatgctagcttaactgatttgggaaaaagagttatattagaaaaatatattcaagtcatttttacactaactgtaaactcattgtggtaatggtttagattaaaacagcactagcattttcttatggctcattaaaagttattctatattttgaa

SEQ ID NO: 10986 - DNA, 8551 bp, Homo sapiens
gcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggtaacctggccagggggctcgagggtggacgccgcggggcgggagcgtggtgtgcagaggggccgggcctagggctgggggtcggcggggactctggggaggagtgggagcttcacggctgccacccgttagagggccctggcctgagaaggagtgcgtcggggggcggggggtgccaaccctggcttctccccaggattccttcctgctgagcctccccaacccccgccgagctcgatgtgaggaggagggtttgcaggacagccggggaaaatgtcccttctcggctcactgagtatattgaaccagtctcggtcctctcaagggattttatcagaagcattgagcatagattgaggtaagctgtcacagcgcctgaattcgggagggagctctggcaagaggagacacttgttgattgctcttctgcggaaaagccaggcccaccgacaggccctgccggcaccttgaggagccctgggtgtaggacgcatctgccccgcgaggcgtcattccctgggaggatgttggcaggcggtcctggcggagtggggttggagggttcgtctccgcggcgtcggtgccgtccaaatgagagactgagctaagttgcagagcttgacagtgcagattccatgagactgttccatattggaatacgtagtctctgccctatgcctttctttggtttagaataaattgttcatctgagaaactaatctctggctggggcttaaagaatcagggatgcaataattccaaacgatttaatttatagtggactcaaatatttattgcataaatgaatggctgaatttatttttattaaattaatctggaggatagaaaaggcaattgcccctgcccctaaactttcagaagtagttctctgaccgggattaagtacttagcctttataatttattaatcgcacctgtgaaacaggagtaacatgatgaagacatggactactcatacacatgagctattcaagtgaaggtgatatttaggtcaaactcgattatgaaaaataaaaggaaaacctccaggtggcatctgaggccctacttatttcaagtagtagttgaattgaccaaatgtcaactcagccgatcccagatataatagtttgtttttgtgatcatactgtcaaaatcaaagtaagaatggtttagagctccactgtaacacaggggagaagaaagatgctgtctatattacacttctcccatttcctttcctcatccttcagatacacattatccagatggcattttatttgtcgattcagccaatatttttgagtacctattagcctggcatagtgtgagactctggtacaatactagatcttcaatataaccaaacctgcaaggtgatttatgataaacttttaatcacagaatgtcacatgaaaagggacctcagtagatcaccatacctctttatagatgtcccatagacatgacagctgaggcctagacaggcctttactacaaatcaagcaatgtgtttgaccttatggttacagaggtaactgagatgtgttcctgtcctggatgccttaaatctagtaaatgaaacagccaacctcagtacaaatgttgtgataaaagtaagcacaagtgttatgggaacacaaaaatgttgaaaaatgcttctgactaagatgaaccctgagctgaatcttgaagaatgagtagaaatagctaagtgaggaagaaggcattccagatagagcaagcagcgtatgcaagccaactggacagagcaggggaagctcttgaagtcagtttagaatgactgctaggcaagagttagaaaactaaattacaaaggataccccacagaactcaggtcccctcgcattacctgtacttagagtttgcaataataaagcagactcttgagaagagagagaaatacacttctcagtgggatttatacgctcagtctttcattacatattttcctactaatggtgttcttagtaggaaaagctcccaacttaaagaaactaaaaaataatgtatttgacaatacattaatccttaaattttccatttttctagaaattcatctgagttcttgatctcatttatttcttcacagatgtgtgctttacagtgtgcccagcattttaccatatactaactggttcaagtctgaaaggcacctctgctttgagtctgcttgccagagataagataggaggcaaggctaatttatgttctgtaatatagtgcaagtatatctggtagctgtgttaaagatgtgtgttaatataaacattaccctccccccccggccgccctgaaataacatatgactaaaatttgcaattgtaaaacttaccatctttggaaccagtaaaattaaatgggttttattattatctagcttaccttgaaggccatttccctgattgccacatttctttacagtaagtgttgagcaagtttcatttcctaataaatctattagctaacagactgaactgaggcaacatgccattttcactggaaggtaggatttagtttaatttagcaaacatttattgagaataaaaggataaaattaaagtcatctgattgaaacctttattaggctccaagtcacacacagtaattccagtctagctttattccactgaagccgatccaatatataaaaattggatttatagacagataaaatagaaggggtttctttacaaaagcatttactattaaaagtctttgactaagctttcctagtacatataaaatacacagaagtcatattttcatagaacacatttaataacatgctagctgtataaaagaagtgacatcatcttacggaatatatatatatatatgtgtttttttttttttttttgagacagggtctctctctgtctcctgggttggagagcagtggtgcagtctcggctcactgcaacctgcatctcccaggctcaagcaatcctctcacctcagcctcccgagtagctggggctactgtgtaccaccaccccctggtaatttttgtattttttgtagagacggggtcttgccatgttgcccagccttgtctcaaactcctgggctcaagcagtccttccacctcagccttccaaagtgttgggattacaggcatgagccaccacaccctgcctggactgtattctcttaagtgatccatgaagcaaaaactatctgctacagccaggtatggctgcacaagcctgtagtctcagctactcaagaggtggagcagaaggatctttggagctcaggagtttgaggccatcctgggctgcataaggagactctgtcccaagaaagcaataactatttgctgaactccataggacaactaaatgttactattttctgaaacaaagttgttatttttagccacctaacaatacattttaacctagaacccagtggatttgtttattctacagtatcaaaaaaaattcaagtatcaagttatatctgattggtatcattaaacttacctgtgaagaagataactataaagaagcaatgttgtatttcattaacatgaaacattagagtattttctgttttgggacttgtagaagtttatggacactaaaattatttgggctttttgccttagactcaattatgtttggaacatctgtcacagcaccttgtcaactgcattctagaacatttctcctcctgatggaaaatacaacatgacctatgaggcagtcttgcaaaagaaaaaagaaatagcagaatctaatctagcctttcaagatcctgccacaatttataggaaataagagtaagaggtcaaaggaacatatttattgacacctcagcaaaatctagcttctacagaaaaacgacccagtttcatcccaaataaattacaagaaaaaagagtgaggattacaaaagacttgagacatatcaagcaattacaatgtggactttatttgaatcttgatttcacaaactgtgaaatatatgtattttacatatgacatcttgagaaatatgaatactgtgacttgatatttgatctaaggaattacattgataattattgaagttgggtcatgagtacttagggattaattctctttaagtgtttttctcataaaaagttttaaagtcttgtagaactaaaaaaataccaaagatgttctaattttatttcatttttttctaagaagaataatatttttcttttcttttttccttttttttttttttttttttttttatgatggggtctctgtcatccaggctggagtgcaatggcgcagtctcggctcactgcaacctccatctctcaggctcaagcaaccctcccacctcagcctcccaattagctgggaccacaggcgtgtaccaccacgcctggctgattttttgtatttttagtagagatggggtttcactatgttggctaggctggtcttgaactcctgacctcaagtgatgctcctgcctcagcctcacaaagtgtggggattacaggtgtgagccaccgcacctggccagaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattaggaaaaatatactacaagaactatttacatggcatttacattataagtaacctagagatgacttaaagtatatgagaagatgtgcataggttatatgcaaatatgccatatgagggactggaaaacccagggattttggtgtcctgggggctcctggaactaatcacctgtggatactgagggacaactgtaattaaattgatttttggatggatgcaactgatgttaaatttggcgggggggaaatgttaggattcacaataacgtgagtactgtgggttggagtagagaatatgcttttcagactcattttcctttggaaattaatagtaaggtctcaagtgccccctacagccttgctactcaaagtgggttccacaaagtgttgacagtatggtactaaatagaaagtggttgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcatgtttcttcaattgtgtctttgatttttattccattgttcccatacatatgcagaaattgatcataatcatgggtatttgtaggttattactgtttgcatggaatttaactgtttccatactggtttatagaatacttaaaactatgttatggctttctttgtgaaaagaaatatcaataatggttgcttgtagtttaacatgggtttaaagtattcaaactaaggcttacgcatgactcaaaacccataatcttaaaaagattgatgggtttgaccacctaaaagtttaaaacctgtgtataagaaaaggcatcataaataaagttaagagaaatagccagctggaaaaactgtttattatatatgggcagaggattcatctcattacatagagcactcatatatttggaagaacagaggataaaaagatatgagtggactgttaatggcaaaataatacaaatggccattaaatatttgaagagataattagcctcattaataatttaatcagattggtgaataatgtgcatcgctgtccaagctgtgagaacactcatgcagtgtacatgaaaatgtaaattggtacagctttctggagggcagactggtgatatggatcaaaatgaaaaacatgcattcccttgatacagcaattctacttccaggaaattaattttaaggaaatagtggggaaagtaaatatgcaactataaagatgtttagtatagcattgtttatctggaaaaacatcatacaacttaaatattcattacctgttattaagtaatgatgcatccatacagtgaaaacactacagccatttaaaaggatgaagtaaatctttatacattaaaagagaaaaaaagttgctgtaactagttaagtgtgtctcactgcacttgtaaggttaataataattatttggaacagctcatctagtagacattgaatgctgctaaagattctgcaggtcagagatctatgtgtaacaggttaaaagcgtagcaacaaagcagtgtacagaatatagagaaaaattaatttaaaacattctagatacgtctttttaaaaaaaaaaaaaaggaagccaggaataacatatgcatccctgttagcaatggctgcctttgggcagaacgtgtaacccagtttgggttccccaggaagcagactaggtgaagattgctgtgcaggaagtttattaaggagtattcttgggatcaacacctatggaagggagagagggaaacaaatgggcagggagaagaccagctgcaatgcagtcttaatggactgcttagccatcctcgagggagttctgaagatgaaataccctttcagagatgacctgagttgcaaagagccaagactttattagccgttgatcagtcattgggtggggattgagaggacagtgtgattttgctgaggcaatacccaaaagggctgacaactcaagtgttttcagatagaactctcagcagtttgggtaacaagttctttatttctgaaagggaatctgggcaacacaccagagtctaccttatagggttcactttttatgtgcttttaattttttttttttttgagatggagtctcgctccattgcccaggctggagtgcagtagcacgatctctgctgactgccaacctctgccacccgagttcaagcaattctcatggctcagcctcccaagtagctgggattacaggtgcccgccaccacacctggctaatttgtttgtatttttagtagagacagggtttcaccatgttggccgggctgttctcgaactcctgacctcaggtgatccgtctgcctcggcctcccaaagtgctgggattataggcatgagcctctgtgcctggcctttacatttttgaaataacaaatatttgaaaaaacattttctttttgaaatacagaatgttaatagattttgggcttacctacagaatttttggcagcattcttaatgtctactagatgatatagtcattaaaaaattattggaagcttataacttcagtctgtaagtgatggcttatattttcaattctaattaaaatttggttttccaatataatttgacttttggtgtactgacatgtattttatgctaattttcttgattctttaagttttgagcagaaaattattttaaaagatgtatttaatggatatttaataattcagaagacagtgatttctggacttagagtaataagtatatacgtggaagtagatagatgttggacatattgatacattgttccagagttgagctacccttccttgatgagtcctaaaatgctgttctccccataggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacattttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaacca

SEQ ID NO: 10987 - DNA, 18004 bp, Homo sapiens
tcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggtaatgcttgttcaagttcgcttaagtgttcactcagcccaacacgcgggttgggcttgaggttcggcacccgggcagcctcaccccccgcgtcaggcgcgcgcacacagtaggtccgcgacccttagccctccactaggcagcccgcggggatgggtggccgggccgcccacacgggcagcaccggcactgcgcatgctcggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggtaacctggccagggggctcgagggtggacgccgcggggcgggagcgtggtgtgcagaggggccgggcctagggctgggggtcggcggggactctggggaggagtgggagcttcacggctgccacccgttagagggccctggcctgagaaggagtgcgtcggggggcggggggtgccaaccctggcttctccccaggattccttcctgctgagcctccccaacccccgccgagctcgatgtgaggaggagggtttgcaggacagccggggaaaatgtcccttctcggctcactgagtatattgaaccagtctcggtcctctcaagggattttatcagaagcattgagcatagattgaggtaagctgtcacagcgcctgaattcgggagggagctctggcaagaggagacacttgttgattgctcttctgcggaaaagccaggcccaccgacaggccctgccggcaccttgaggagccctgggtgtaggacgcatctgccccgcgaggcgtcattccctgggaggatgttggcaggcggtcctggcggagtggggttggagggttcgtctccgcggcgtcggtgccgtccaaatgagagactgagctaagttgcagagcttgacagtgcagattccatgagactgttccatattggaatacgtagtctctgccctatgcctttctttggtttagaataaattgttcatctgagaaactaatctctggctggggcttaaagaatcagggatgcaataattccaaacgatttaatttatagtggactcaaatatttattgcataaatgaatggctgaatttatttttattaaattaatctggaggatagaaaaggcaattgcccctgcccctaaactttcagaagtagttctctgaccgggattaagtacttagcctttataatttattaatcgcacctgtgaaacaggagtaacatgatgaagacatggactactcatacacatgagctattcaagtgaaggtgatatttaggtcaaactcgattatgaaaaataaaaggaaaacctccaggtggcatctgaggccctacttatttcaagtagtagttgaattgaccaaatgtcaactcagccgatcccagatataatagtttgtttttgtgatcatactgtcaaaatcaaagtaagaatggtttagagctccactgtaacacaggggagaagaaagatgctgtctatattacacttctcccatttcctttcctcatccttcagatacacattatccagatggcattttatttgtcgattcagccaatatttttgagtacctattagcctggcatagtgtgagactctggtacaatactagatcttcaatataaccaaacctgcaaggtgatttatgataaacttttaatcacagaatgtcacatgaaaagggacctcagtagatcaccatacctctttatagatgtcccatagacatgacagctgaggcctagacaggcctttactacaaatcaagcaatgtgtttgaccttatggttacagaggtaactgagatgtgttcctgtcctggatgccttaaatctagtaaatgaaacagccaacctcagtacaaatgttgtgataaaagtaagcacaagtgttatgggaacacaaaaatgttgaaaaatgcttctgactaagatgaaccctgagctgaatcttgaagaatgagtagaaatagctaagtgaggaagaaggcattccagatagagcaagcagcgtatgcaagccaactggacagagcaggggaagctcttgaagtcagtttagaatgactgctaggaaagagttagaaaactaaattacaaaggataccccacagaactcaggtcccctcgcattacctgtacttagagtttgcaataataaagcagactcttgagaagagagagaaatacacttctcagtgggatttatacgctcagtctttcattacatattttcctactaatggtgttcttagtaggaaaagctcccaacttaaagaaactaaaaaataatgtatttgacaatacattaatccttaaattttccatttttctagaaattcatctgagttcttgatctcatttatttcttcacagatgtgtgctttacagtgtgcccagcattttaccatatactaactggttcaagtctgaaaggcacctctgctttgagtctgcttgccagagataagataggaggcaaggctaatttatgttctgtaatatagtgcaagtatatctggtagctgtgttaaagatgtgtgttaatataaacattaccctccccccccggccgccctgaaataacatatgactaaaatttgcaattgtaaaacttaccatctttggaaccagtaaaattaaatgggttttattattatctagcttaccttgaaggccatttccctgattgccacatttctttacagtaagtgttgagcaagtttcatttcctaataaatctattagctaacagactgaactgaggcaacatgccattttcactggaaggtaggatttagtttaatttagcaaacatttattgagaataaaaggataaaattaaagtcatctgattgaaacctttattaggctccaagtcacacacagtaattccagtctagctttattccactgaagccgatccaatatataaaaattggatttatagacagataaaatagaaggggtttctttacaaaagcatttactattaaaagtctttgactaagctttcctagtacatataaaatacacagaagtcatattttcatagaacacatttaataacatgctagctgtataaaagaagtgacatcatcttacggaatatatatatatatatatgtgtttttttttttttttttgagacagggtctctctctgtctcctgggttggagagcagtggtgcagtctcggctcactgcaacctgcatctcccaggctcaagcaatcctctcacctcagcctcccgagtagctggggctactgtgtaccaccaccccctggtaatttttgtattttttgtagagacggggtcttgccatgttgcccagccttgtctcaaactcctgggctcaagcagtccttccacctcagccttccaaagtgttgggattacaggcatgagccaccacaccctgcctggactgtattctcttaagtgatccatgaagcaaaaactatctgctacagccaggtatggctgcacaagcctgtagtctcagctactcaagaggtggagcagaaggatctttggagctcaggagtttgaggccatcctgggctgcataaggagactctgtcccaagaaagcaataactatttgctgaactccataggacaactaaatgttactattttctgaaacaaagttgttatttttagccacctaacaatacattttaacctagaacccagtggatttgtttattctacagtatcaaaaaaaattcaagtatcaagttatatctgattggtatcattaaacttacctgtgaagaagataactataaagaagcaatgttgtatttcattaacatgaaacattagagtattttctgttttgggacttgtagaagtttatggacactaaaattatttgggctttttgccttagactcaattatgtttggaacatctgtcacagcaccttgtcaactgcattctagaacatttctcctcctgatggaaaatacaacatgacctatgaggcagtcttgcaaaagaaaaaagaaatagcagaatctaatctagcctttcaagatcctgccacaatttataggaaataagagtaagaggtcaaaggaacatatttattgacacctcagcaaaatctagcttctacagaaaaacgacccagtttcatcccaaataaattacaagaaaaaagagtgaggattacaaaagacttgagacatatcaagcaattacaatgtggactttatttgaatcttgatttcacaaactgtgaaatatatgtattttacatatgacatcttgagaaatatgaatactgtgacttgatatttgatctaaggaattacattgataattattgaagttgggtcatgagtacttagggattaattctctttaagtgtttttctcataaaaagttttaaagtcttgtagaactaaaaaaataccaaagatgttctaattttatttcatttttttctaagaagaataatatttttcttttcttttttcctttttttttttttttttttttttatgatggggtctctgtcatccaggctggagtgcaatggcgcagtctcggctcactgcaacctccatctctcaggctcaagcaaccctcccacctcagcctcccaattagctgggaccacaggcgtgtaccaccacgcctggctgattttttgtatttttagtagagatggggtttcactatgttggctaggctggtcttgaactcctgacctcaagtgatgctcctgcctcagcctcacaaagtgtggggattacaggtgtgagccaccgcacctggccagaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattaggaaaaatatactacaagaactatttacatggcatttacattataagtaacctagagatgacttaaagtatatgagaagatgtgcataggttatatgcaaatatgccatatgagggactggaaaacccagggattttggtgtcctgggggctcctggaactaatcacctgtggatactgagggacaactgtaattaaattgatttttggatggatgcaactgatgttaaatttggcgggggggaaatgttaggattcacaataacgtgagtactgtgggttggagtagagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcatgtttcttcaattgtgtctttgatttttattccattgttcccatacatatgcagaaattgatcataatcatgggtatttgtaggttattactgtttgcatggaatttaactgtttccatactggtttatagaatacttaaaactatgttatggctttctttgtgaaaagaaatatcaataatggttgcttgtagtttaacatgggtttaaagtattcaaactaaggcttacgcatgactcaaaacccataatcttaaaaagattgatgggtttgaccacctaaaagtttaaaacctgtgtataagaaaaggcatcataaataaagttaagagaaatagccagctggaaaaactgtttattatatatgggcagaggattcatctcattacatagagcactcatatatttggaagaacagaggataaaaagatatgagtggactgttaatggcaaaataatacaaatggccattaaatatttgaagagataattagcctcattaataatttaatcagattggtgaataatgtgcatcgctgtccaagctgtgagaacactcatgcagtgtacatgaaaatgtaaattggtacagctttctggagggcagactggtgatatggatcaaaatgaaaaacatgcattcccttgatacagcaattctacttccaggaaattaattttaaggaaatagtggggaaagtaaatatgcaactataaagatgtttagtatagcattgtttatctggaaaaacatcatacaacttaaatattcattacctgttattaagtaatgatgcatccatacagtgaaaacactacagccatttaaaaggatgaagtaaatctttatacattaaaagagaaaaaaagttgctgtaactagttaagtgtgtctcactgcacttgtaaggttaataataattatttggaacagctcatctagtagacattgaatgctgctaaagattctgcaggtcagagatctatgtgtaacaggttaaaagcgtagcaacaaagcagtgtacagaatatagagaaaaattaatttaaaacattctagatacgtcttttttaaaaaaaaaaaaaggaagccaggaataacatatgcatccctgttagcaatggctgcctttgggcagaacgtgtaacccagtttgggttccccaggaagcagactaggtgaagattgctgtgcaggaagtttattaaggagtattcttgggatcaacacctatggaagggagagagggaaacaaatgggcagggagaagaccagctgcaatgcagtcttaatggactgcttagccatcctcgagggagttctgaagatgaaataccctttcagagatgacctgagttgcaaagagccaagactttattagccgttgatcagtcattgggtggggattgagaggacagtgtgattttgctgaggcaatacccaaaagggctgacaactcaagtgttttcagatagaactctcagcagtttgggtaacaagttctttatttctgaaagggaatctgggcaacacaccagagtctaccttatagggttcactttttatgtgcttttaattttttttttttttgagatggagtctcgctccattgcccaggctggagtgcagtagcacgatctctgctgactgccaacctctgccacccgagttcaagcaattctcatggctcagcctcccaagtagctgggattacaggtgcccgccaccacacctggctaatttgtttgtatttttagtagagacagggtttcaccatgttggccgggctgttctcgaactcctgacctcaggtgatccgtctgcctcggcctcccaaagtgctgggattataggcatgagcctctgtgcctggcctttacatttttgaaataacaaatatttgaaaaaacattttctttttgaaatacagaatgttaatagattttgggcttacctacagaatttttggcagcattcttaatgtctactagatgatatagtcattaaaaaattattggaagcttataacttcagtctgtaagtgatggcttatattttcaattctaattaaaatttggttttccaatataatttgacttttggtgtactgacatgtattttatgctaattttcttgattctttaagttttgagcagaaaattattttaaaagatgtatttaatggatatttaataattcagaagacagtgatttctggacttagagtaataagtatatacgtggaagtagatagatgttggacatattgatacattgttccagagttgagctacccttccttgatgagtcctaaaatgctgttctccccataggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacattttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaaccaaaaagaaaaaacagaattttctaaatttattaatagaaccaaaaagattgctcacatgttaatgtctttccagaggtcttaatttcatgcagtattttgttatattttgaattgatcagcttacaataatgcattaatcatttccttattctggaaaattttgaaatattttcacactgaaaatattttgaatgctgtctaacattcatatctcttctggtacttactcacacagagtaggcacagcataccatttcatttcttattcttccatagaggctgccatctttttaccatcagatccaagtttgtgtttataattagtcatcaaataattggcattaccatgatgacttaccttctatctcctcttaatttttattttgaaataattacaggtccacaggtatagggaagtcctgtgtgccctttaacctcctccgatggtaacaacttgcataactatagtacaatatcaaaaacgaggaaatagacattggaacaatccacagtttacttggatttcctgagtttacaagcacttgtctgtgtgtatgtgtataaatagttgtttgcagttttattacaaggtagcttcatgtaaccaccaccacaatcaagatacagaactgttttatagttatatactccctttccctagccattcgtaaccactggcaaccactagtctgttctccattttgtaattttgatattccaagaatgttgtataagtggaatcatccagtatgtaaccttttgagattggcttttttcactaagtataattccctcaagatcagtccaagttactatgtatcagtagtttgttcctttttattgcagaatagtattgcatggtatggatgtaccccagtttaaccatttattggttgaaggacatttgagttgtttccaatatttggctgttatgaatggagctatggaaatatgtgtgtaggttttctcatgaacataattttcacttctctgggatgaaaccccaagagtacaattgctaagttctatagtaagtacatgtttgattttaaaagaaactgccaaagtgttttctagagtatcttatattaagttcccaccagcaatgtatgagtgatccagttcatcctcatcagcatttagtgttgctactttttaatttaatttaattaatttatttatttattttaagacagagtctcactttgtcgcccaggctggagtgcagtggtgtgattccagctcactgcaacctctgcctcccgggttcaagcgattctcgtgccttggcctcccaaatagctgggattacaggccccgtcagtaacgctgggctaatttttgtatttttacaaatttgtattttgtatctagaatgcaaaaagaacttccaaaacacaatattaaaaatattagcaatctagctgggtgcggtggctcacttctgtaatcccagcactttgggagcctggggtttcaccatgttggtcaggcttgtctcgaactcctgacctcaagcagtctacctgcttcagcctcccaaagtgctgggattacaggagtgagccactgcacctggcctttaattttattaatagccattctgataggtatgtagtggtatctcattgtcattttaatttgcatttctctaatggcttgtgatgttgaacatcttttcatgtgcttatttttcatctattaatatatattctctctctcaaatatctgttgatgtcttttctaattggattacatatatatatataatttttttttttttttttttttttttttgagatggagtgtcactgtgtcaccccaggctggagtgctgtggcacgatctcagctcacagcaagctctgcctcccaggttcaactgattctcctgcctcagcctccagagtagctgagactgtagacgtgtgccaccacaaccggctaatttttgtatttttagtacagatggggtttcatcttgttggccaggccagtgtcgaactcctggcctcaggtgatctgccgacctcagcctcccaaagtgctgggattacaggcgtgagccaccgcgcccagccagatgctaatatttttgatgttgtgttttggaagttctttattctagatgcaagtcttttattgaatatgtggcttgtaaatattttcatcctcttaacagggcatttcacagagcaaaaatttttaattttgacaaggtccagtttatcagtttttccttttgtgaatggtgcttttggtgtcaagaactctttgcctagtcctaggtctccaagattttctttgttttcttttcttctaaaaggtttatggattttacatttaagtccatgatccagtcaagttaatttttatgtaaagtatgaggtttaggtcaaggttcattaatttgcctatgaatatccagttattttgcacaatttattaaaaaggctctccttctgccatccatactaatttttaatgcaggttttcaaaaatttttactttatatttttataggctcgagaactcttcctaaaagcagtagaagaagaacaaaatggagctctctatgaaggtaaaaattcagagcccaggttcatatcataacatttctgaataatgactctgttattaaccatatttttttttctataacttatttggtatagaacatcacttttcttaatacattcttccttcagtactcattggaaattggttccaggaccctttgtagataccaaaatgctcaagtcctttatatgaatggtgtaatatttacatataacttacttattatgtaaatagttattatactgtatttttttttaatttgtatttattttaaatatttttgatctgtagttggttgaatcagagaatgtgaaacccatgaatacagagggccagctatatttgaaattgttttttaaaaaataaaaaatagaaattgtttttctatataacctgtctttttgcaaaaaaatattgctgggaaacatcatcatgttggtaggatgagcaaaataacttttttttacatttagctttagttattcttcattaataaagtatttaaaaattattcattttaaaatatgctctttttataggtgaaaattgcttcagaggatgggaatataaaggataaattgaggaaaaaatacatgtttttctttctaagttccaatttacatattaccaacagaaatatgtggtaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaaaaaagaaatatgtggtaatatatgtgtcagctttgtgtcttttattaacccaatagaaatgtgtaaataaagtgataggactatttgccatattaggtttgtaattatgctttccttttgtgatagtaaagataataattgatgcataggaaaaatccttgtgcttgaatcgtttgaaaatgccccaaaactaacatcattcagagttactgcatttatatgcaagtttcttctagtgatatttttctttagatttttagaaaggcccagttgatcaagtccctgtgcagccttcattggtttgtgaaattcgcatctccacttagtgtatggtgtaattcatccagaataatagaacatggcagaatatattgaatcataaactcctttgtagggaaaaagaactagtcagcctctacagctccaagttctactggtgtatctctgtggggagagttattgaatattacagctctaaactacctgtctaggaaatttgtaaaaaataagttttgaagattacttaggtaaataagaggcagctgggctaaaagaagttaaatttaaaggataatttaaaaacaaaaacaaaaactattctttattccacccagtaggaagcatttaattttcctcaactctgtgtcttagaaaagtttgcttagaagtgtttttggccaggcatggtagctgacacctctaatctcagcactttggcaggctgaggcgggaggatcgcttgaacccaggagttcaagaccagcctgggcaatatagcaagatgttgtctctacaaaaaatttaaaaattagctgagtgtgctggctggggcatgcctgtagccccagctactcaggagactgaggtgggagaatcacttggacctgggaggtggagtctgcagtgagccaagatcgtgccaactgcactccaacctggacaacagagtgagaccttgtcttaaaaaagagagaagtatttttgttggctatagcaattgcatcttcagagcccaaagaaagacaactatttaaaaatcatgatacgtaagagggtgaggaaaaatatgggaagggctaatatataagagtaaaatacaacatcttaagtttagggaaaagtttctttctgagcattaaggtttggaaatagttttgtgtcactgaactgctgttgcatgtagaaaaacagaatttggccgtttgtaaagaaagttaccaaattaaaccacagttaagggtaatcaaaggaaatgacaaaaatgtgtggtcacagctaatttagctttatttcttcttttagccatcaagttttatcgtagggctatgcaacttgtacctgatatagagttcaagattacttatacccggtctccagatggtgatggcgttggaaacagctagtgcgtatataatttgatagatagtaatgcatagagtttgttaaagttaagcatctttgccctgttgactcttaagatggtgctaattctgttgagctctatactctttagtatatctttgtttataaagttgtagaaattttttattagggaaattgcaagataacacatagaaatgcaccttttaaacagatacaaaaataaacagatacaaaaataaacagatacaaaaaaacggtttaaaaaaataaaagcagtagttactgaaaggagtaaattaaaggacacatttcaactttctgaaacctatttgaagtagaaagttttaaaatgtaattaggctaaatttggcaaaatattaataatggttaaaattgagtgatgggtacatgggagtttattacactagtttccttacgtatatgtttgaaattttacattttaaaaaaggcttctaattaggaaaatgctgaactataaaagatgttattattctcttaatgtttttagtaaaacattaaaactctaacatttatttaaaagcacaggtgcagaatatattcctaaaagaaatcatgtttgaattgtatagttgccactgcatcaaagccatgaagtagcattggttttatatggataaagatcaagaaaacttatttttaaggcaatacttttgcaagacaattataaaattgttttggcttaattgcactatctcccaaaactcaatttgctgatattagaagagaagggagtctgtacccatgagagaatgtcaggttaaaaatagacagtacagagaaaaaagttttggtaatgaaatattatattagctattatattaatatattccctctgtcatgaaataattgtcacctttattgataacatatgcttattgccaatgttttttaactgcatatggtattaacacttaagctttggataagtcatattaaaaacattcccaacaaggtcaatattaatagcctgtttaaattttcagctaataatattgttcaccaaattagagttaacagtatgaggtagttcatacttaaaatgaatcacttgggttttttctaaaccttctttaaatttgggtagagtcgtttagactcagctcttagccagttttataaatatgtgccagatgctgttaagaaagattgtattaaaatattaaagaggcatttcttttctttcccattttttatacaaacccagacgctatgaaagttctttaaggattcatcttttttttttaaataagatctgataagccctaaaagtttgcctttttttttctttcctgtaacatgtttgtagaatagccattgagtccatctagcctcaaccacacttatattttgttgtattacaaaatgcccttcctggtttttttttttgtttttttgttttttttaagtctacatcacttgaaacttcctggttttctaacttcgccttcatccaatcctctttgtaagtctgatcatctttaaggtttacttcagtaaaaatagaaagctcatttttctagcaccattcactacacatttgtgtatactggtagatgatttgtgaaccctaagatgttttcaaagtaggtattttcctctctaaaggtaggctgataaggcaaatctgttagaaaacccttggtaagtaagtacctcagatgacgtctgtagatttggtttttatccagttagaataaattaaggttaaagaacatactacgttaagatttttgaaaccatttgaaagcttgcagtaactcataaaatctctactttacaataaaattagttaaatctcaacacctgtatccaaaaattctaattctttctggatgataattactgaagcttttttctttgaaaaacttgatacagtattcctttgcaagacaggataaattcatcacatttaaaaatgtatcacatgttgaataagctttaggtgactttttgtaaagcaaatttgaaaatgctatgaaaaatcagtttctaaactgtacgcttgtagactgaggcacttaatttattcacctcccttttttcagcattgaagataatgatgatgacagcaaaatggcagatctcttgtcctacttccagcagcaactcacatttcaggagtctgtgcttaaactgtgtcagcctgagcttgagagcagtcagattcacatatcaggtgtgaatacttgtttttcataactcagtgagaaatatcttaaccttaaagatttccaaatttataaggtcagataatttgccagataactgctgctttagttcagaatatggtggaagatctagttataattatcatttgcatatactattaagctgttttgtgttttgttttgtcttgttttgttttttgaaatggagacgtgccctgtcacccaggctggagtgcagtggtgcaatctcggctcactgcaacctctgcctcctgggttcaagcaattctgctgcctcagcctcccaagtggctgggattacaggcgtgtgccaccacacccagctaaatttttgtatcttcagtaaagacagagtttcaccatgttggccaggctggtctcgaactcctgacttcatgatctgcccacctcggcctcccaaagtgctgggattacaggcctctgaggcactgcgcccagcccagtagtaagctgctttacaatctgaagcagaacagtttgtagtgctgttgtttaaggatgccatacctttttcagtaaagatctaacagggtaagtctgagttgttgaggtagccctaagaaaactggaggaatactggtatcatgaagcatttcagccatgttggacaattgtcctgagacagactgaatgtttaggaattaatggatttttgttcgggcatggtggctcacgcctgcaatctcagcattttgggaggctgagttgggaggatcacttgaggccaggagttcaagataagcctggccaacatggtgaaaccccacctctactaaaaatacaaaaattagctgggcgtcgtggcgcatgactgtagtcccacctacttgggaggctgaggcacgagaattacttgaacccaggaggcagaggctgcagtgagctgagattgtatcactgcactccagcctgggcaacagagcaagaacctgtcacaaaaaaaaaagaaattcatgtatttttaatatgttaaatattgtttggttcggggctttttcagaggaggacaattaaaagttttcaaggagatgaaaataactttagtgttaatagatgcaatatggatcacacacacatagattattttcctaaaacatttattttaatatgtctggcaaaataatcttatgagggaaaagagtgctttataaaaagtagcttcagatctatactgaaaaaacaaagatatttatgtcttgatgttaagaaccattattattattgagtagctaaatacattcatgctttagctctgagcaatacagagggtgtgattataaatttctaggaaggtataaatgtactgggaatgtagttgtgacaatagaatgacatagaggagagtcactgaaggatgattttcttttgcagtgctgccaatggaggtcctgatgtacatcttccgatgggtggtgtctagtgacttggacctcagatcattggagcagttgtcgctggtgtgcagaggattctacatctgtgccaggtactaagtttttgtttttgttttttaaacaactgaggcaatggtgaaaagaaagatggtcctttgccaatcctgataaaattacttgattggtgttctgagttaaagcttagaataaacaagttttgctaagctgtacttaactttctcaaataacttagaatttaaaggctagaatatgctaggtttctagggtatagaataatatgtaggacagatgtagtaacccatactactaccatagagtttacatgctagcttaactgatttgggaaaaagagttatattagaaaaatatattcaagtcatttttacactaactgtaaactcattgtggtaatggtttagattaaaacagcactagcattttcttatggctcattaaaagttattctatattttgaa

SEQ ID NO: 10988 - DNA, 87 bp, Homo sapiens
ctcacgcctgtaatcccagcactttgggaggccgaggcgggcggatcacgaggtcaggagttcgagaccagcctcaccaacatggtg

SEQ ID NO: 10989 - DNA, 87 bp, Homo sapiens; identical to SEQ ID NO: 10988

SEQ ID NO: 10990 - DNA, 1493 bp, Homo sapiens
cgacaagtgacttaaacactctgtgcccagttttccgcatctgcaaaatggggagataaatagcccctacctcctaggatcatcatgagaatgaggtgtgcgaagcttggccggcatgggttccatagcaggcactcaggggtgtcggccacgaagattattctttctcttctctctttgccgtcttatttcatctctctccgttatttggttcccctgtccttagtcccctttctcccccaatggcatcccaagatgcacaatagtggcaagtgcccagcctgtttccacagcctgatccccaccactgcgttggccagtcacccaagaagcagctggacccatcatctggctctagggatgacccagttccagcacccccgcaaacctccgtctgtccccctacctccctcagcagaggcccagcccaatgcaggcccgtggctggatgggagtagctcttcccaccacccctgggcagggctctgcggagcttgggagcctcacctggaatcggccctcatgcctcagtagagaaggagagcgaggagagaggtgatggggctccgcgggcacccccgatgcacagtctccttctgggcttctgatggccacaaggccagaagacctgcccagaagaattcagtataacccagttcagtgaaattggagagaacgagggcctgcgtcttccgggcagaaggcagggttcctgccctctggagcccttggcctggcgcgggctgattaggacctagatctgcctgggtggctgggtggccgagtggcgattgggctggttctgtaccgggtgtgctccgtggggggcgtgatctggcaaagccttggaggtgggactgtggaggcaccattgattgaactgtgtcccctgcaattcacatgttgaggcccaaacccccagtgtggctgcatttggagtagggcagtaattatggttaaatgaggtcgtatgggcgggtgctgatccactaggattaggatccttataagaacctgccaccttctctctgccacgtgaggacatggggaggaggcggctgcctcccacccaggaggagcccttactggacactgggccctggctgcaccttgaccttggacttctagtccccagaactgtgagaagtagatttctgctgattacgctttcctgtctgcggcctgagctaagacagcagcgcttggggagaagcagaatttgaggagctcctcagtggcaggctgccctggccctgctgtcagcagaggggaatggccatccatgctggcccctcaccagccgggccttcagtgagctccccgggtaggtgaagctctcccagctctgtgtcccccgccaaagcaggcccacaagcgagcgcctatggggtggagtgagagtgaggaagaaacattacccgaggggtcactctcttcagaagacctcaatgactgtagactactgaattatttccttaaaaaaaaaaaaaaaa

SEQ ID NO: 10991 - DNA, 470 bp, Homo sapiens
gggtcatgggtcatttacggcctgggtctccccctctcctccctcctccttctctccaacctgctttcttgctgctggaagggggtgtgcaggctcccgtgtgcctggcacagcaggggcagcacaggagactccatggggcctgtgtcccgcacccccacgcccccgcccccagccacagccctttgagagcacagcggaatgaacgcctgattaggaatcagatgccagaaagaagctgtgtctgttccaaaatcaagagaccaggagaagtgacgtcctttaaaaggagagagctaagtgacagagagggggcttgtccccagcccaggcacctcggggctgcaagctcctttgagatgcggggctcaggcctcatcaggggaaacgtgggcatctagatgaccctccacactgagcagacccagcacaggctgcgccactcatcattataggctgcgccactcatt

SEQ ID NO: 10992 - DNA, 89 bp, Homo sapiens
tttttagatggagttttgctcttgttgcccaggctggagtgcaatggcgcaatcttgactcactgcaacctccgcctcccgggttcaag

SEQ ID NO: 10993 - DNA, 1616 bp, Homo sapiens
ctgcagtctccctagcatctgttatttattgactttttaataacagccattctgaccgctgtgaaatggtatctcattatggttttgatttgcatttctctaattgttagtgatgtggaacattttttcatatgtttgttggctccttgtatgtcttcttttgagaagtgtctgttcatgtcttttgcccagttttaaatgggatttgttttttgcttgttcacttgttcacacttttttttttttatagattctggatgttagacctttgtcagatgcataatttgcgaacattttttctattttgtaggttgtctgtttactccactgaaagtttcttttgtagtgcagaagctctttaattaggtctcacttgtcaatttttatttttgttgcagttgcttttaagcacttagtcataaattctttcccagagccgatatctagaatggtgtttcctaggttttcttgtaaaattcttatagtttgaggtcttacacttaaatatttaatccatcttgagttaatttttgtatatggtgaaaggtaggggtcctttcaccatagaataaaacgttgtttcattcttttgcatatggctagccagctatctcagcaccatttactgaatagggaatcctttccccattgcctattttttgttgactttgtcaaagaacaggtggctgtaggtgtacagctttatttctgggttctcaattctgttcccttggtctgtttgtctgcttttgtaccagtaccatgctgtttgggttactgtagctttatagtatagtataaagtcaggtaatgtgatgcctcagctttgttctttttgcttgggattgctttggttatttgggttcttttttggttccatatgaatttcagaatagttttttctagttctgtgaaaaatgacactggtcatttgataggaataacattgaatctatagattgctttgagaagtatagccattttaacaatattgattcttgtaatccatgagcatggaatgtttttccatttgtctgtgtcatctgtgatttctttcagcagtgtttcctagttctctttgtaaagatccttcacctccttggttagatgtatttctaggtactttgtttttttgatggctatcgtaaacaggattgtgttcttcatttggctctctagcttggatgttattggtgtatagaaatgctactgatttttgtacattgattttgtatcctgaaactttaccaaagttgtatgtcagttccaggagccttttggtggagtccttagggtttcccatgtgcagaatctcatgattccttaaaagcatgcatttctacttaaaccatcatgtttacttttctagagagcaattaacttggaggtgggtgccggggaggttaggttgcttttgtaatattaatggatgtacaccaagaatattgcttctgagaatgatcttatcctcattgggaaagatttttctgtttttagttgaaattgagatgaaatacatcttattataaataaattttgactcttactaatgattacaggattgtagacaattaactgtctttcctcatgctgagtacataaaaaaaaaaaaaaaa

SEQ ID NO: 10994 - DNA, 489 bp, Homo sapiens
atagctcagagtgtatgtttctagacttcactctctacatacacaaaatcataaataacatcttttatattacttttttatttagtttttaaagtaaatgctttttaaagttttttcttttaaaaataaatgccttttttcccctaaatatctgtctcttccaacagaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaaggtataaatatgtaatct

SEQ ID NO: 10995 - DNA, 342 bp, Homo sapiens
tgagaactcactatcacaagaacagcatgggggaaactgcccctgtgatccagtcacctcctaccagttccctcccttgacactggggattacaattcgagatgagatttgggtggggacgcagagccagaccatatcacatgggctgaaggatttaaatctgcctattcttcttagtggggctgccaatcaaaacttttaaaaatcatatttttttttcaaagaaagataatttcaactcttttggacttcacttgttaatttcagttgataatccaactattttagattcagggcatacatgggcaggcttgctacatgagtatattgcatgatgctgag

SEQ ID NO: 10996 - DNA, 1197 bp, Homo sapiens
cgagatcacaccactgtactccagcctgggtgacagagcgagactgtccaaaaaaaaaattgataattaaatgttaaaagtcagcgactccagtaatacgtggtgggctgagtattagactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaagaccagcaagaaaaaaaaaatgggttcctaggaagaggtagtaggttgcatagttttagggcagggattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaactagtgctttttaagtcatccttaacccttatccccatccttgcagtagtagatgcatttttcatttgtaattattatgatttgttcttagtttcatttttca

SEQ ID NO: 10997 - DNA, 2248 bp, Homo sapiens
ttaactctggaccaaatgtatgctttttgttttatccactgtggacagctgcatagataattggtctttgttctaaactgcacataaaaacatgggagaaaatgacatttgttgccttttgatgtgccaaagaagagtgggaatgttctaagaattctttttggcttaatctttgttgaattgaaaatatgtataactcttctgctgaaagtgtagcaagtacagtcatgaaattttgtggtcttcctgacatgttcttccagcataacgttgccaccttcagttggaaacgtatccttatctaataattaagccctggagaaaaattaatttatatattttattaattacataaggacattgttattagctaagcagagtaagtaaatcgaaataaaactttaaaaatgcctttatggagagaatgactatctctgaaagcttgtttttaatgatgataaaattcatgatcagaatttgtttctgtttgctttaattcaggggtcaaaaactgaaataccatcagaggcccaggaggggctagttgtaactggcaaatatagtaaattaatttgctctggttgataggtagcaagcagggtttatatacattgtcacctacttttccagttaacaggagagactggagattttatgaaatttgatatttaaatgttggtaactgggttgggcaccatggctcacacctctaatcccagcacttcgggaggctgaggcgggtggagcacctgaggtcaggagttaaagaccatcctgaccagcctggtgaaacacagtctctaataaagatacaaaaattaggccgggtgtggtggctcatgccggtaatcccagcactttggggaggccaaggtgggcggatcacctgagtcaggagtttgagaccagcctgcctaaatggtgaaaacctgtttctactaaaaatacaaaaaagtagctgggcgtggtggtgggcgcctgtaatcccagctactctgggggctgaggcaggagaatcacttaaacccaggaggcagaggttgcagtgagccgagatcacaccactgtactccagcctgggtgacagagcgagactgtccaaaaaaaaaattgataattaaatgttaaaagtcagcgactccagtaatacgtggtgggctgagtattagactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaagaccagcaagaaaaaaaaaatgggttcctaggaagaggtagtaggttgcatagttttagggcagggattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaactagtgctttttaagtcatccttaacccttatccccatccttgcagtagtagatgcatttttcatttgtaattattatgatttgttcttagtttcatttttca

SEQ ID NO: 10998 - DNA, 814 bp, Homo sapiens
caggcggtctgatagaaagtcagttaactaattgtacaatatttaagattaacttgtcttaaagagatgtagtgcagcatttgtttatggcctggaaataaattaatttagagataaagtctgtagcaagtacactggatgggggtggggaaaccttttgcttcttgtcttatttctctgtgtcagaataaatgtatttttttattttgatttatgctgataattttatgttgaaattttctttcgaaagagattgtactttccattccagaagaaaacattgctctatcagagtgaggtagtagattgtatagttgtggggtagtgattttaccctgttcaggagataactatacaatctattgccttccctgaggagtagacttgctgcattattttctttttatttagatgatattaaaactcagaagaattaattttgacattttgtatttacagtttatcagttaattttctctgttcaagtagtacagtaggcacagattaacatttaaatttttcacatatggtatatttcagaaatttgaagttaagcaaaaattttaatgagtagagaaagtaagtagccttcaggaaatcttcatagaggaccaggcccttttggaattgtgaataggtttattgccttacatcctggtacacatgtccaaggtcaggtcctgggtggtaaaggtaaatacaaattggaagggcactgtgtgagccaaaatgagtcagattagtcatgattcatttccagtttgggttttgggtggtcttggagaatgttgtaagcactgcttcattgataggt

SEQ ID NO: 10999 - DNA, 1348 bp, Homo sapiens
tcacggcatcccactctgttctgccgaggacgtgaatctttcctttgttcagtatatcccatgctgtatacactacctgcctgtcagtcattcagtagcggcctatgttatcagattggctgatcattgtattgcagtgctatgttcaggtaacacttattttacttatagtggtcccaaggtgcaagagtagtgatgctgacatattattataacttctattttattattcttattgttaatcttactatgcctaatttataaattaaacttaatcataggtatatatatataggaaaaacatagtgttatatagggttcaatactagccccagtttcagttgggggtcttggaatgtgccccccacagataagaggggactatattcttatagaagaagagtttgattttttaggacgttatttcctgttcaaaccattgacccactctttgagataagttattctgaagctttcatataagtaaaagcaattaaattttgccaccagcaccatcctcaaccattctgaattataaagtgttaaaattaagaacaggaagaatggaagtattcaataaaaaatgaagtattttcagttccatattgtcatcaaataagggtgggaaaggcaaaggagaaaatcaataagtatggagaagaaagaaatgagtagacagaacaaaaaagatgagaaaggaagccatattgaagtcaggagagagtgcagagcaagaaaggatgggcagaaaaaaagaaaacaagaaaggagtttaatgagtgagtagaatgtgctcttgttgcattctactgccagtctaagccatggaatagttcactattctgggaagtattcttaagatcatcagtgaccttcaggtcatgaaatctaataagcattctttcagacctgttcttatttgacctctcagtggtgtttgacactctcaaccaccaactctttgtgaaacctttttttccctgaaagctgtgaggtcgtgctttctcggttctcttctcatgtctctggtaactcctgctttgtctactttgggttttttgttttgttttgttttttgttttttaagagttgggatcttgctctgctgcctaggctggagtgcagtggcgcaatcatagctcactgcaacctcacactcctgggcttaagtgatctacctgccttggcctcctaagtaactgtgttcatttgacacagtttaggaactaaagatcaggtaaaaccagccagttcctgagctggaattgaatctgttcagaatgtctgggaactaactccatttttacgtgtcaaccatacctggctaattaaaaaaaaaaaaaaaaaa

SEQ ID NO: 11000 - DNA, 1348 bp, Homo sapiens
tcacggcatcccactctgttctgccgaggacgtgaatctttcctttgttcagtatatcccatgctgtatacactacctgcctgtcagtcattcagtagcggcctatgttatcagattggctgatcattgtattgcagtgctatgttcaggtaacacttattttacttatagtggtcccaaggtgcaagagtagtgatgctgacatattattataacttctattttattattcttattgttaatcttactatgcctaatttataaattaaacttaatcataggtatatatatataggaaaaacatagtgttatatagggttcaatactagccccagtttcagttgggggtcttggaatgtgccccccacagataagaggggactatattcttatagaagaagagtttgattttttaggacgttatttcctgttcaaaccattgacccactctttgagataagttattctgaagctttcatataagtaaaagcaattaaattttgccaccagcaccatcctcaaccattctgaattataaagtgttaaaattaagaacaggaagaatggaagtattcaataaaaaatgaagtattttcagttccatattgtcatcaaataagggtgggaaaggcaaaggagaaaatcaataagtatggagaagaaagaaatgagtagatagaacaaaaaagatgagaaaggaagccatattgaagtcaggagagagtgcagagcaagaaaggatgggcagaaaaaaagaaaacaagaaaggagtttaatgagtgagtagaatgtgctcttgttgcattctactgccagtctaagccatggaatagttcactattctgggaagtattcttaagatcatcagtgaccttcaggtcatgaaatctaataagcattctttcagacctgttcttatttgacctctcagtggtgtttgacactctcaaccaccaactctttgtgaaacctttttttccctgaaagctgtgaggtcgtgctttctcggttctcttctcatgtctctggtaactcctgctttgtctactttgggttttttgttttgttttgttttttgttttttaagagttgggatcttgctctgctgcctaggctggagtgcagtggcgcaatcatagctcactgcaacctcacactcctgggcttaagtgatctacctgccttggcctcctaagtaactgtgttcatttgacacagtttaggaactaaagatcaggtaaaaccagccagttcctgagctggaattgaatctgttcagaatgtctgggaactaactccatttttacgtgtcaaccatacctggctaattaaaaaaaaaaaaaaaaaa

SEQ ID NO: 11001 - DNA, 6662 bp, Homo sapiens
agcctcctgagtagctgggactacaggcgcacgccaccatgcctggctaatttttgtatttttagtagagacggggcttcaccatgttggtgaggctggtctcaaactcctgacctcgtgatccgcctgcctcagcctcccaaagtgctgagattacaggcgtgagccatcgcgcccagcttcggtgtgtttttaaaaaccttgattttaagatgttatttgtttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaagtaagaaactttgccagattctaaataatgagttagaaatcaccggaactcttttttttttttttttttcctttgaggataaaatgtttccatcagttgattggttgaaaatttttggtttttatcatctttggttagggtctatctcttgatatttccttgtaagtccagaatattttctctcataactcagcattaattgctcattacacagttgtatctaggtatggaagttaagacagtttgttttatgatagaagatgtcctgtcataaatagttttggtcatccagttttatcagctagaagatctgatttatatggatgggaattacctagcatgttcattaaagctaactgttgtcagttcccctctattcttaaaaatcagcattcaaagggttaagatcaaatgagtgagctgctttttaaataaaatacaggcatgaaatggaattgtgaaggccttatccatatcaattttattttactttttctcctgcctattctttggttctgcttactaaatttccagttttattttttgcttgttttatcttaagggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgatggggtttgttgttgtttttgagctggctgtatatattttaaaattataaatagataatatattattttttgcacattgtgatcagtttgcccagaattggggatggggcagttagcatgttggggccaggaagggacaagttagataaggactgagtgcttccgttgcaggcagtttgcacaatacctaattaaccttcctattgaaaataccaaatgtgtggttacattactttaaatgacattgaattggaacttgatggcaattagttctagatacaaccttttgatctttgttggaattttaagggaaaaatgaactaaacttcatatttgttgattttaatcacctaatagtactgaaggttggaaagttgcatgtggctggatgctgttaatttctttaatagccatgactataatttaagcctatgagaagatagactgtttcgtagggatatattcacatgtgtgtgcacactcatgagttttgtctcagcaggatagaataagcaaatccatgaactggtcttctattaatactttgattctaaaaattatttgtttacttgctatggtctgttcattctgggcctaaccttaaaggctcaataacaaatacaacaaatgtaaatatgtttacattttaagacatatgcagtggttcttacagatcagttaattaactccagaaagcaaatgttagactacacatttatttttctccttgatcaagtataaaattctgaaacagaggctttaaaatttaaaacctcagcaaaataatccatgaatttactgattcttctgtatcgtgtgtagttaccattatgtaactatacacacatacagctacggatataatgaaaattatctgcaaacacctaaattaaagagaaaaaaaagtagtttgtaaactcatttgtgatctactgaaaagaggttatattaaagcaaattaaaatattttccttctctgtcctctgaaatgactgcagtagatactcttagttatcccatttagggtggttggagggcctttttaatttaattgaccccccgaggtggtcttttgttttaaacagggggcaacagctggatctccaagtacatatggattttgtatatataggagatttttagaaaaatcaacaacctaacaccagattcaagtcacataaaagtgttccaataaaatggatggatgtctttttcctccccattttgctttatactgagtaatgcactcttgcaagtgtatacaaaaactaaatagacttctgccctccaacatctttttattgcattacttcaaaatcctaattttgtctctactgatatgtcttattaacatctgaaaaaatatatattttttattggaaaattctaatttgttaggccttgaaagttttgtgacaattattttgctgtgtttaaccacaatcattcaccttatggcatgctttgattactagacttcaggcagtctcattcattgtatcatacttacacacaattagtaagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcagatgccagaacaaagaagaacagtcaactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttctttgatttgactgttatttctgaaaaggacacattcttgctgatacttgtaacaacctgttcaaagttgtggaaatcaccttctgttggctttctgacatggacttccttgcagcactgttacttcttaaaaggaacagaatggcaaaccagtgtctggccgtagtccccattgattcctgttattttcatctgaggagcctgtgaagctttgcagaggcttctgggtaagtttgtaaacctagcattggccttcactaggctcttgctttgcctcattattaagggttgggagagggagtgaagtagcatatgcatttcatacttgcctttaggtctcaagcctagccccagtggaagtgctgctctcactggtactgtttggaatttgtgaaacctcttaagagggtagtcttgtggaccattcaactctccttcagccctttaacttacccactgagtaaggcagtaaggaaagtatatgtgaaaaggaaaagctgttactctggggaagatgtaaacctgcaaagtgcttcagcctacctgccatagataaaaatgagtcatgatagaggacaagctagggtagtgcctcagaactctaatgttccatggagtgtttgtgctcttctaagaagagaaaactataggagtattaaaattgatgcaatacctcaggatagaaacaatctagcgaccttagaagttgaaatgaggaccataggctccttttggggtatcatctttctgaaggaataggtacattattaaacaaaactggcatttgccacagaagtttgtgctcataggcacatctgcaaaatttcacttcaattggtgtaggactaatatcggtgagaaaatgagaccctacaatcagggtagggtactgctttacaaccacagctactcttctcaaaatagtcctttttctttcttgaggttttgttgcttccatcgaggcaga

SEQ ID NO: 11002 - DNA, 3484 bp, Homo sapiens; identical to SEQ ID NO: 6558

SEQ ID NO: 11003 - DNA, 1218 bp, Homo sapiens; identical to SEQ ID NO: 6559

SEQ ID NO: 11004 - DNA, 158 bp, Homo sapiens; identical to SEQ ID NO: 6560

SEQ ID NO: 11005 - DNA, 6585 bp, Homo sapiens; identical to SEQ ID NO: 7374

SEQ ID NO: 11006 - DNA, 246 bp, Homo sapiens; identical to SEQ ID NO: 7375

SEQ ID NO: 11007 - DNA, 13646 bp, Homo sapiens; identical to SEQ ID NO: 7982

SEQ ID NO: 11008 - DNA, 7770 bp, Homo sapiens; identical to SEQ ID NO: 7983

SEQ ID NO: 11009 - DNA, 139 bp, Homo sapiens; identical to SEQ ID NO: 7984

SEQ ID NO: 11010 - DNA, 661 bp, Homo sapiens; identical to SEQ ID NO: 7985

SEQ ID NO: 11011 - DNA, 139 bp, Homo sapiens; identical to SEQ ID NO: 7984

SEQ ID NO: 11012 - DNA, 1605 bp, Homo sapiens
ggctagatagtgctatgaaactaattttggcaaaagactttgatgaagatagaaaatagtaaaattgatggaattcaccaatttggtgatattgacaatgtttcttaagctaggactttcttttcctttttggtttgtagcctatgatgttggtttacctggaataaaatctagtaagaattcatagaatattgaagctaaaattttacttagacatccctgtcctagctctttattttctgataaagaaattgagacatagaacatggcacacaactcaacatctaggtttagcaaatgtttactggaaacctgtaaggagcctggtactgtatttgcagaggcatttgggacacagagctgtagttcccgacctagagaaacttagccatactttctgactttcatttcattgttctttccatcataccgtgctgcctcccttctcctcttccctctaactttaaataataagctgatttaacttcaaagagaacatttcaattttaattcctagtatttaggatctctcgttataacttaaaaaaattcgacactaatcttagaaataactgctgtttaccactaaggaaagatagttattctccatgttataaatggcttcaatatactttagggttctgggtttcccccagcattggcatctgaaaaagaaagatgtcttagagcagcaggagaagtatgggatacatgagctgttcattcttgcctgacatgaactggcctgtagaggatgagctgggcatttgggatcaagtttagagaaatctgacagaaagaaatttcactttcttgggattcacaggatcatagagtcttaccaacgagagaggcactcaaagaatgtgaaggttcagttgattattttttaacttgggcttggctgtagaacataactcttcttcgtatgactttttcatttcctggaattctcctaacaacaaaacaagaggcttagtatccaaaaggaatggagtaaacactgcaggcaagcaggagcacattagaaatttttacctattctttattagatagggatttagtagtcatcttaaatggcacgatagtttgaatgcccacacttctgcatgtggtctttctcttggttcattttttaggtatcccagtggttcttaaatataatatgtaaagggattactgtagtgcaaggttgtatatacatatctgtatgtgaactttagaagagtttaaaaggattttcttaatgttaattctgtagcatttggctacaggtgatgttacaacccatccccaatgtaagacgttagtactgtaatgacgcacttgtcccactgtaactaagtagctggatatgttacaatggaaaagggagaatgaatgattgaaaatagatttttattcaaaaggaaaagaatcattatttcctagtttctaaatatccttcaaaatgagaagaggctaaagacatattaactaagtatatcagcagttgtctaccaatattatttattctcaaaggacatagtggttctttttcctaagagaagatagtacaaactatttaaatgtagacgatttcctggagctttgaaaaaaagaaaa

SEQ ID NO: 11013 - DNA, 1606 bp, Homo sapiens
ggctagatagtgctatgaaactaattttggcaaaagactttgatgaagatagaaaatagtaaaattgatggaattcaccaatttggtgatattgacaatgtttcttaagctaggactttcttttcctttttggtttgtagcctatgatgttggtttacttggaataaaatctagtaagaatccctagaatattgaagctaaaattttacttagacatccctgtcctagctctttattttctgataaagaaattgagacatagaacatggcacacaactcaacatctaggtttagcaaatgtttactggaaacctgtaaggagcctggtactgtatttgcagaggcatttgggacacagagctgtagttcccgacctggagaaacttagccatactttctgactttcatttcattgttctttccatcataccgtgctgcctcccttctcctcttccctctaactttaaataataagctgatttaacttcaaagagaacatttcaattttaattcctagtatttaggatctctcgttataacttaaaaaaattcgacactaatcttagaaataactgctgtttaccactaaggaaagatagttattctccatgttataaatggcttcaatatactttagggttctgggtttcccccagcattggcatctgaaaaagaaagatgtcttagagcagcaggagaagtatgggatacatgagctgttcattcttgcctgacatgaactggcctgtagaggatgagctgggcatttgggatcaagtttagagaaatctgacagaaagaaatttcactttcttgggattcacaggatcatagagtcttaccaacgagagaggcactcaaagaatgtgaaggttcagttgattattttttaacttgggcttggctgtagaacataactcttcttcgtatgactttttcatttcctggaattctcctaacaacaaaacaagaggcttagtatccaaaaggaatggagtaaacactgcaggcaagcaggagcacattagaaatttttacctattctttattagatagggatttagtagtcatcttaaatggcacgatagtttgaatgcccacacttctgcatgtggtctttctcttggttcattttttaggtatcccagtggttcttaaatataatatgtaaagggattactgtagtgcaaggttgtatatacatatctgtatgtgaactttagaagagtttaaaaggattttcttaatgttaattctgtagcatttggctacaggtgatgttacaacccatccccaatgtaagacgttagtactgtaatgacgcacttgtcccactgtaactaagtagctggatatgttacaatggaaaagggagaatgaatgattgaaaatagatttttattcaagaggaaaagaatcattatttcctagtttctaaatatccttcaaaatgagaagaggctaaagacatattaactaagtatatcagcagttgtctaccaatattatttattctcaaaggacatagaggttctttttcctaaaaaaaaatagtacaaactattaaaatgtaaacgatttcctaaaagctttgaaaaaaagaaaa

SEQ ID NO: 11014 - DNA, 1605 bp, Homo sapiens
ggctagatagtgctatgaaactaattttggcaaaagactttgatgaagatagaaaatagtaaaattgatggaattcaccaatttggtgatattgacaatgtttcttaagctaggactttcttttcctttttggtttgtagcctatgatgttggtttacctggaataaaatctagtaagaattcatagaatattgaagctaaaattttacttagacatccctgtcctagctctttattttctgataaagaaattgagacatagaacatggcacacaactcaacatctaggtttagcaaatgtttactggaaacctgtaaggagcctggtactgtatttgcagaggcatttgggacacagagctgtagttcccgacctagagaaacttagccatactttctgactttcatttcattgttctttccatcataccgtgctgcctcccttctcctcttccctctaactttaaataataagctgatttaacttcaaagagaacatttcaattttaattcctagtatttaggatctctcgttataacttaaaaaaattcgacactaatcttagaaataactgctgtttaccactaaggaaagatagttattctccatgttataaatggcttcaatatactttagggttctgggtttcccccagcattggcatctgaaaaagaaagatgtcttagagcagcaggagaagtatgggatacatgagctgttcattcttgcctgacatgaactggcctgtagaggatgagctgggcatttgggatcaagtttagagaaatctgacagaaagaaatttcactttcttgggattcacaggatcatagagtcttaccaacgagagaggcactcaaagaatgtgaaggttcagttgattattttttaacttgggcttggctgtagaacataactcttcttcgtatgactttttcatttcctggaattctcctaacaacaaaacaagaggcttagtatccaaaaggaatggagtaaacactgcaggcaagcaggagcacattagaaatttttacctattctttattagatagggatttagtagtcatcttaaatggcacgatagtttgaatgcccacacttctgcatgtggtctttctcttggttcattttttaggtatcccagtggttcttaaatataatatgtaaagggattactgtagtgcaaggttgtatatacatatctgtatgtgaactttagaagagtttaaaaggattttcttaatgttaattctgtagcatttggctacaggtgatgttacaacccatccccaatgtaagacgttagtactgtaatgacgcacttgtcccactgtaactaagtagctggatatgttacaatggaaaagggagaatgaatgattgaaaatagatttttattcaagaggaaaagaatcattatttcctagtttctaaatatccttcaaaatgagaagaggctaaagacatattaactaagtatatcagcagttgtctaccaatattatttattctcaaaggacatagtggttctttttcctaagagaagatagtacaaactatttaaatgtagacgatttcctggagctttgaaaaaaagaaaa

SEQ ID NO: 11015 - DNA, 4648 bp, Homo sapiens
aaggccctcggccggaagctccgctttctcttcctgctctccatcatggcggtgagtagctgggacctggatttgctttcctttatccgtcgccatccatggcaggccgagcctgcgggggctacttcgcccgcagcccgaggaatatggagcccgcaatgcctgctggcccaaaactagcagagccgttcgagccaaggacgcagggttgaattctgtcactttccctgccatcgttttaggagcggctccgggcacttgcccggagtgctcagaagcacggtcaggaggctgcagcgggggcagatggggtgaatggagggttctgaggcaggggggtccgggccttttcctggtcccggggacttgagacttgctcggtgctaggaaaccttagtcggttgctccgcttagggaaggtgccagcctttagacagcttccgaataggatgctggacgtcgcataaccacgtgtttcctgttaactgagcaattaagttctgtttcttcgctcactccccttagttggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgactgctgctcttccctgttgcagcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaaggtgagtagtcacaaggacatacagggtttgcctgcttgggtcgcttggttgtttcttgatttacctgctgtcgagtctgtttagaaagtgacagtcggcatcacttaaagcattaaattcatgagccggccaagaggtgtcttttttttttttttttattcaagatggcgtgtgggattggaacactagattttatttgagcagatcttaagctaagactagcccaagtaaagattttcctaagtaactaggatatgagatagagtggaaatgtcaggaacgaagtaaagatcattagatctgattagcagttagggttatataggctgcattaagaacagggctgtacgggagcatgaggcttcagtggcctatattagtgccactgcactccagcctggttgaccctatctcaaaagttgtatacagattgcctgggtttgagtgatggcttcaccatttgctggtctgactctgggctctctggacctctgcttttttctttgcataaagagggtaatactttataattgtggaagataaaatgagttgtacatgtgtagttgctttaggacagtgaaatatggcaagtctttggattccactcctgctttttgttaccagctgtgatgtttggcaagttaataaacctctcaaaacctcacctgtaaaatatggataacagtacaataaggtttcagcaaatagtagatgttgtcaataatgctttgttttctttggaacatgataatcttactagtggcttcttcggcctattctggttgtgaccttgcccttcctggaacttcggcgttatgactgttcttaactgctgaaggatggctggatgtctggaaatgggaaaatctgtgctgtggatgaaatcttattaatagatgtgggagacactaattagaacaccacaacttaaaagagtgtggatgaatgcttaatgtctctttaagtcatggagatggtgttctgggaaagaggtgagtgtagtgggggtatgatggcatctgactccttgttacccacttcctgcagctagatacactgtcagatcctttggcatccggagaaatgaaaagattgctgtccactgcacagttcgaggggccaaggcagaagaaatcttggagaagggtctaaaggtgagcctaatcccctaatggagtgatattgatcagcactcctttagtaacacatgtagataagttacatttaatgttctgttctttggtgtcttgatatttatttacttaagcttctaaaaggctttttctacaatcagcagggttaaactgttcttggtggtttaaaagatgcttgaggctgggcacggtggctcaacgcctgtaatcccaacactttgggaggccaaggcggttggatcatttgtggccaggagttcgagaccatcctggccaacatggtgaaacaccatctctactaaaaaaagataaaaattagccgggcttggtggcgggctcctgtagtcccagctactcgggaagctgaggcacgacaattgctagaacctgggaggtagaggttgcagtgagctgatattgtgccactgcactccagcttaggccacagagtgagactcttgtctcaaaaaaaaaaaagaaaaaggatgcttgggagtcatttcatgcctctgctttctctgggtttttctctgctctttggaagctgggagaggtcatactgggtagttggggtgtgaatctatagtcgaggtatagtgaggaagtcaggttgtgttctcagccaagtttcattgacttctgtttgctctggggtgcatgttgcaggctgagctattaatagttacttgggggtgggagggagttgaagatgacaaggaatgttattgctgcatttttctccacaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagacttggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttacagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgatgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccgtttctatccaaaagagcaataaaaagttttcagtgaaatgtgcaat

SEQ ID NO: 11016 - DNA, 638 bp, Homo sapiens
acaaccccgtcatcctctgattggatgccagtatttcctggcagatccaagtccaagcttcatagcattcattgcctgtgcttgccacaccttggttgatgtgctgtggtgcagtagccccatttggaggggagggtttggttgatgttggggtttgaatttagagccttggttaagcagggtgcagtgctcctgtgttccaggaggccccctgctattcagtgattctgttctgtactagaaattttatcagcattgatgcgtcatgaaggaatgacaggctttggtgtgatggttgagattaaatttagacttaactgttcaggctcaggtttcttttacaatgagagtataaggttcttgggaggcagtatgtgcagataagagggcagtctttccgtttccagccctttcctttaactgttacctcgggtgagttgttaatctgcctcagtttccttatctgtatcaggaggcagtaatagtagtatctctcagaggattaaatgatttaatacttaacaaaatgctcagactagcaccagccacgtagtgctcaaaaggggtttcatttttgtgtttgggtataagaaatattacttctgctagcttgcttccctttggtgcaaaaatgaaaa

SEQ ID NO: 11017 - DNA, 313 bp, Homo sapiens
acttattttttatttttgagacggagtctcgctctgtcacccaggctggagtgcagtggcgcgacctcggctcactgaaagctccgcctcccaggttcacgccattctcctgcctcagcctccagagtagctgggactacaggcgcccgccaccacgcccggctaatttttttttttttttttttttgtatttttagtagagacggagtttcaccgtgttagccaggatggtctcgatttcctgacctcgcgatccgcccgtctcggtctcccaaagtgctgggattacaggcgtgagccaccgcgcccggcc

SEQ ID NO: 11018 - DNA, 11240 bp, Homo sapiens
ttcagagtgttgttttattgccctgggatgtaaagacttggggacacctgacaaagggatgcttagatatattgcttggccttgactgcaggagagtttacagcagcagagacagcatctgggcccggagggaatgtgtcaccaaatgaacttgatttttactccataggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggtaacttttggtttgttttattcttaactcgattccctgatggatttgtggaagtctgaagaaatcagttcatttacattaaaagtataaattggaaaaaatgagctctggggagaaacagacttagactgtacctttaatccaggacaaagtgggatcacaaatactttgttcacatagttcacatgtgaccagtgttggaatataatgtgcgactctgccagaccctgttggctacattaagtgtcagcttgtgtccaaaatctttggccaccatcacacccagagaatcatggtaagttacatgatgtgcactgattctgaggagaaagcgggtccgttcctcaggggatgtcagtatttcatggcacttaaatcttgggaaattagtttgatgctttttgctagaggtgacaagatagactttttgtccttaacagcatttttccaaaagatacacaagcaagttttgtgtgactgtttctacatgattattctgagtcctctatgggactataccaagaagggtttaatgaacacagtttttccagagctcacagcactgcggcctatatacccaaccttgttgcagtctgtgtttatctgtgagtaaacctaattgcctaaaaaatgcaaggtttgctttcaaaggagctccatgaacaggtcactaaactggtgtttaagtacagatttgaccaaagggagttgaaagttctctttggcaatggcttgggttgttgagatccacagggtttgctttagaatgtcatgttgtctcagaaaatacagagcccttccctgtgttcaaatccagttattaacctctcacctcttttaatgccttaacttaaaaaattatgcaaatgactcattatggttttacacgtatatatatttggtctctgtctctggttcttggcacagagctcctaaaacctttggaatttcctgagtgataggagtgtattttgttcttcataaccagtgcctttcaaccacacctgagtttatggtaatgaggtggctcagaatgggctcctagacaacctcaggatggggctggttgccagaaagaccaagccttgattacagagttgggactttcagtcccacccccgacctccagattctgtgaccaatggttgatgatttcttttttttattttttattttttaatgagatggagtcttgctctgttgccaggctggagtgcagtggtgcaacctcggctcactgcatcctccaccttctgggttcaagcaattctcctgcctcagcctcctgagtagctggaaccacaggtacaaaccaccacacccagctaatttttttttttttttagtagagacagggtttcaatatcttggccaggatggtctcgatctcttgacctcatgatctgcccacctcggcctcccaaagtgttgggattacaggtgtgagccaccgcacccagccatggttgatgatttaatcatgcccacgtcgtagaagctccataaaaacccccatggggtttggagatcacatgtggaagtggggggtgggggaagggggcactgcaattccatgggatcagaggctcctgtgcttggcaccctttggaccttgacttctgtacctctttacctggctgtcatttgtatcctatataataaactgtaattgtgtgacattttcctgagttctgtgagtcattctagcaaattatcgaacctgagcagggaggttgtggcaacctccagttgtggtcaagttggacagaagtgtgataacgtggggaccccagagtggcacatgatgtgagggcagtcttgtgggaccgagccctgaaacctgcagagtctgatgataaccctcagcggttagtgttagcatagcatcgaactctaggatacccagttggcatcagagaaagtgttgctggaaaagacactgtgtatttggtgtcagaaagaaccacagattcatagttttttttttttttttttttgagacagtcttactttgttgcccaggctggagtgcagtggcgtgatcttcgctcactgcaacctctgcatcctgggttcaagcgattctcatgcttcatctaggtgccaccatgcccacctaatttttgtatttttagtagagaccatgtttagccatgttagccaggctggtctcaaactcctgacctcgggtgatccgcccacctttgcctcccaaagtgctgggtttacaggcgtgagacatcatgcccggcctcatggatagattttcaatgtgaaagactcaagttaaatagtacacatagtgtgaaaacaaagttccccctctgtatactttttttcctaattccctagtatgtcactaacaaatgcttgtcttcctgttctagggatttacctgtgaggacatctatgtctgcatgcgtgtgtatgtgtgtgtatacatgcgttgtatacatatacatgtatctatgcatgtcaatgcttacatgtatgatggcttattttttatggccactgcatagtttatttgttgttttgctaaatatcatggtatagtttacatgaagggggtcatgctagattattctgcacgtactatatgactgtagcatatagtttagggttgcaagtaggtgctgaaaaacactgcagacattctcatgttagcaagaggatttaatggctgcatattacagaaacttatgatttgttggattaatggatggctgcatggttattataaaatatagaatattttactatgactttgcttctttcacagtatatttaaaaaactaggaatacagtttatttgtgaacatgaatttgtactgcaagggtccacttatatccaaacttgaatcaaaaatatagtattctcaggatgtgaaactcgcttatacagagtaacataagcagattccactaggccaactgtaggtcatgagtatgcacaatttcggtatatgtggggcatcctgaaaccattccattgagtataccaagggacaactgtgcaggtgcagcttatgtggtgaaaatgggccgaacaacttcatatttcttccatgtcaataaaagagaaacatattaagcaggactgtgttattacaggaatcactgaccctggaggatgtggctgtggacttcacctgggaggagtggcagttcctgagccctgctcagaaggacctgtaccgggatgtgatgttggagaactacagcaaccttgtgtcagtgggtgaggacagctgccctgtgtcactcagagggtacccagtcagtggcctttgctttctcagcttctggaagctttggtatgtctgctgtgctcccaaatggcagatcctcaggcccgtctctggtcccacaggaagaggcataatcttccttcgtcttagaaaaaaagcctttaatttgctaacatgcaaattatgcagtccctaacatgtacctttctcctatcatcagagccacgtggtgcaattcagtgagcctaagtcttctcccatttcccacaaacagggtatcaagccggcaaacctgatgccctcaccaagttggaacaaggagaaccactatggacactagaagatgaaatccacagtccagcccacccaggtaagtgagagagaaccagcaagaggggaaggcagcggaagtcacattctggtcatttagagaaggcatgacagttgtgaaagtgtctagggagacagaaacagctgccacatcttcttctcccctaggatacaagagctctttttcttataggaattcagagaagcatacatacccctttatctcttcttggaactgatccctattcatttcttcttagatgttgagttgcttcccctaagttcttcttgcttggattttcacatcttcccattcttcttcatcacttgtcagaggatcattttgtgtttctgaggcaaaaacgacaaactgtttttttctctgtcacatagtcactcaacacagcatttatgccactggatatataggggttgttttctcacagcccaggcaattctccagcagacatcagctgggtatcgtctgtttcaaatcagctctgaccctatctacctgatacggcatcagatcccaccggttaagggctcagtccaagactgtgtcccacttcagatgccagtggcaagtcccaggttgtcacctcagcttctgaccaaccagctgtaaagtaggggttcccaagaccctctcctcaagtttgattaatttgctagaacagcatttatatgtatatgcgtgtgtgtatatatgtgtatgtgtgtgtgtatgtgtgtatatacatttatatatatactttatatatttatatgtatatatacatttatataagagagagagggagaaagagtgccataagcattgtctagagttactgattcatcaagtgagataagaactgaggcataggaggccgggcatggtggctcacacctgtaatcccagcactttgggaggctgaggcgggcggatcacaaagtcaggagtttgagaccagctttgccaacatggtgaaaccccatctctactaaaaatacaaaaattagccgggcgtggtgacatgtgcctgtagtcccagctactcaggaggctgaggcaggagaattacttgaacccaggaggcagaggttgcagtgagctgagatcgcgccatttcactccagcctgggtgacagagtgagactctgtttcaaaaaacaaaaagaaacgaaaaacaaaaaaacaaaaaaactgaggcatcggtatgtgattatggtttgtttttcacattctgacactatgtatttttcaccttgaattttcttttcatgaaatggtttttaatacactacaatataataatatcttccatgtctaaattcccattctactttgcatcccaatcacacacaagccactcccatagataccacatcagtgtgatttggtggtgcttgaggttcctttgctactctggagtcaagggcctggttttcattcttcttcatgtaagattgaaatacatcttggtcattcatgcatttcttcatcgaaggacagattagccaggctgaagagaggtcatacttttccatctattaagcatttcttaaaggctagatctttattaaaggagttttcatgacactgtccataccaaggcctcttgctctgtgagtctggttttgttagaattgagttgggggcctgggcgtgtctttacatgaagctctctcgggggctgtttttatgagttgatgaactgtagccataatacacagtagaagagactgaatttagtgagaaacagaaatgtctttcttgagcaaagattttgttagcaaaaatagggcaaatttttatgtaatatttacaaattaaacttttgaacgtgtgaaatgtttttgttacaattcagggctatacaaagttaaagtgaatagtaaatacagaaagaattgtaggactttagaagaaatgtaacctacagtggtctagacaagatggagaaagacagactgataaaatatcttatgcaagagacatagctaggtattgaattaagatgaagacatatgacaagaagttgtagaactggaaatgcaaggccatgtggggactgtcagaagattagcctgaaggccgggtgcggtggctcatgcctgtaatcccagcactttgggaggccgagttgggcagatcacctgaggtcaggagtttgagaccagtctggccaatgtggtgaaaccctgtctctacataaaatacaaaaaattagccaggcgtggtggcacgtgcctgtcatcccagctgctcgggagactgaggcaggagaattgcttgaacctgggaggcggaggttgaagtgagccaagatcgtgccactgtactccagcctgggtgacagagcaagactccatctcaaaaaaaaagaaaaaaaaaagattagcttgaaactggtcacatggaggccacagttagaagatatttgctgggaaatggtgaagtgggaacttaaagtggatgcgtcatggtaatggtaaaacttttattgttcagctcctgctgtgaattttctgtgccagtaattcagggtagtggtggaggtaaagttttgtatttttctagctctaggtagagcttacctttcacctggtggcagtactatagcaatcatactgtatagctgatgttctaagaaaaactaaaagtaaagctgcctcaagtcttgattcagaagtagggaggtggtccttgagggctccattcaccgatgccaacagagacataagtacaaaattcagagagtagaggctgttagtggcaaggtgaggaattagtatattagggacagcaaagtggaaaaaaaatccaatatgacatctgtgcaagtagggcatgatgaagaaggtgacagtttccatatttggtgcagtggcagagctgtgtggagaggaccacgtgttctgcttgcatgttctgaaagtccatagggatcaccctgtttctctttctgttggaacatatgagaatatatcatagccaggtagatacaaggtgttaaccaaaaaattgaggaggcaaagagaaactttatattctaacaaaagatgattcgcagatctgagtggtgtgactttgaggaagtggaaaaaacacacatcactgaagaggggaaacttttttttttttgccttgcaggaggctttttgccttctaggatttgctttgcatacctattcagtgagagatggggagtcttatgaatatctttatgagaatcagcaaacatgtgcatagtgagcaaacatatatgtaacatataatccactttcattttggagtggagttttaacattaaaatgaggtggaatttgactgtatgctagcaggtcttttacaggatataagaaaagtctgcacagactccggcagctgaccaaaacagctggtgtttatcaggagaaggatattgagatcagtctcctgtccaatcatagctgcagttatggcctgtggaatgctgttgggggtgaggggcatcagttagtcagcatctggtggtccgggagctgcaattgtttcaatattgcttgtcccaaggccagtgtttgtttagctgctacagaaaaagaaacaaaacaaaacaaaacaaaaaacactcgtggcagttagaacatagtttattctttaaatgtagggggtgtgtgacttaacccttacctgtatgtccttagacctagtttatagtttggtatcttattgctacaaagagtctgttccatcagtcttgtgatctctgttttaacaaaggttagagtattgactgcagttttcctggaaatatgagattggtgctctaggaaagttagcgtgatgatggtctacagaatggagaagggcatattttagcacccaacagtctaataggattaggatgaagtcaaaggctgtgtatccaacattctaacttgcctttctgggatatttattctactacctatgtctgctgtttccctactcaggattattcttttttaaattaaaaaaaaagtttttgtagagacagtctccctattgtagcccaggctggtctcaaactcctgggctcaagtgatcttcccacctcaccctcccaaagtgctgggattacaggcatgagccactgtgcctggctggcaaattttttttttttttttgagatggagtcttgctctgttggcagactggagtgcagtggagcgatcttggcttgctacaacctctgtctcccaggttcaagcgattttcctgcctcaacctcctgagtagctgggactacaggcacgtgccaccacgcccagccaatttttttgtatttttagtagagatggggtttcaccatgttggccaggatggtcttgatctcttgaccttgtgatccacccgccttggcctctcaaagtgctgggattacaggcataagccaccgcacccagctggcaaattttatcttatatgtatttaactacaattcttaaaagtttttttaacagatagggaacacttatacttggaattccttccatgttggtattataggggttccagtaaaaagccagccaaccccaaggcatctttgaagcagttttattccgtgtgatgatcatggaaggatttattgttctctctcttagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacagaggagagaaaccccacgggtgtagcttgtgtgggaaagccttctacaagaggtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttatatctttcatatctttatttatcatggttttacttttaacctatttatgctttcatatttaaagtgggtgtttagtgggcaacatacagttgggccttccttttttatccagttaacaatctctgtctttttactggggtatttagatcatttacgttcaatgtattgatgtttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcacttactgtataataaaataatcttacagtagtatatctcta

SEQ ID NO: 11019 - DNA, 497 bp, Homo sapiens
aattttgagtccaagtttcagtcaaccagccaagtcaacagttagcaccactcaatttagctcacacactgaaattgccagtagaatgtaatctccatgaatgagagtctttgtgcctgaatttccaactgttgtattcccagcacgcacaacagtgtttgacacattaggcattttataaacattcgctggataaatgagtgaatgatcaatccctttaaaggttctctgaggctggttataaaattatagggagcaggtttggtgctagaattcatcagttaattgatcagctgagtttcagtattgaacagaatcatctccccttcagagttttgatttcaagttgctcccaccttcctggatgtaaaggcttgttctgcctttggcttttccagggtgagagagccctgttttcgtgttggttccccactttgtcaactgctgatcaactgtgttctccattctccacaccaattataaccaaagctttaaca

SEQ ID NO: 11020 - DNA, 9754 bp, Homo sapiens
  misc_feature (7069)..(7069): n equals a,t,g, or c
aggggaggaagtaactgtagatgtggtggaaatagcaagagaactagaagtggagcctgaagaattaactgaattgtttcaatctcatgataaaacttaaatagatgaggagttgcttcttatagatgagcagagtattttcttgagatgcattctattcctggtgaagatgctgtgaacattgctgaaattacaacaaaggattttaaatgttacataaatttaattgataaaacattggaagggtttccaattttgaaaaaaagttccgtggataaagtgctgtcaaatagcatcagatgctacagaaaaatcttttatgaaaggaagcatcaatggctgcagcaaatttcattgttgtcttattttaagaaattgccacagccaacccccactttaagcaaccatcaccctgatcagccagcagtcattaatatctaggcaagatcctccacctgtaaaaagatgatgactcactgaaggctgagatgattgttaggatattttaacaatgaagtatttttaaattaaggtatgtattttcttaggcataatgctattgcacacttagtaaactacagtatagtataaacgcaacttacatgcactgggaaactgaaaaaattatgtgacttgctttattgagatactcactttattgtggtggcctgaaaccaaacccgcagtacctgtgagcatgcctatatttgatacaataggaactatattgcaggtagtaaaaaatgatgaatagtgttagttcaaagcgatagatgatttgtatgtccaaattaaagaaaagcatgtatgggaaaaagattgtcatttttatgtaaatgataagtgctttctgaattgtatttaaagaaaagaagattttataagtccaaagaatcacttaatacaatgaataaagggtaataatttaccacttttggattaccttttatttaagacataaatttttcaactcataagctatttaaaatcttttcacttaagatacctgttgaaattttgtttaggtatctggccaggaacagtcttcacggggacaaagaattttatctattccaatttggcccccaaacctaggtatctcacagaactgtgtgtatgaggtacagcaggtaccaaaagtagaaaagacaggtaagtgtttgtaatacattttggcagtctgctgggtaatcatgttccctttgaagacataaaactaagtttttaaaaagaaaaaatctcagggatgaatattcatatatataaatatgtagttattcattttttttcttaagacctctaaatttacctttttaaagttgaacttccagaattatctgtgcatgatttacttgcatgttgctttggaattgtttgcatttttctatttttcctaattctggaggccatcgaaatatatagattccagaatgaaacatgtaactaggcatctttctaacctagataagtcttaaatattgtttctagagtaagatgacgatattaaggcaaactagaacaataacattaatatattttcctctattcttacagacagtgatctgacacaaacacagctgaagcaaacagaggtcctagtgacagctgaaaagtgagttctggaaagcaaaaggagacatttgctaactttagttgaataaaaaactcatttctcaaaaatcacttggataaaaaaatgaaggtgatagtattccgtgctggtgaagggtgctggcccttaagtcagataggcctgagttccagtcctgactctgctgtgttttagccgaatgattttgagcaagaaacttaacatctctgaggttcagtttctttgtctatagtttggattgttgtgaggattagatgagacaaagcatataaagcacaatgtctgaaacatacctaggcacctaggtagtgttaggaagggaaacagcttgtctgtggacctggaccagctcaaatactctttgaaattcacatacttaaacaaaggtcaagatcacataaaaatatctttcagatctcaaaaggatctttagttgtctttgatttactaaatctcaaaaccatctataagagaattgatccaaaaatgaatatgccagttgaaaagatgatcattttaatttatctcttgaactgtaggagaagattgtcagaggggtgaagatgctggaattcttcattaaagaaataggaatatttggggctatggttgagaaattgatacatgttaataaaacaggacagagacttaaatcttgtctcagggagattcttgaaatatcttgattgttaattatattgtggctgttttatagttttttgttttaacatttaaatttagggaccaattctcatttattttatctgcttctcaatctttattttgtataccttgttttgagaaaatattactacataaataagaactagtaagaatggaagcaatttttaaaaaaattttttaaatgaatattttaaaattcatgattaaacctttcaatatagtaaaaacttctttgaataagattaataaggaggctaatctaacaagtacttcgttttgagtaactcttaaatctttttgtaacaatataggatataaaaaagatattggctgggcgtgttggctcacgcctataatctcagcactttgggaggccagggcgggaggattgcttgagcccaggagtttgaaaccagcctgggcaacacagtgagaccctgcctctattaaaaaaaaaattaaaacattctggccgggcgtggtggctcgtgcctgtaatctcggcactttgggaggctgaggtgggtggatcacgaggtcaggagttcaagagcagtctggccaagatggtgaaaccccatctttactaaaaatacaaaaaattagccgggcatggtggcatgcacgtgtaatcccaggtaggctgaggcagagtattgcttgaaccctggggggcagaggttgcagtgagccgagatcgcaccaccgcattccagcctgggtgacaaagcaagcctccgtctcaataatgataataattttaaaaaatagataccttacttgcccttggtgtctaaaaattaaaagaaaaaaagaggccgggcgcggtggctcacgcctgtaatcccagcactttaggaggctgaggcgggcggatcatgaggtcaggagattgagaccatcctggctaacacggtgaaaccgcgtctctactaaagatacaaaaaaaaaaattagctaggtgtggtggtgggcgcctgtagtcccagctactcgggaggctgaggcaggagaatggtgtgaacctgggaggtggaggttgcagtgagctgagatcatgccactgcactccagcctgggcgacagagcaagactctgtctcaaaaaaaaaaaaaaaaaaagatacttttttgtatctttatgtaaatacagagtgtttatatgcatagcttatatctgtaaactgaaaaattgatagataagagtttgcagaagacctatttttatttattatttttatttgagagttgatctcactgtcatccaggctagagtgcagtggcatgatcttggctcactgcagcctccacctcccaggctcaagcctttctcctaccttagtctgccaagtagctgagatcacaggcatgtgcctccacgcgtagctacttttctagattttttttttttttttgtagagatgaggtctcactgtgttgcccaggctggtctcgagctcctgagctcaagcaatcttcccgccttggcttcccaaagtgctgggattacaggtgtgagccaccgcgtccggccctattttatgtttaatattataaatccttagacataaaaagttgctaataaaacttagagggcatttttaaggatttacctttgttcctgacatatgaacactttaaaagcaagggaaacatcttcatctatgtattctcagcacctgacatattgcctagaacttagaagatgtttggtaaatgtttgttggataagttttttttttaattttattttccttcaaggcataaaagatccttaagattcataaagtatcactagaaaatagtctttaaaccttttactcataacatcacatatatttgtgcatggggcaaatataataaaccattagagaagctgttttaagatgcagtacaaaattatatgtgatagcaagaaaaattagagaagaatatggcctctctgtcatcaaaagtctagaggattccaaatagtgttcctgaagacccccttgattctctttcttaaaaacacaataaaacttgttagaatacatgttctttagtaagtggaggcattcacacgttataaataatgaaaaaacacattagtatgttaattattgagctttttttaaaaaccacatttataatggctttattgatgggttttagatatcactgcataagtaaattaatactaaattatgatatggtctttttaaataaagcttgtcctaatgtttggtcttagtctagaaattaagtgaaaaagaaattcagataggaggaattcttgaagttacaaaaactcggattctaaacacttcttcttttctatttagattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggtaaggaatgcatgtaatcttaaattctcctagagagcacagtagctaaaacctcaaggttaaagttaagaaagctctctaaacatccagttgaagttctagatctagaaggtaaaaatatttcgaaatagacagattggtaatatatttgaataaatcagttgattacttgcatatgagggaggcaataaaacacatccaagcaaattattacccaagaattacattagcagtcctaccctccagttccagtcagcctctgagttataggtctttcatattgccctttctttttgcttgccataaatttactgtttttcctgtgacaggaactgagtatgttgttaatggtcatcatagttttgtgcttaaattttaccgaggcgtcctgccttcattggaggaccatagttacactgccagcaacacagcttatgctgtcatgttgactctggaatattggatttttctgaggaggaaaagtatatatatatatatatatatatatatatatatattttttttttttttgatacagagtctcgctctgttacccaggctagagtgcagtggcatgattctcggcttactgcaacctctgtctcccgggttcaagtgaccttcccacctcagcttcccgagtagctaagactacaggcatgagccaccatgcccacctaatttttgtattttttgtagagacagggtttcaccgtgttgcccaggctggtctcaaactcctgggctcaagccgtccacctcggcctcccagggtggcttggattacaggcatgagccaccacattcggtcagaaaagtctatataatttttttgtttgtttgtttttgagacggagtctcgctcgtcacccaggctggagtgcagtggcgctatctcagctcactgcaagctccgcctcccaggttcacaccattctcctgcctcagcctcccgagccactgggactacaggcgcccgccaccatgcccggctaattttttgtatttttagtagagacgggatttcaccgtgttggccaggatggtctcgatctcctgacctcatgatctgcctgcctcggcctcccaaagtgctgggattacaggcgtgagccactgtgcccggccgaaaatcaggttttaaacattagccaaaggatttaaagtggagaagaaaatgcagtttaagattactggaagtacaaaaatacctttaagaaaactttggaatgtgagcagctgttttattcttttctgatttttttcatttttttctcttccatttttttggatgcttctttttctttacccttttcccctctgtttgttcccccctcctttcttctgggaataaccttattagtaacactcacgagatgacttattcctgccactagatctactctacaaaaaatatgcctgctgctttgaatttatagtaaggttttcgtagttgtcatgctgacagaagttcactaggtggcaggagagtgttatggatcagcatttcaaaaagagcatgtcatcttcacttctgtgggtgctgactatctgggactaaattatactaatttattctccattcaccttataaactgctacagggctgtggcccggtgtctctggctttatgcaactacagaatggttgctggatgagtttcttatgtagttgtcaaccacaaattacccttaacattcttaagtatttcatttatattttcttctaaagattgtttacagagctggaaatagaaaaaatatctcaaactgctgtgtgtttgataattataattaggttataattcaataaagcttagatattctaaaaactgtgtcatagtttttagtcttctggaggggcctcaagttctatatttgtttggagaaaagacttgtatgattaatttacaataacccgttgacaattttactaaatatgtgtgtgcttctttaatgtaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaatgtttttnaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatacaagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccaccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 11021 - DNA, 288 bp, Homo sapiens
aggatggttttattaaagtcccatgctgtgttagaaacatacaagtgatgagaaaaacattaacttgaaacatgcacttactggcattctctaaaataccattatacaagttttcatttaattagaaaaatacccactaaaacaatcacagttcttcttaaagatttaaaaaaaatgtattggccagaacaaagtccaagagaataaacaaagttctgaattgtatgtcaaaaaactgtacatggttgtacataaaactatagcttacaaaagactcaggtatagtaa

SEQ ID NO: 11022 - DNA, 619 bp, Homo sapiens
ttatattgcaagaagatgccatctaggacttcataactagaaagaagaagtcagtgcctggtttcaaaggacaggctgactcttttgttaggagctaatatagcttgttactttaagttaaagtcagcattcattgaccattctgaaaatcctagggcacttaaaaattatgctaaatccactctacctgtgctatgtcagtggaaaaacaaagcttggggatgacagtgcatctgtttatggcatagaatattttaagcacactgctgagaccactattcagaaaaacagattcctttccaaagattactgttcgttcacaaggcacctggtcacccaagagctctgatgaagatgtacaaggaaatgaatgttttttcatccctgctaacacggcatccattctgcagcctatggaatcaaggagtaattttgtacctacaggtctccttatttaagaaatacatttcataggctatagctgccatagaagtgatttctctgatggatctggggaaagtaaattgcaaacctgcaaaggattcagcatcctaaatgctattcagaacattcgtgattcatgggaggaggtcaaaatatcaccattaaaaagagtttg

SEQ ID NO: 11023 - DNA, 1355 bp, Homo sapiens
agcatttggtggacttctgagcggtgtccaccttttagctgtgatgaacggtgctgttgtgaacacttgtgtacaagtttcagtgtggacgtgtgtcttcgtttctctcgggtatatacctaaggtggaatcactgggactatggtaactgtgtttactcatttgagcagccgccagcctgctttcccaagtgtctgcaccatctcacgtcccttcctgcagccttgggagttctgatttcgccacatctttgccatcacttgtttttctctgactttttgtttccagcccatgttgggtgtaaagcagtgtcttgtggttttcatttgcattttcatgatgactgataatgttgaacatctttttttgtctttcttggcgatctgtatttcttctttggagaaatgtctattccgattcttgcccacttttagttggattattgtctttttgttgttgatttatgagttctttacatcatctagatagaagtgcttcctcacatatatgattcgcaaatatcttctcccattctgtgagatgtcatttcactttcttgatggtgtcctttgaggcacaaaacttttaagtttttacgaagtccaatttatttttcttttgtcacttgggcttttgctgtcatatgtaagaatcttttgccaaatccaaggttatgaaaaagaaaaccttcaaaagtttttttattttagctcttttatttaagagctaaaataaaaattttaatagctgcatgtggtgtgaagtagggatccagcttcgcccttttgcgtgtatctgttcgttggcccagcaccgtttgttgaaggctgctctttcctcactgaacagtctcgacattcttgtcaaacatgagttgcccgtaggttatgagtttattccagaaccctcagttccactgcaccgatgcgtgtgtctgtccttgcgccactcccacactgtcctgttaccatcgcattgtaagtcttaaaactgggaatgtaagtcctttgacttttttctaatccaatactatgaacaaaatagatggcagatgaaattgaaaatttcctagaaaggtgcaaactactcaaactgattcaacaagaaatagacaatgtgaatagatatataacaagtgaagaggttgaattagtaatccaaaaacacccataaagaaaagccaaggaccagagagcttcccagctaaattctaccaagcatttaaagaattaaaaccaattctcacaaactctttcaaaagactaggagagtgggaaatgcttctcaattcattttatgagaccaatattactctgataccataatcagacaaagacattgccaaaaaaagaaaa

SEQ ID NO: 11024 - DNA, 507 bp, Homo sapiens
ggtgctggtgtgggcggtggtggtgctggtgtgggtggtggtggtgctgatgtgggcggcggtgctggtgtgggcggcggtgctggtgtgggcggcggtgctggtgtgggcggcggtgctggtgtgggtggattcctggaggacagctgggtcttgcatccagcacaggtcctggtgcctgggaggtgcttaccccatggccccaaccggcacaagtgtggctgtcacagctggggtctgggtaggtctggcagccccatgggaacctggctgtgtgagcctgccctggggccttccatgagaaaacccagttaaggagcaacctggtaaacccttgaaaaccaagtgggccttcaccagcttgaaaggccgcccgtgcctttcctccttggccctcacagcccagctcggcatcgcagcagagtcccggtggtggagatgctttgccactggccacccagagctaggagcctcggccaagggctccctccttgcactgtggtctct

SEQ ID NO: 11025 - DNA, 3640 bp, Homo sapiens
caaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtccctccagagctgggatcccatgggcgcagcagcacacccagctcccatgcgtcactccctagctctgtcccagcttttgctatcattgctgacttttcctcctgtggctcatctctgtccctgctctctttgaaaacctaaactaccaaggtgtcatgctgcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggacgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacagcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgagccaagcctcctctgccactgccagcatggcccaagggaggcttggccttgcgcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggcctaccttcctacacagctaggctataatgggcctgagtgagagggtagcttccccagccccaagcacaggcagaggggtggagagcaatttttggttttatttttgtttctgaagtggtgcctgtacctccagcccccaggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtctatctgccccagagaggt

SEQ ID NO: 11026 - DNA, 19447 bp, Homo sapiens
aatttacaaagttatctgaagtcttacattttatttaaatagcctccagtaagaagagagtgggccaattactaccccttccttgtaaaatgaagtaaccaagccaaggagggtaagtgcacccagcagccagccagccatgtgatgggtggggtgcctctcagtgggggcggccacgacacggccccggcctgctgctgtgggagcatccacagtcgagcgggggttcttgatggtttcatctacagacacgatcaggcacgcagcctcagaggctgctgtcagcgcattgatccgcaccatagctggctcccacacgaaagcttcaaagttgtcagcaatgtcctcgttgttgatgtctactccataccatgtacccccctaaaagagtaggaaaagaaaggaggtaatatggaactactttcaactttcctcttgtaaactggtactccaaaagacactgctaggaacccgcagactctctgaacttggtggcatttcgctgaagaatactgcatcttcctatgagcatgccaggaacctggaaacacccctactcccgccaactcctccccttagccctggacataccacacaagacctctgggatcttctcccaggcaagctgttgtgttttggggcggccccatcctcaggtcacctgaggactatatatatatatatatatatatatatcaaacaatgagttctcaagataaacaggaataacaaaaatactatcccatctttcatctcattgcttcaaatagcccgattttacagatgaggcaagtgagacacagaggtaaagtgactttaagcaaaagtcctaatacaagccagaagcagggtcattcactgggtgctaagcacttaacaaacctctatctatttaacaaatggagaaattaaactctcagagaggttgaagtaactagcccagggtcacacttgtagggctctggagagcttcaccacaccagtaagcccactccatgtggtcagtatgtgcttccaggaaggtggatgcaaggttcctcctgtggtaccataagaagcaatcatactctttttttttttttgagatggagtctcacactaccacccgggctggagtgcagcggcacgatctctgctcactgcaagctctgcctcctgggttcaagcaattctcctgcctcagcctcctgagtagctgggattacaggtgcccaccaccacgcctggctaattttttgtatttttagtagacatagggtttcactatgttggccaggctggtctcgaactcctgacctcatgatccgcccacctcggcctcccgaatgttgggattacaggcgtgagccaccgcacctggccacgatcatactcttggtagaagcaatgaagaaaccctggatctcctgtgctagcaccatggctttccttctgccctcagaggagggagttggtcaggcagacaggctggggggagttgcagcctatctcctgggccaggcgtgcacagcttgagtaagcacagctcacattcagaatctagccccacccgcccaaaccctgaaccctggggagagaaaggacccacctgggcatgccgagcccgcagcttgttgagaatgtttgtggcatcaaagccagcattgtcacacagctggcgtgggataatctccaaggccttggcatatgccccaatcaacagctgctgttttcctggaatagtccttgagtaatcccgcaggtacttggagagttccatctcaatggccccgccaccagccaccactgaatcattctgcagagatcagaccacctctcaatgtaagagggcccctggtccaagcttccatgctgggccactcagtaggtcccttcagcccagaaagagtggttcttcattccttcctccatcccaagccccaaacgcccagacacagcccctatctagaacatcccaacttcaacctggtgaaccttatggtttctgactattttcaaggtcacctgcagctcaaggacactggcacaattactggaatatctgactacattagctccagtttgctaacaaaacgaagtctttttcttctgcttgctctgttgcccaggctggagtgcagtggtgtgatcatagctcactgtaacctccaactcctgggctcaaggcatctttccacctcagcctcccgagtagctgggactgactacaggcacatgccaccattcctggctaatttttttatttttgtagagacaggatctcgctatgttgcccaggctggtgtcaaactcttggtcttatgcaaccctcccatctcggccttccaaagtgctgggattacaggtgtgagctaccacgcccggctaaaagaacaagtcttagctttcaaggcaggatgacctatttttgagaaactgaggctcagtttctctaccatttgtggggcaaatcagggctcaccacaccacccaggaaagggcaggttatatagagaaggaatcaccacacaaatccaaggtctgatcagctagggagataggagagagtaggctgtgcaagcaggaggatatcagcccagtaccttgatggccctcctgacgatcatgatggcatcatgcagggaccgctctgtctcctccataaactgctcggcgccgccacggagaatgaaggtgcatgtcttggccttggggcagccagtaaaaaaattgtacctatgcccaggattaaacagtacacacatgaactcttgtctgccaccatcctactgtattgtcctcactgccagcccccccaacactcagcagctgctcttacattcttcactcaggttacccaatcccaaccttatagacattttcttggaaaggtctgcagctgtaccactagggcataaaagattgtggagtcaaggcttttagatcttcctgtaatcctgtatattatctgagctctttatggctcaaaggtgagactctgtaaaagctgtataccactttgtacacaaaggtgagactttgtaaaagctgtataccacagccaaaagatggcagaagaccagacccaggcaggtttgtgagctcggcctgggcccacggctcacctctcgcctccaatctgggtctcttcaaacacctggcatcgacccagcacatctgctgacagagcattcacactggtctggattgagcctccacaggcctagggagcaaggaaggcaagatctagcagtgaaggttcccgaggccaggcagcttcctgccacctcgtctcaaagccaattcccacgcatgcccccagagcctctacattacccgccctttcccttgacttccaggcgacccttccccctctctgaaagagcaaaaaaaaaacaaaatagaactaaaacacatcaaaggcaaacagaagaagttaaaaggagatagggacccattcaattcagcttatactccctcccctaaactagggtggcactgggtccagcaactgaactcaggagtactttaaacctaaaagtatcttttgtgggatgctcatgaaagggaaaaaatctggctggaagaatcaatatttgagtttgtccagctaatcatagcattactgctaggttctctcacaaaccagatttctggacttgttttggttagactaaagtagtttgtgctactgggcacacacacatggaaatggaatgtgtcctggaaaaaaaagagttaaaaaaaaaaaacagggctcaattcacacgccaacctgacagtacactctgttataccaggggtcagtgaaaacccttcagggccacaaaggccgagaagcagcctgtgaaaatctggttaccatcattgtcctcttcagatcctcctcaggtactcggccagcacagaacatgtccctgtcagcaaagtactgggtggccacatccccaatggggagtttggacaagacaactttggctccagaatgatggatcttctctaacttgtcatagagaatgttccactcagcatcaacaattgcctgataatcctggagagacccagaaaaggatgagaatgctttggggtgaaggttgacatatacggtagggtaaaatatacccatctgcccccaccaaataaaacatgctgattcatctgggaattaacagagataaacagaatagctactcctcagtccaagcaaataaggaccccatgagatgacttaggaatcacctgaaactccccaacacaaaagcagaaagtaaccccaaggctgagaaccacagctggtgctgtccagatgcgagaaatagtttaaactggctgaggtctagactcttctgaggtgctggattcatggagttcccaataagacccctttggccgggcacagtggctcatgcctgtaatcacagaactttgggaggccaaggcaggtagatcacctgaggtcagaagttcaagaccagcctggccaacatggtgaaaccctgtctctactaaaaatacaaaaaaaaattagctgggcatggtggcacatacctgtaatcccagctactcagaaggctaaggcaggggaatcacttgaacccaggaggcagaggttacagtgagccgagattgcaccactgcactccagcctgggcaacagagcgagactccgtcttaaaggaaaaaaaaaaaagaccccttccccaagaactgctcaaaggtgggtgacatggctacctccagaggtagcctgggtaacatcaacaatgagagcacacctgtctctgcagcactaggtctagtctagaagtggaggaactcacacttgcaccaacaagaggaaccaaaataccgggcaggctatgtagctagagagtccctgccatccccttccccaggaccacagcgtatttcaacaggtgttccctatccaaatttcctcaggtcaaggtcactcagggagaacacagagtatggaaagaagggggcctagtacttagacatcaatattcaggggggcaggaagagaaaggggcccacaatagccatgaagacccagggctctggctcagaaagctgcccatttccatgcccccaccaactggtgaacccacctacctcaactgtgtggactcttatctcagcattgtctttctcagctttcaactcgagctcgacattcaaaagggcaatcttgggattgtggtactttttgggttgcatttcaaacccagcgtaagagaaagtcttcttgaatgcaacaccagctaccagctgagaatcctgttttaaaaaaacaaacactttaatggtttggtactaacatgaaataaaatcaagctagttgtttgctggctagtgcttatccattcctgtgagcctgagctaatcatgtctttatttcactgctgtaacacagcctttctgttatcataaaatcgaagacaaatccttttttttttttttaaataacacaacatattatttcagtcaccccttaagcataaggaaaatcatctggttagcagaggcaaagcatggtaaaggcctactgggctgtcctctaagactggcctctgcagcactggccgatggataatgctgtacaaacttccaaaaagtatgccagaagaggagccaggtgtttacaaagaaggcaaaacaaaagctgtgcaatgctaccctcttctatgccccagctcccaaatctcaagtatcctcctgtacacctccatgtacccataatttgcactgcaccctccacccccacacccccaacagcatggatactatagccttgacgcttcctccctccagaagatgatgccaaaaggtcttaagaatcagaaatcccctgcataatttctaagctatcactgcagctcctcagacctcaatccctcaaggtagggatcttctaccacttgttctgcaacagagcttctctgtgggttggatttaacagcagggcataatagaaagcacactgcacccagggctgactcagcactaccgtgagacttaggttccaatctcagatcttttccttactaaatgaccgagtcatttcccacaccataaaaaagggtattcagttcaataacctttagtttctctgccagtgctcatctacaattctaatctataatactgtaacccatgggtgaagagtatctgtccccagttcctgcatcattcaaatccacagcttcctaaagggagtgatgcctgagctgaatgacagatgagcagaaattagtcaaagagaaaaaaggaaaaaaggggttctcctaagaggtgggaggcagtgttgtggaatcagagaatgaaaagccatttgaagttgctagaatttagagggtaagaaccagccagtgaagaagagagaggggaagtaggcaggggccagtttagaaggatcttacaggctttgttaatgcctggctttgtatagggaatgtagatatcagaaggctttacgcagaagaataaagtaggaaacttcaccctgcaaatagtaaataagtacaatggatttaggggatccaagactggaagaggggtggcaatagtaccagaaagagtaaaagagacagactcaataaataattaggaaatcacgaggtaaaatggaacaatggtaattgacaggctggagtcagaagggttttcaaggatgatcccagatttctggtttgagtgactgaataaacggtggtgacaccaactatgacaagaaatacagaaaatgctatcacaggagtggaggacaagataaagcgtttaacagcagttagacacaagaaagagcatgaggctcagaggagaggtgagtactaaagatatggatcagaaaattcccagttaaccctggtaacaagtaaataatcactaccactatttattgaattctgggtcaggtttgtatgtatttaacgaatgtaggacagtctcggaaaaacgcaagtgtggcttagagtccctggctctcttgccaggtaagattattagtcctgatttctaatctatgtagattagaaatggatgccatttctagattagaagtggatgccaatctaatctcaaccatttatggaagtaggaaggcccaagagaagatgaaaaatcgctactaaagcagtgagtaaagacaaagtcagcaagccatgatgaagatagggaaatggctcagatgacctccaggttcctcacagctttattacatacagagaatctcagcccactggtctgacatgtgccacaataggaggggaaatggcaaagtgggaatgcaatttgggagggtaaaatttaaagagaagggccaggctatctttcaagctggtcctcctctatccaaatcgcttcagttgaggtcactgacgaagagtaataagtaaagcaggccagagactgaaaaggccaaaagcagcatggagataccaaggacgtttccagacagatactactgtgttaaaaagaaggagttgtgctgtccaagacagtagccactagctacatgttgccatttaaatggaaataaaattaagattcagttcttcagttacattagttgcatttcaggtgctcagtagccaagtgtggatggggctatcatattggacagcgcagatatgtaacagtcccaccaccctacagaaagctctactggagggtgctgagttaagagctacacacgctaatgtggatcaatttctaaaatatgttgttgaatggacaaaagcaagctacagaacactatataagcaatcttttgtctttaaaaaacagtatttacatacatgttcatatatgcacaaagtaattctgcaaggatacacacaaactaatagtggctgtatatggggcaggggtagtgcatgaaacacttttaactttaggccccttcacagtttgaaatatgtatcatctattcaagataaatgaatgaaagaagggcaagcttaacagtatcacttaggagtaagcagtgaactgaaaaatccctctcagatgtattaattgggaggtcattgatgatttgagctagtcctactacccctccaccacccactgacacagagaacctgagattctgaaaatcatacagtccaattttctactctgctgacaaataatatccacagaggttaccaagttcatctagtaacagcctctaatggcagtatggaaagtacaatgtaagtctgacttcctgcctaacatgcattctctttattcctgtaatgagtacccctctgccatatgaagctgtctgaagggtcaatatgaaagcaagagctgtctaggaaggccacagcaggcttacctcgagggctccaccctgtaccttcttgattccaatcattttaagctgcagcaaatcatcgagcatcatcactgcatccaccaccatcttagcaaagaaagctttctgctgggagatcagcttggagctcagagcggtcatggcacacttttccagcagcttcctctgctccctgggacacaagggcagaatctgcatcaggtcttgaaaaccaaatccctcttatctgattctactacagtgtggaggtagttcccttccagtctctaaactcagccctctccaacttcaccttttgtatctttagggcagattatcagtgacagatggtgactgcagtcaaagatctcatatgtggcagcttttaaactacagtcgacagcttcttttgtgctctgtgggctgggacacagccaagggtctggcaggagccaaacagccccaggcacatagagggattgcagcatgcttctgcatccaatttggccacaggaagtcagtcaaggttctgacaaaggcctgacacggtgactcacacctgtaatcccagcactttgggagtcgcaggtgggagatcacttgagccagtagttcaagactagcctgggcaatacagcaaggctccgtctctttaaaaaaaaaaaaaaaaacccactacagacttacactttatctgccttcttcacggtcacagcaatctctttgatcttgttaactgcctgccaagaacagaagttgaatgagtctctcatgctaaagacaaactgctgaagtggacctcaatctctcaatagtcctgagtctgttcactcccaaatcctaagcatttctactctacagctgaaaaaacacttctaggtcttgtaactgctcagaaaaatgtaaaactctatagttcagaaaattccaagtcagaaatgcagagtgggtatacagttctgaagaatcagggtgcttccaagattttgctctgggtctgcaggtaacacgctacaacgaatgagtggaaacagctgtgacacgagattaagccaaacctcctggtttactaaaaacacctacgacaacttctagcactttatatattagttatatataaaatatgcatacaaatatataaactttttatttttttccaaagtactcctcatatattatttcattttaatgtcaccactcaaattagagatagcaaagaaagtaaggcctagaaagattaaatgacttgccccagatcacaaatgaaggttagagggcaaataatagctaggtctcaatatacaccatgaggtgcttgagtatagcatgtagtagtagtatgccatgagtctcttagtccttactaaaagactatgtctacatcatagtctaccaggctgactctaacctgaggcttaaagagattaagtaatacacctcatcaaatggctacagattagtagaactgagattactaaggagatgtcagaaaatgcccaaagtaccctgttccccagtccctccacactcctgaaaagaaattccccttcctaagagaaatgtgaaggtgtccaggcccaagagaaggttaatcagtactgccataccagctgggtggctgtgcggaaagctcgaatgatgatctgggggtgtaaaccttcctccacatagggtttcacctgcttcagaaactctgcagccagcaaggtcactgaggtggtgccatcacccacctggaagatgatgacaggaaatacacgttttctgatgttcagggaataaagccctgaaactccatttttaggcacgctacccatttaaactgcatattatttaaatggatgtcaagcttttttctggaagcacaggtttttgcaataagtagaaagaagctaatggtagttacatatccatcatgtcaaacagtcctgggctaccaaattaattccccagacagccccattctctaaagagggctgatgtggacaatcaaatgtcctcagggtaaaaaattacacacatgaactgagaacttatgttacgtacaaggcattgtgatgaataaaacagtccttgtcatgcttattgtaatacaatacttaaaataatcatggtaccaagaagcaagagacaaacattgtttaagaagcaaaaggtggctgggcacggtggctcacacctgtaatctcagcactttgggaggctgaggcaggtggatcacctgaggtcaggagttcaagaccagcctggacaacacggtgaaaccctgtctctactaaaaatacaaaaattagctgggcgtgatgcgggcgcctgtaatcccagctactcaggaggctgaggcaggagaattgcttgaacctgggaggcagaggttgcagtgagccaagatcgcaccacagcactccagcctgggcgacagagtgagactccgtctcaagaagcaaaaggtactgcaggagttcctttcttttttaatagagaaagggtctccctatgttgtctagactggttttgaactcctggcctcaagcaatcctcccacctcggcctcccaaagtgctagaattacaggcatgagccactgcatctggccaggagttaaaaaaaaaaaaaggtaactttcagtcaaatcacactaaaacaaacgtcctaggaccagccaaagttctttatatttcaaaaactatgaggaggccaggcacggtggctcatgcctgtaatcccagcacttggggaggccgaggcgggctgatcacctgaggtcaggagttcgagaccagcctggccaacatggtgaaaccccgtctctaccaaaaatacaaaaattacccgggcgtggtggtgggtgcctgcaatctcagctactcgggaggctgaggcaagagaattgcttgatcccaggaggcggaggttgcagtgagccaagatcacaccattgcactccagcctgggcaacaagaatgaaaccccctctcaaaagaaaaaaaaaaaaaactactgggaataagcagattactagtctgctaatcttttttagatggtgcttttctgtgatgggatctaaatcctatttaatgagggtgaaaaagaaaaagagctttctaagaaaattggataaactctaaactggaagaaatttatttcggtagagatggggtcgtgctgtattgcccaggctgatctcaaactcctggactgaagggatcctcccaccttggcctcctaaagtaatgagacacaagcatgagccaccatgctcagcccagaaatttatttttaacttcatgtatgttcactgtgtaaggtaagaaattctcaaggggcaaaaaaaaaaaggttactatagagaaggtttaagtgggcagatttctggaccaaaaggcattattccctcgttgaagacaaaaacaaatcaaatccagactcttctctctttaattttatatatgctatacctgttttataggcttggctcctaataaaccttttaacgtaacttcaagacatacctgtagtatacatattttgcagtactctaaaatacaaaacctatctgtcaacacatttattaatactccagtgttagaatttatttttaaaagatagactggttaatgccatgaattatacacttaaacatggtattaagaataaatattatgtctgttttatcatcagtttaaaaaaaaaaaaaaaaaagcctggtgtagtggggaatgccagtagttccaacgactaaggaagctgaggtgagagaaggcttgagccccggagttcaaggccaacctgggaaacatagtaagaccctatctctttaaaaaaaaaaaaaaaagaaagaaaggcagattggaagtcttagtttacagccccattttgtaagagatgagaagtcaaattatttaacctagcaactcacacaaatgacagcacacaacctgttaagatctcaggcagtagacttatatctaaagactgttgtcattcaccaatgtattaatggatatgaaaagctacatgtaacgaaatagtatgaattttaaaaggctgttaattctaaatacttttataagcatgtattacttgtacaattataattatataaaatcttaaaaaaatttaatagaggagaactaaggagcaagcaagcatgtgtttcaacctccatttaaacacacaactattttcctacctcagcatcttgggatttggcaatgtctaccaaagtctttgctgcaggatggacaacatcaagaagtttcagaattgtggccccatcattagaaattgttgctttgccttaaaagaaacaaacaaaaatctaaagcccctttcttaaatgctgtcttcaagtgggacctagaacccatctacactttactgggatggggcagaggggatcacggcagggctgaagggaaaggatacctatctgatctttctatacagaattagctctgtacacaaagggtctaaaatcacaagcttttgcagaccacagactcccaattttccttgaagagcaattaatacaggtcaactggatacagaaaagattttttaaataaaagtaaccacttagatattcttaccacagttgataccctcacacatcaattaatataccaagatataaacaggaattttctcatcttgataacaatggaagtgaacacaggaaactccagatggttctatttcatgtttctaggccacgtctccctatgaggcaacaggctcctgagcctaggttctctcatatagtcccacacgggctcagcagtcaggacaatataagaattggaactgcttcagagtgagtcatctttcaacgatcttaaaagcagtgggatttctgataccaacctatgctagtcccaaacaccccctcaggagcctcctttcctgcacacaggcctgaggaactctgtagacttacctctgccatctacaataagcttgtccatgccacggggacccagggtagttcttacagcctcagcaatcacctggcaggcactgatgttactcacaagctgggggatgccttgggagctatcagtcccctctttcaataggataactggtgtgggctagaaaagaaagaaattaactgcttttaataatcatctattataatgagactggcaggggaaaggggaaaatgctcccatctctcccttaacagaattatctagaggtcttcttaaaccacattcccccaactgtctaccacatccattccccaaccagcctctacctccagagacactatcaaatttagcctaccctgcaggtatgctagacaggaaaatggtttgagaagcactgacctaatctaaaagaaaaaatcatgagttctccagtacccagctgaatgaccatggccttttcaacttctgaccttactccctgtgctgaggaattgggtcacaacacaggaggaagaggcagaccctgctaagtgttcattccgcagcaaaacatccacttgtctgtgttacagctcaatcttagagaagcagatgggacactgatgcaaaatgcaagatgccaagagcttgaggtgttgtcctagagatgcctaggcagtcagctttatgtaacagtgatgttcagctgcagtgtaggaaaacaggcagagaaacaaacagcacctttgccctgttttgaaaaatgatggcaaatctaattcatacagcaatgtttccatctctcatgctggctgaataaagcttctgtgtgactaatttccaatcagataccccaaagaagttttcctctttctatattgcattggtctccagaacattccctatccccgtaagggcttcatttgcagacctgctttagaaactgagaaacagggatacttgcttgttttaaagggcccgctcagatatctttgctctagtgaccaccattattagcagagagagcaatttctcagcttagcaaaccagactactttctctccacattcaaatctgagccttcagagataagcccacgaactagatccagtcttctcaagtgtttctggctaattttgtgtgtgacacagaatgtagtaaggataaatactatttcaaaacttttattgtgttaaatttgttactaggctatgattaaaaatgtatttcttactgtggaatgcaataaaaagtttgaaagccatcacctagtccttagaggtacgtggatgtctgagcaaggaaggcacaggaaagcacagagctttcccaacctaacaatgaggagtgaggaattcctgccaaagacagagtcttgccactcatgaggctgattccttattaactggtcaattccttaaaaagttcaactcttttggccagcgcagctggagggtagtaagcaagaggaagactggaataaagctgaagaggcaggcaggaaccagatcacatacacactcgtagacacactatggtgaggagttcagatttcattcctaaaaaggaaagccctgggaagctttcagcagaggaatggcatactgtgatttacataaaaaacaaaaaccactgtagaaaaaagaggatcacttgagctcatggagttcaagaccagcctggggaacatggcaagaccctgtctctacaaaaagaaaacgaaaaatacccaataaactctacggaataagagagtgggagtaatttaatatattattcattttttaatatatatttctaagagacagggtcttgctccaccacccatgctggagtgcagtggtgagatcatagcttactataagctcaagcctcctgagtagctggaccgcaatgcatgaggtaccacacctggctaattttttaaatttgtatttaaaaaatgttgcccaggctggtctccaactcctggcctctaacaaccctcctgcctcagccttctgaagtgctaggattacaggcatgaggcaccatgccaggccctcattaaatttttttaaatgcttgtcaaataatcatacattactccttttattttttattttaaaaagaatgcttgtcatgtaaacccctacatttgggatcaggcgtcaactgaagggaaaattccttccttttgctggagtgtcccaggtctggtggcaagaaatggcttctctatactcccagcattctttctggctcttcagctggcccagtccctggcaccttctgtaagggaaagatgtgtgtcctgaaaggccctaccatctcccagtcttgctaaatcattccttatggcagccccaagtcttctctggtccacccctgccacggatggagtcttacactttaaatcaaaaactaacatgagtctcaatcacttcctatcaccttcaacaggttctttcacctcaacaggttaacttacccaatgcttgtgtatactttttctcacctcaacctgcaaagtgtacccccatctaaaatagtcactctgccatcttctaccaaaaccactttctcaccaccaggccaccaattcctcagagctccaattcttccaagaagttttctctacagtaataaacaagggcatctgaataggggaatcccataactttctcttcacttgcccttgctcgcaactttttatcaccatccagcttaagtacaagctttccaaagacaaggaccaaaataaccttaatttgaagagtgccaagatttggccacacatgaagcaatattcagcagcttttggggctgaaaatccaactgctacttgtaagtgcttgacagcactggcttcttgacttttggggagaaaagcactggcactacagtaacactacatttactgagagttcttaagcacaatgcaagaagagcttggaagcagctaaccacagattccccaggttccctatgctttgcaggccctgaagaaacagcaggctgggtagagagcatctatggggtggaaaaggtggcagagctggattgagtcaagccaagacaagcaggataggtcctcttctaacagttccccagcagcaggcactgtatgcaaagtccagtttccatcccttagttactttcaacctcgctccttttttttattcctctaataaataagaaacaaggtcgggtgcggtggctcacgcctgtaatcccagcactttgggagtccaaggtgggtgaatcacaaggtcaggtgttcgagaccagcctggtcaacacggtgaaaccccgtctctactaaaaatacaaaaattagccaggcgtggtggcgtatgcctgtaatcccagctacttgggaggctgaggcaggagaattgcttgaacctgggaatggaggttgcagtgagccaagatggtgccactgcactccagcctgggcaacagagcaagactccatctcgggaaaaaaaaaaaagaaaaagaaacaagagcagactccagtaattggccacaggtataatggaaggttttggaatttcagcttactgatcttcctcttcatcctactttaaaactttcactaagcatcattaagcttaatggcttacaaaacaagtgtgtctatgccaaggcacacagcgctcaacgccacaaaggcaaggacatacattttatgcaagctgtaccaacatcacaggactgaggtttcaggggaccttttcacctctctttcgattacagaagtattctagaatatcaggggccaatttgaagacaggaagactcttggagatagaagtttcacattccaaaaatggggaggagatatcaagagccaatacagcagggaaacgtcaatctgacagaggaggggtcagttcagggaaaatccaagtgtgatgatctagagcccactggtgaagttttatcacggcagagaatggcggttctgatccctagctgtgtgaatgtgaaccaaagctcttacggaagccctggcagcgggatggactgatttcagagatgaaaggaagcaaacaaccacctcgccgagtaagagctaacattgctgagtgcttactatctgctaggcacactgacaaactgagaaccagaaattaaataacatgctcaaagtcacacagctagtaagtggcagagctaagttacaaacctaggcattcagtgtagctccagaggccttactctcaactgctgtactatgctgcctctgcacagaagatgaagacgacttcaagaatgagcaatgctagagacataaaggggagaggaagtactgttaaatgctaatttccttctaccttgggtacaagcgggattcatagggcatttggtagaacacctaaaaggtgtctgcgtccctaacaggacagagaaaagctgcaggaagcaggaaaagagcagaagatagagtcggacaggccaaaatgaataagtgaactgccaagtgcacagaaagcagtatctcagtcagggtcaaacaccacctcggaagctggccctactcaataacaacccaggagataccatcgaggcttgggacccacggaaagtatctaaagctccgagagacagagaaaagaagtgtgggaagtagggctacaaggagcactttaggtggctccaggactcacagcaactccctcgccccaaatttcaagaaaacgagacccagagttaggtagccaactagaaaagcctttcttatgtcaccagagtccgagcctgggtcttcccacctccgatacagtgtctccatctacctttcccgttctcctggctgagaggctgcaacccccagcaaccaccagggcctggtacattcagtaggcactaaagacgcgtttatttaatgactgagcgaatgagtgaatgaattaaaagtactagggaaggcgtctgcttctctgcacgctgcggtgagggtcagcgagtgaacatagtgagtccctaggcgggcacaatatgaggtccccaatgtgcctgtgccggttccaagaagcacacgtctttacagcccgcaaatctcagagcagccccagcttccaagtctagctgccgaccgcgtaaccacggccgacctgcactcgtttcacgcaagtcccgatcatgcggggctaaaaaagaggtccccgacgtgggttcgcgggcccgaagcaccctgggacttgtagtccccaaccggccagcccagagactcctctaaagccccacgcagccctcgccaacggctccagcgccgtgctcgggccgagccaggccgcggctggctggggtcgcccctaagctggggatctgggcgaggacagaggcggcaagcaaaagagggtcctacagagcaagcccaggccgagcggcgccggccaccggccagatggcagctgatggcgacggatgcgcgagacgccactcaccatcattttggaagcttattcagcggcccgccactctcccctcttctccgagaccgggccgcccagcaacccacaatgcctcgcgcaatagaaatacccagaagcttgggccgggagaggaagagaacggaccacttccgctactctatggttcgttaccaccgactcggtgcggctagaaggacctgaggctgggcttcggggactctctagtgaggggcgttcattaaagaggggtcgccgcatttcggtcgtgcttcttagagcacggagggtctttgctcggcccgcatcacctactaacttaattccaccctcctccatccccggacgccagaccaaggaatgcaataaaggcaaaagtgtgggacgcaaagtgtgggataggctggtgccaaagcactttacgtgagcgatctcatttaatcctcacaaccctattgcgttggtcctattaaggccattttactgatgacagaaaggaggctgagaggtcaaggtgtccagtgtcacagttacatagtcagtgtcaacgggacgagcgtgggaagctgcccccaatgcccgttttctggctttgcactggccagaggctcctcgtggatggcgtgcgccaggccgcggccccagcgcctatccacggtgagcgcgcaagcgttggtggcactgggcggaagaccccctggcgcaagacgagtgccttcccgtgaaggcgtggggaggagggaagcgcagctcggaggagggaagcgcagctgggagaaggctaatcgtcgtcaatcgaggcggccttggagtggacaggaccgaga

SEQ ID NO: 11027 - DNA, 2088 bp, Homo sapiens
gtgtccttctaatgccatctctgtagaaaatgtgccctgtaaggtcagtttcctggaagctcttctgtgtgttgtcccttctccagcagtgggtcgattgtcagggagcccaggatggaagctaagtgcactggtcattggttgttctttcagtgcccttcagacagcccttgccctggtggtcttgtgcctccctgtctgtttggtgcctcttttataaattagtgatgacttcaggaaatggtcctggatttcaaatagctattcctggagacattctaattctgtggtttaaaccttaaaacaaacaaaccaaagtaattccctggatattggtggctactggtgtgaagagcatggtgcggcgcctgttacttggatgagctttgatcaaagaatggcatcaaatgataacagacattggaggtataagtgattacaaggagaatcatagatctaaataaaaatggaatggtggttaatactttaattgatcgagatgatacagcaatatttttattcatatatcagtacaatatttaacttttaaaggaagtgatattcatcttagcagaggtctcttagcaccatatttgcaacattggatgttatccattgagccttgttttggggaggaaaaaagacaccaactttcttgagtaaattgttctctgaaggtgttttacacaggaatacaaatttgcctgaactcaaaagggtcttgtttacagtactttaatcttgtttttcacttcataagccctctgtaaactgaaatacagagctacaggcaaacctcattttattgcacttagctttattgctctttgaagatactctgttttttttttttattcaaattacagatttgtggtaaccctgcctcaaacaagtctgttggtgccatgtttccaataacaggtgctcactttttgtctctgtgtcacattttagtcattatctcaatatttcagactttttcattactgttatatctgttatggtgacctgtggtcccagatctttgatgttactattgtcattgttttggggccccataaaccatgcccatataacgtggcaaaccttatcaataagttttgtgtgttccgattgctccatgaaaccagctgttccccctctctctccctcttctcgggcctccctattgcctgagacacacaatattgagattatgccagttaataaccctgcaatgcctctaaatgttcaaatgaaaggaagaatctcatgtctctcactttaaataaaattctagaaaggattaaacttggtgagaaaggcatgttgaaagccagaatacgctgaaggctagacctcttgcaccaaacagccaagttgtgaatgcaatgaaaagttcttgaaggaaattaaaagtgctacttcatagaacacatgaataataaggaaaacaccttatttctgatatagagaaagttttaatggtctggatagaagatcaaatcagccacaacgtttccttaagccgaagccagagcaaggctctaactctcttcaattctctgaaagctgagacaggtgagggagctgcagccaaaaagctggaagctagccgagggtggtttatgaggtttaagaaaagaagctatctccgtaacataaaagtactagacgaagcagcaagtgctgatgtagaagctgcagtgagttatccagaagatctagctgggataattgataaagctagctacactaaacaacacattttcactgtaaaccaaatagccatctattggaaaaagatgctgtctaggactttcttagctagagagtacgaggcatcgccttttcttaaagcttgaaaggacaagctgacccttggtaggagctaatgcagctagtgacactaaattgaagttagtgctcattttcccttctcaaaatcctacggcccttcagaattatccttaaatctactctgcctgtgctctaggaatggaactacaaaggctagataacagcacatctgctgacagcatgatttactgactattttaagcccactattaagacctactgcttagaggcaaaaaaaaaaaaaaaaag

SEQ ID NO: 11028 - DNA, 463 bp, Homo sapiens
ctgatgtttttactcaccatcttgccacccaacagcattcacttgggagcttattagaattgcagaatcctcagccccaccctgacctactacattagaatctgcattttaccaagaggtccaagtggtttacattcacgtggaagtttgcaaagcactggtctacaacggtggtccatggagcaaagcttgagtagtaaagctgtagcacagtagttctcaaacttgattgctcattagaatcatacagggagctctgtaagcttctcatctccagccttcaccgtcagagattctatttgttagagtggcacctggacatggatagctttaaaagcttccccggtgattctgatgcgcagcctaggttctcaacaccttgctactcccaggtgtgggcctcagactaacagacatcacctggacctggttagaaatgtgtctctcagataccaccctggac

SEQ ID NO: 11029 - DNA, 3943 bp, Homo sapiens
tgacaattcaaattcgaatatcacttgaaaagctcttaagaggaaataataaattctttaccttgttgaacttcaaaaaattaacatttggggctcaagagactctccaaattggctgtgtgaccttggataagtaacttaatctcaaaatctctcatatcaaaactgggggattagtttaagtgatttggaaaatcccattcagttttaaaatcctgtggttctctaatttttttctttagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaaggtagtgttctccatggtcagaggctggagtgtgatgccagacgtttttttggggtatgggatattttctgcaaatatataggagaagagtagtaaggtgtttgtgaggcagaataatggtggattccaagtactatgatcattgatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagttctggtctagggaatattattaccagagtttatcatgtggttgtgtttgaggaggagatctaccaactaatcagcagttctgagatgaatcgcatagggcctcatgcgtcccttttatgggagaaagttattttgctttccggtacaggatacagctgtgcttctcctactttgtatttgccatatacggatagatacaaaacctcatgactgatttttccctatttattttgagtggctctgtataccattttcatgtattacttcatttttctgtttttcagttatgttctctgttttcgtatatttttggaagctagttctaagtcatgttttgtaggaaataagcaatcttaaatacatgcataggggatttctttcttctgaggatccttaatttcttctatttttaagattcaaattgaatgattaatcagtaacagtttatgttttaaataaaagtctttaaaatgttaaatatcagcctttcatttctgatatttggtctttgaagaggaaacataatgcaatagtaattcataatagtggagggttctttcctcacatccttgaaagccaccagtcttattcttcagcctggctcttgagctattgctgtattaattttaaatagggtgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcaaactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagctggggatacctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttgtgatagacgtgttttatctcgaactatatgaatgcatttatttttcttgtttcaaagatgtttctgaagaactattattgttttcattttacttattacgtagatgcaagtaagaattatggcaaaaacttgagaaatgtactaataagtgaataatgtcaataaattaggagtgatcataactttattttgcagaagtaaaattataaaatttattttatgaaattgtggatttttaaatgatttttttctttttttttctgagggcttcaaccttgtattattagaaggaaattttcactgcaattccatagaagtctgtttattctcatgccatttaaaataatggtcacttaaaaatttatttgatcctgttaaaatatacaaattatctgtgttttattgggatgcacctttcctctacattaagtaaagataaagattctggccgggcgcagtggctcactcctgtaatcccagcactttgggaggccaagacgggcggatcatggggtcaggagttcgagaccagcctgaccaacatggtgaaaccgtctctactaaaaatacaaaaattagccaggcgtggtggtgcgtgcctgtaattccagctactcgggaggctgaggcaggagaatcacttgaacccgggaggtggaggttgcagtgagccaagattgcgccactgcactctagcctgggtgacagagcgaaactctcatctccaaaataaataaataaagaaagattctaaggcttggatgtcttttagctatctttagcagaattagtgggaatatttaataaatttaggcttggagtcattttgaaattatctataagaataaatcttaatatgtagtaactcactttttttttttttttttttttgacacggagttttgctcttgttgcccaggctggagtgcagtgtcaatggtttcggctcactgcaacctccacctcctgggttcaagtgattctcctgcctcagcctccctaatagctgggatttcaggtgtgcgccaccatgcccgactaattttttgtatttttagtagaggtggggtttcaccatgttggccaggctgacctcaaactcctgacctcaggcgatccaccctccttggcctcccaaagtgttgtgattacagacatgagccactggcccagcagtaactcattcttatatagggatttgttctattaattgcatgacttaatacttctgtcagtttatcaatatgatatttaagatgttgcagaatctttcaaataatttgtctcttgtatttataattttatacaacaaatggaagatgttgggttttagagtttaatttttttctcagaatagaagtttgaaaacataaatacttatggtttagcaactgagattttgtgcctactgttaaattgataaactttgttcattcatagtgtctgccttttttcctttgggaagttctaattggattaaaataagatgactgtttagaaactagtagtttcaaattttcatgtgttgtatttaactcaactattaactcaattattattttattaggtggatactttaatactgataagccacaccccaggggtgaaattcttattgggggccaaagtgtgacaatggggtactacaaaaatgaagcaaaaac

SEQ ID NO: 11030 - DNA, 1239 bp, Homo sapiens
atttgagatatttccttttgattcagacgtaacactgtgctttcaagcttaacatcctattattttcctatatatagctagtgtttatgaaagtttctctactccttatttttaaatccatataaataaagcatttattggatttatactgaggttgaattaaagaagtgtaagtttatttttagcatcgtgagaagtgtctcacttaaggtagtttttaatctggttgtgtttgcaatgaaacaatattagacagttttataattgatttctttctttttcctaccatttcatcagcaagtcccttcagctctttcaaaataaaccctgaatctgatcattgtggtctgaatcactattatattttgccagaactgctacaatagcctccaaattcttttttcctcttttcttacactcaattaatgaaaattttaccttacccaagtaaaatcagctatgcccagtgatcttttaaagacaaatcagattaacattcacctgctgaaaacccttcagtgaatttctgtctcttctagaataaaatctaaagtctttattgtggcctccaatgctctatctagtctggcccatatctatctctaactgtatctttgatcaatctctatcttaatcattgtgttccaggcacactaaccatctcgctattccttgaatagcatatttctgtctggaatggtcaactaacagcaaagaggacagtgtggttggataggaatgagagagggaggaagagggtgatgaggttacagaggtaattaggggaaagattatatggtcttataggccgtagtagtacttttagatttttctctgaaaaaatagagagccattttagggttttgaacaaaggactgatatcttccacttgccatttaaaaggatcattctggctgttgcattaagaatgactatagaggctgggagtggtggctcacacctgtaatcccagcactttgggaggccaaggcgggcagatcatttgaggccaggagttcgagaccagcctggccaatatggtaaaaccctgtttctactaaaaatacaaaaattagctgggtgtggtggcgcccacctgtaatcccagctactccagaggctaaggtgggagaattgcttgaaccagggaggtggaggttgcagtgaactgagatcatgccactgtgctctagcctgggtgacagagtgagactccatctcgggggaaaaaaaaaagaa

SEQ ID NO: 11031 - DNA, 1239 bp, Homo sapiens; identical to SEQ ID NO: 11030

SEQ ID NO: 11032 - DNA, 1674 bp, Homo sapiens
gaaggatggaaataggacccttgagccgattactccgtgatggctcagactgcatgcaaagactaggatggggctcttgctctggctcagtgttgggcatacttcccctcagaaggcccccgccaaagagcttagattttggcttgggaaaaacattacccctcttcagtaaccctgaagctctgtatttggtatttgggattcaggtaggtcagctgctcatgttgcctggcccaagtgtgtaagaacaaacagtaatgccagtcattttcccactaagatgttccagtgggaaggggggctggtatgaaaaagagaatttttttttctctgtgtaatgataactttgttcacgtagtaagaattcagttcttactattggtgtgaatagggggtaaatattatttttatttaaaagcaaaattaaatactttctgaacctcatccatgtttgcaagtagatgtctactgtggttgccttttttcctcaagagaatattttaataaacttgtaagtaattttgttacatttttctgtctgcctgtgtactatgtattaaaactcacatgggggctttcatgataaaaagataaactgttaagcagttggaaattttcagtgttcttccagtggacacctgccttggggcaggagcttctttgtagtcattattgatagaatggggtcacacacattgtgctcctgcattaagggcagctccaaggtttggcatgagactatgcatgtgtgtggacacggaggtttctcagtgagaaagagtcctaagacagtgaagtggaacgaggccttaaaaatcatctagtcagctgacttccagtttcaggttctcaggctccttttggtattttaggaagcccacattggactagagagagacttcagaccaagatatcatgtttatgttcttttagctagaattgtgttaaggcaatgactatctcctacagcttagaagttctgaagtacatggccaggagcggtggctcacacctgcaatcccagcactttgggaggccgaggcgggtggatcacccgagctcaggagtttgagaccagcctgggcaagatggtgaaaccctgtctctactaaaactgtgaaaaacacattagccgagcatggtgatgcatgcctgtaatcccagctacttgagaggctggggcacaagaatcacttgagcctgggaggcagaggttacagtgagccaagatggtgccagtggactccagcctaggcaacagagcaagactctgtctcaaaaaaaaaaaaaaaaaaagttctgaagtacagttatatatgtatttgattaatacaaaagtagagaagttaatcactccttaaaaaatgcagtttgggaggccaggcacaatggcttatgcctgtaatcccagtactttggaaggccgaggaaaggcggatcacttgagtccaggagtaggagaccagcctgagcaacatggtgaaaccccatctctacaaaaaatacaaaaattagctgggtctggtgacgtgtgcctgtggtcccagctacttgggagactgaggtaggaggttcacgtgggcccaggagattgagacttcagtgagccatgattacaccactgcacttcagcctgggcagcagagtaagaccctgtctcaaaaaaaaaaaaaa

SEQ ID NO: 11033 - DNA, 1674 bp, Homo sapiens; identical to SEQ ID NO: 11032

SEQ ID NO: 11034 - DNA, 153 bp, Homo sapiens
tataaattgaattatgtaatatgtgatctttgtgattggcttctctcagttagcataaggttttcaatgttcatacatgctatagcctgtgttagtactttgtttctttttcttgccaaataatatccattgtaggggtatgtaacattttgt

SEQ ID NO: 11035 - DNA, 153 bp, Homo sapiens
tataaattgaattatgtaatatgtgatctttgtgattggcttctctcagttagcataaggttttcaaagttcatccatgttatagcctgtgttagtactttgtttctttttcttgccaaataatatccattgtaggggtatgtaacattttgt

SEQ ID NO: 11036 - DNA, 230 bp, Homo sapiens
cgggcggatcatgaggtcaggagatcgagaccatcctggctaacacagtgaaaccccgtctctactaaaaaatacaaaaaattagctgggcgtggtggcaggcgcctgtagtcccagctactcgggaggctgaggcaggagaatagtgtgaacccaggaggcggagcttgcagtgagcagagatcgtgccactacactccagcctgggtgacagagtgagagactctgtc

SEQ ID NO: 11037 - DNA, 7029 bp, Homo sapiens
attggctacaaacccactggtataagcagcagtgtgccttctctctaactgtggacaagtcgggcatgtggcgggtgaggagccctgggctgggcactggggcacagtgaatggggcgggaggggctcacatcaaaaccaaaatggcacgcagcccaggtctggttcctccatcagtgtctctttcctcagcgcttttcttccgaggtaactttgtgaagcttgacttggacttgcctagccttggagggaccacaacagggaggcctaatagattatgaactaagccctcaaaagggctacctgcccaggaggaggaagtgggcatctccttccacagtccctgcctggcggggctgttcagggagactgagttccgagctcaggatgtctggcaggctggctgtgacttccagccaccatcaccaggacaccggtgtgggctgcatgcctcagtgggccaggagaggcacggcctctgagttgggtagaggcttcccacaaaggcctgggaacctgatcctggccgtaaatctgaaagtaccacagccctcaggagaaccaagagatagggaggcaggctggggaaatgtcatcaatgtgcacccaggcgtggtggagctggtcagccccagctggagtgggaccccatcaagatggagcctttcctggcacctccgggaggccgttttgcgtttccgcccttcatgcatctgaaacaccaagggccatgttccttctggtgcttgtccttttgagcttggtgtttcagccgtgtctgttttgtagactttgattttgtcttaaatgagaaagaaagctggtgaaggttatttcaaagttaaatagctagtctgaggggcttatcactgaagccagttgtgcttatgtggggtgggagtgtcactgcctacttgaaagtatgcacttgtgtggaacagattcagggtggcccctagcacttggggctgcgggagcttctgcacactttccctttaacggtaaagagacaagcttggagtgtttaagtggttcgttcaggagcacagtgatagcggtgacaaaggagatttgaacccacgtctgcgtggctccaaagttcactctttcatcactccctgctgcgtccttcttgaggctttagcatttttagtgtgttttgtgcccccagacctcagagttgacatttagcagtgataaactgctgtaaatccaaagaacgtttagtgtctcttgtggtgaggtcctgaaatgattgttgtattagtcaaacagaatgatcatggagcatgtatggagatgtcagatgcaatccctgtattgtaaggcaatgacatttaatgaaggataagatgaattcacagataactagaactcagggccaaacgcacacagcctgtagcaacagtgtcatgctgagatttaaaggaagaagaggtgccgtggcagaactccacgtgaccgtcccctccctgcacgcagccaggatgagaggagcagagctgagcgccacctccctgtcggtgccacggctgaggtgaggagctcttgccggatggtggggtgggggcagcagggcagattgaagtcagggattctcttatacctgagtttggaatgcctcctattcaaacaaagcaaaatatctaacagatggttggatatgagtctcagggaggaattcaatttgaaaagcacagaattaacatgtattgcttatatgaagaatctcagctagaataacaaggtcggatgggaggaatcaggactgatttgaagcacgatttactaaatcattctttccttttcctccttagcagatcataccgccagctgcttaacacgtaatagtttaataaattgtttcttcttacctctcagtgagggtaagcacatgcagggagatgggtgagtcttttaaatggatagtgtcatctctgatgatcagccttgacagggagagatcctagtaaagctgcaaattcaggcactcagttcccagccctccagttatcaagggggtgggaacgctggtgggctggaaaatgtggaacagacctgctcctcttcttttcctgccaattaccgtattcatagaaggttgtgtctgtggatcacacctgtgtgtgtgctgatggcggatgcttgtgtagcatagtgacttgggacaaaacagcatggtagatgaggctggagacgggtgggctaagtaaacaggcattgcattgcacattttgtgggcaaagaagttgaagcatcgcatgattttaacaaattacttgccagatgatttcaacacactgcaaaatttagaatcaataatgccaaattggccacatgatttatataaaaccaagtgctatggttttaatattatctttagaggagaaaccattttgatctgtgtccaaataactcttttttttttttttttttttgagacagagtctcactctgtcgcttgagctggagtgcagtggtgctatctcggctcactgtaacctccgcctcctgggttcaagcgattctcctgcctcaacctcctgagtagctgggattacaggcacccgccaccacgcccagctaattttttgtatttttagtagagacggggtttcaccatgttggccaagctggtctcgaactcctgacctcatgatttgcctgcctcagcctacaaaagtgctgggattacaggcgtgagccaccgtgcccagcccccaaataactcttgaactggaaaataactctttagctatatactggcagaatatttgaacaactctagcaagaaatgtcagtttagggatgcctcctctaaatgggggcttagaatataacattttgcaggaagtcctttctgatacatagctgactagatgaaggaccagattaacaagttcatgagttgtaaatataaaagttgtgtaccacgataaaaaagaaaaagaagtatggctgcactgttgatggctggtcaaacagcccccaagaatcctggggtgactccaatactgccaccttttctctgtgggtgcagttgcctgcggatgtgtgtgcacatctgtgcctcggtatgcacactcgagatgcccgctctcatagacggtgcagagcgtcactgcattcctatctgattaatgtgaccttagtgttgtagatacactgtgtcactttcatcctccctcctccccacaaaagatgccacgagaactcgtgaactgtgataagcaatgaacagaataactgttgaagaagcacctcatgaacctccccagagaaacgggatggaggagcacccagggtgctcttgctctcttgcctgcgctgccatttccttccagcctgggtttctagctctttggggagattccccgttttgtggaatgctttctgtgtttcctacttctggatgcctaaggagtggccagtcatactcctggctgaccactgccaggcaccgtggttttcctcactgaactcaaggagtcaccctccgtggggaggccacactcacagctccaggcctgccatttagcccttggggcttggctgtaaagttgcccaagaggattacaggagctgccagccaagtttaatttggccaccttagagaactgcagcaaggccctatcagcttcccattagacaaacaactgcatttaaattaaataaagtttgcacctctagggagtgctgacctgaaaataagaaccttctgtctgtgattatagagtacacttgcttttattaattgctgattcttagtttacaaaaaaaaaaattagaaaagcattaccatttactttccaaggggcaagagattctctacaatacccttcccccaaccctctcctcaaatttccaaatcctaaatactttgaagaaatttgtgtgactgtttaaaattgagtatttccttctaactattgtcttttgaaaagggatggttcaccaggccagtgatactctatggactgcattttgggacctctaccccagcaaggatacaggttcctggggtcttgaagatgggaaaagttgtctcagaatttacccaaatgtcgttctcaccataaaagatatacttgtagaaatgagaagcttcagtataactcaaaacactggacgcagcaataactataaacattttaatttcaaaaacaaaggtgtgtgcgatgttgtgtgcacagtaagggttgcggggcttggagaacaagcacgcgtccctgtgaagcccgcagggtgctggcggcccaccaatcgcctggactacagtgaggagcattgtgtgactccgcggtggatttccatgcaccgaatggactcagtttctaaactcacatcctaacgtatcctggcttttcacagaatactggagacatgactgcatgcatgatcacggttcttgttgtgaagctgccaccatgttacgcttaacagctgcataaatattataaagaaatagggttttcttgacacttagatttaaccttaatgcatctgcccagctgatggtatcagacgtgctgctgttcatttctttttcatggtaacagtaatgtataaagtgccgatgatgtaacatgcagttgtcttattttcatcagggcatttgtttcatggctctgttgagttgttttaagttagtgaatggcttttgagatttcagattctggaacatgtgtggtgctgtccgcggtgtgccgctctgggcagcgctgtgcctggccagggaggtgtggtgtggcttctttgttgcttttttttgtttccccatcatgtgaggtttttttgttgttgttgtttgatttttttttttttttttttttttttttcaaaaacctgagatcagttctgtgttctggaacagctctccttttccacaggaggagtccctcatggatcgcggtattggttggttgtggtgatttggggagcacgagggagagcaatgcaggtgggaggtgtgggggagccagcctccccgcccggccgcacgcccgtcactgctcgtctgacacactttgctgcgaggccgtgtcgtccaggcccatgtcctcctggcttgctctcctgcagacaaccccgagagtgtccgccacagcctcagccagacatcggtcatgaagctgcccctgctcggtggcatcagggggctcacatggctcggagaggtgcttccaaagagaagagagaaacagtgaacagctcagcaaacgttcactacccacttctaactggcatcacccccatccgtgctgtgggagctaaaggctagcgctgccatatccttgaggtcaggttctaaagtcaggtcaaatgatagagggccagcacagtggcctctgaggacaggacgggcaactgaagcagcatctgagacacaggggctctgcacgtgggcctttctggatgactgcgctggaaagagcggccctggggggaaggggcatttgtgcgcctggctttctagctgtagtcagtgtcacttcatgcacacttagcccctgtcatgaatgctgagttctagcaggcttgaccccagtagaacacagaggccattgtattctgggggcatgtggtccctacgacaattgtccattttggagagcaggaaggagaatttgacagaatcccagaactacacccatagattgtgactttaacacagattggggcatggagaagggtgatactttgtacatttttattgaggaaataaagaaaagggaggggaaatgtattcttttagttatctaactaaggtcaaactcctgaagtaaccacctctttcctcttggccaggacagcctgggggttccaggaaagcccataaatctccccttccatgaaaggtggcacccatggctgcaatcctgtggctccttgtagggcggccggcccagccttggcttcccctggcaggaaggtacttccctggagagctgtttcccatgaaggagagggagggtgacactagaaatgttcaggtgcagccccccgtctccacctgcaaataacctcacccagaaccagaggccaagccactgcaactctggtgcttgatggaaagcatgagccatggtaaggaaaacctgaacactcaaaaggagtgggggaactctccaaacctgacccatttttgccttgacaccatcgattttccctgtctaccaggtcacataggagcactgctgggtatttatttacttttttctcactgaagaagctcaagtattcatttcatctcagctggtttgggattctggacaagtaacagcttatttgggtgaagtccttagaactctccttgtctagtatttaaatacctaaaagcagtgggccatctcagcagctttaaagtcaaatcgattggctgagaagcagtgaagctctaactccagcattgacaggtgtcctttcctctccctcaggccagaatcatgtgagaagagtcctgctgtgtgaatgggtggagggcattctccgtcatgccccggtgtagggcagatggccacagttctgcagaacctctgtatccggtgactcctttcagtgcctgcctgggcattatcgtttacaggatatctgctctgtatcttgtctgctttcaagagcagctaagccacttcgtgtctaatcactgtcctttgtcactctgggagccccatagagaaggggatggggttctgcaggcagaagggtgggaacgcaaggcaggtgccacgctcaggccaggagcccgtgccaccatcccagcctgtcctggtgagccctgcccagccccttacccgagtggcctggctggcagccctggctgaggggcccatcacgatgttgacgctgctggatgactgggtgtcactggtattgcccccctccgcagcagagagtccggaaatgacgagcgcgctggaaaagctcctcttgccgaagaggaagctcagggtggagctggtggaggagcccaggctggacctgatgagcgcctcggcccgctcacggacactcaggtggccggtggtgg

SEQ ID NO: 11038 - DNA, 28215 bp, Homo sapiens
gggcggggcctgcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggtaaccctgaggggatccccacctccaagaggtcgagggggtgggggcgcgcgggctgcgggcgaccttgtgctgtcggggagggtctccggctccagggctccggcctctgaagttcccaatttaaatggcgggcttggtagtctgaagagtttgtactccttcccggaaaacgtgatttaaaagacacagggcctaaaggattagaacacacttgtgagggggtcctagactggcttcttgatgaagggcagaaaccgcaggggccagcggcagcggtaactcctactgtagtgttgacgttgtggtctgcacaaatggtatttcaagagatctgcggcaaccgcgatgtgaagtggagatgtctaatttctgttgatagtcacaggtatttccttactgtgggtctttgctacattgatcgtgcaaaaaaaaaatggtaaattttagttggaggacagcgaaactgaagttgtaacctttctttcccatctaagttcatccccccacccccatccccatctccatccccacgaattccctccacagctgaggccagaggtggagaagctttggtacctacaggagcccttctcagacactcttgcttgttcctgtcgctgtcccctcctgatgtctgtcagatccctcaaccctgtggcctgtggagttctcatctgagaagcaggatagcgttgaggtcagatgagaggtgtaggaggaggtgcttttaaaccaaggcgctacccatgtatcaagcattactaaaaaggacaggtaggctgcatcagataggctaaaaaaagatagatgggctaagagtggagaaagtgatttcttcagctcctttgcaaggcaaatctaattttgaagtttagtgtgggttcagatatcaaaggctgtaaccctggatctagaattctctttcactttattttaatgattatgtttagttgtaagtagcaaaggctacagctaatattgcagactttgggattttgtcaggcattggatgggggagttggggagcagggggtgaggaggaggagggtggtttgagaaatgcctgctatctaaagtcactcctaagtattgcaaagaactgttttctgaaagttggtttgtcaatcctttatttgaaacttggaatgcagtttgatactcagcaggctgaccccaagacaactgtgtgttttattaatggaggtgtcctgttaccgtgattgtattgatggtggttcttgtttctgctttatcaaagtcttacctacacgtagttgaaagactcaaataattctacagtgtagctctcttaaacctgtcctcaaacccacgcacctttgtcttttctccttctcttcttaatgtagttacagcgtaattttcattagtcaatgtttacagtattatggccatgtaaagacaatcacaacagagccacatagtaatctatgatttcttttccatttatttatttattttagagacaggatcttgctttgtcacccaggctggagtgcagtgaaacagttatagctcactgcattctcaaactcctgggcttaagtgatcctcccacttcaacctcctgaatagctggatctacaagcgcatgccaccacacccgggtatttttttttttttgtagagacctgtctcttgttatgttgcccaggctgatctccaactcctagcctcaagtgatcctcccatctgggcctcccaaaatactgggattataagtgtgagccaccttacccatcttttttttccctcttcttattgagacagggcctctctctgttgcccaggttggagtgcagtggcacaatcttggctcactgcaacctccaccttccaggctcaaaccatcttcccacctcagcctccctagtagctagtactacaggcatgcaccaccatgccctctaattttttttttttccttttacacataacttttttccccattaggagttattgtcaggtgtttttatttgcctagtttctttctgttttctcaatatgttcagaccatcaggtaaagtctcctctcaaagaggtcactttttgttgcatatcctcttagtgcccctggcacttagcattttttccgatttccaactgtctgtacccatgactcatcttggagggctttctctggtccctggagcccacttggcctgcaaacagagcaggccagaagagccagggaattcctgtgccctgggattagccttcaacctgtgattggtgaaagttagttgataaattccctactttctcactcctcagacaggataactgagccacttgccctgacttgtcccttaggattccccagggggttgaagctccagctgcccccagtggaacttgcttgacagtgcacctcatgctggtgtccttcccttccctttctgaatttcttccctgccagtccatcatgttgtcactgcccaggttaaactacctgcacttgaatctttatctgaggatctgcttaggggagaaccagaaccaaaataattccagagctttctgatctgtttgtgcctggtatacagctatcatctcgaggtctcctgaagcagaggtcatttcttatccagacagcattggggtagcagcttaactaatgaagaaaaaattaactgaaagaagattcctagagctgaagaagccaaaagggactttgcccaaatgcttcctatttattgctctactatgttctacacaacatacagtccccacagtataccctttgtgaacaggaatagttaccgttgctccattttatctttttcaaaatataaacggcaatttttgttaggataagagtaagacccattcagtataagaattaaaaaaaacaagaaaagtttaaggaagaaagtgacaatcacagggaatttgaacatcagaaatcaacattgtaaatctttgttctgtattcttcttgacattttttttttctgtagacacgtacttgaccattctttaaaaaaaacataatggaatggtttctgctattaacctgctttttccatatattattttcatacattgtggtctattttccatgctaataaatacatataagcagtatattttttaatggttgcatggtatttctgtgtatttatgtgctattatatacatggtgccatgagttaacattcccttacaatcaacatttaggttgttttcagtgttttgctattataaagaatgttgcagtgaatgtcctctttcacacatttgtattgttgatgtttcctgaggatgaattcctagtcatgaactacagggtgctgtggcaggcgcattgaaattgcccttcagaaaagaagtagcagcttacacattcggcaatgccattacttgcatgaaacagattctttagtgactttcctaaagcagttgttactgatggccagggctggattagaatgtcatcattttatgttctacacagttctaccagctgcatgctcactgtggcttactgtagccagaatcctgttgtgttgctgttcatgttccagaaagccaggtgccattattttaatgtgaagtgtgaagatagatacattaaataagaataatggatcatattttatgtcaaggaggcttaaaagagtgggtagtcttagaaatagcatgatttgcaactctgtagtatctcaaaatagctcacttgcagacatgctaggagttttctctctctttccattgttgggtagtcatgatgccacttacttaaatccatattgggaacaaggctcatattttaaaaagtcatggtgacaggtaaagtcccctgttgaaaggtatggaccttatgaggggtatagccttgggtaaaatacctaaccaccatgtacctcagtttctccatctgtaaaatatgcataaggatggtaattgcctcagaggatggttgtgaggacttaaccaagaaaatgcttccaaagtgtgctagaacagtgtctggctccatgacgtcagtgatgagtattactatattaggtagcacctgttggtgcttacaaaccagtgagttcatcagagtagtcagctgaccaggctggatggacaggaaggatcaaggtggggaggctgagggggcagaggtacataggttcaaactggggaaggtgtgggggataaaggtgaagaaatgcttagagaccctggagaagatgatgttggaaggagttgctaacctgataggcttgctgttatgaaaaagtttgaaagtgaccattaacagggatgctaatgatatttaagagacacattttcaggagttacaacaatgtaagtcaaaggaggaacaaagtgattttcccactgttaagtgtaggtccgtttgtaatctcttgaaagctgaaatcttaaattcccagcccctgactcaagtgtgaccagtgttacttcctgggcagaaaaatgggaactgtaaaccatttcacaggatgcaaatggcatgggagaatatcatcaggaacctctcagttgattctgggattgtgtacgtgacaaaattaacaatgtttcacaatttaaaaataaacctcaagatatcattcgtgtttttattatgcttgtttctacttgaaattaagcatttttagcacctggagcaatcaaaattaaattgaagttcatattcataaatccatttacagcccatttctctacccaccataattgctgcctcagagtccacaagtgctgtgtgtgctctagtaagggaatgtttcctaatgggcttttcttctttttttttttttttttttattttaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggtactgatatttcatttctgtggtgttctattatctaagctccccttccatctgtgctttgggagcttttcaacaagagctaaattcaccaaaagcagatactctgttgggtccttggatgcccatctgctttccctttaggttgagagtgtctccctgggcacagggttgagccaaatgttgtcatctatcctcaagaatcttaggcctttagggatttctcagagaaagaaaacagaatgaaaccatcacatgaaaaaagtataagaaagtgatattttacttaaaacttgttcaccaagtcataaactcctctcactttataattcttagtcctgtttctggtgccacttttcaaagactgttgatgcagtagctgcttggaccttaagagatagccctgccataactgcaaggcccattgttggaggtgtggacactttgaacagggtagctctgttcaaagcagagaaaacctgatcagctttacagaccaccgcattttgtgttggtcatttttaaggatgatttagcatatgtggaatgccagaggctcagtggagcagctaaaaaccagaaatcaatacaggagtttttcaacaaagaacataatgtcttttccttcaggttagagcctccacctggaaaacgtgaatgccgagttgggcagtatgtggtcgacctgacttcttttgagcagttggcactacccgtcttgaggaatgtgagtacgtgatttctgctttttgaacccatctgctcttagtgtattgtgggaattgctagccatggaaacagaatgccttttgctcttaaaggccccagttttgcattttacaattgaaaagattgagtcttaataaggataaacaacataatttgctatcactctgagctacagataaattcctataaattcagtacatataaatattttattttggaaaggctcttgatgcccaggtaccaacattcccaaagataagtctttcctctgtcttctcacagtcatgtcttaacctggtttcacagcacaacaaacatttaggaagagaaaatgtcattatatgaacataatagccagttgttattgaatgcctaccaagtactgtaagcagttaacgtattatattattatattaccttttttaaaaaagaaaaaaactttattgacatcttacggcttctttctttctactttgaatgccttttatttcatttgcttgcctaattaccctggctagaacctccagtccaacattgaataaaagtggtgagagtagacatccttatcttattcctaatcttagaaagaaagtatttagtctttcaccattatgtatgatgttaactgtgtcttatttgtatagagtttactcaggcgtattttgttgaggatttctgcatctttattcacaaaagatatggtctgtagctttcttttcttgggatattgttgtttagttttggtatcaggttaatactggtctaatagagttaggaagtgtttccttcttttctaatttttggaagagtttgtgaatgattcgtattaatttttctttgaataattgatagaattcactagagaagccatgtgggctaggtttttcttggtgagaagcttttaaattaccaattaaatctctccttataggtctgttgattttgtatttttttgttgaatcagttgtggtaatttgtaccttttagtaatttgtccatttcatctgaagtatctaagttattggcatatagttgttcatagattcacccataatgctttttattttgtaagattggtgatattgtcacttctttctttattttagttatttaaatcttctcttttttccttggtcagtctaaaagtttgtcaatttagatgatcttttcaaagaaccagcttttgttttattgattatgtagttttatgtatctatttatcagatatttatcaagtactgcatatacagtcatgaacaaaacagacatgtttctactctttcaaaactgttagtctagtgggaaaggtagacactaagtaaatttatacttgtcatggtcattaatgctgtgaaagaaaagaacagggtgctatgaaagggagggacaggaagaactgactttagaccaagggaccaggaaagagttctgggaagatgacatttaaacagaaaggaacaggtgagagggcattggggagagagagttagtattggggtatttgtatgtgtcagggtggggaggtctggggagaatattctaaatggcaggaacagatacattcagacctcagagccctggagcaggagcaggtgaagaaggtaagtttggtgaggtggggggccatgagatgcagggctctgtggaccatgttaaggaatgtgagtgtcatttaatctattacagacttactactttgatttgtgaaaattaaatgatacagacctgtctcaaaaaccaactataaactatccagagttttctatggcaccaagaataaagtccaaagtccttccagtggcctagaaggccctgtagccctgtgatatctggccttactaacctctgacctcatcttgccattcttcagccacactggttcaatcagacttcccacatatgccaggctgaggcccttggcacttgccattttttttggtgagcacgctgtcttcatagatctttgcctctctgctccttgacattcagagctcagctgaagtatgtagtggtggttgcccaaaggctgctgaagattttagctatagcctctgaggatatcctctaatctcagagggctggtggtatcttatggtctgtttcagcagggggttgtgcttcttggaacccaccaagttctccttttcttcctacgctgtgtttcctcctcccacctccttcttccccaattccttcctcttggaacttaccctcagttcctgtgctggggactctcgtggccactgtgttttgcgggagcagagaacatggtacttttctttttagctgttttcccgtcacatacattcctctctacttaaatgttcaaaagtcaagtgaaatacttcaaatgaaattccaagtgaagattctggttttaggaactgactgggtcaatacaaagaattttttacttaccctgctcagacagagtagaccaaatcctgggaggagagtttgcacaggtgtttagtgtctagatgcaagattatataagagatcatatgctgaccagatcagagcataaatctgttttttaattaaaaaataaagaaatacagacttctcccaacattttgtattctgattgccaaatgcagacatgtacattccatgtagaaaaagttcctggcaggggatttgatatgatttggctctgtgtccccacccaaatctcatcttgaattgtaatccccatgtgtggagggagagacctgaagggaggtgattggatcatgggggtggtttcccccatgctgttctcccgatagtgagggagttctcatgagatccagtggtttcaaaagtggcagtttcccctgcactctctctctcccgccgccacgtgaagaatatccttgcttcccttctgccttccaccatgattgtaagtttcctgaggcctccccaacaatgcggaactgtgagtcaattacacctcttttgtttataaattatccagtctcaggtagttatagcagtgtgaaaatggactaatataggattctcacccagtcagggtcatggatttcttttctggagcagaaatttttctcccatcatacatattttatgggaatgaagaaaggagaaggaactagtgttttgtctttatactaaagaaaaaaatgaaaagaatattaattaaaataattaggcaacaaaactggggagtataaacacaccatttttgatactggcaatgaaaacaaccaagtaaactggaagtgttagaaaccctttataaagggacacagtattagttcatagtgctgggatctatgaaaacacaaattccgataataagaaatatccattgtgtgtaagaaatttcaatatgtatgagtgaaagatagtttgagggttgtatgtatgtgtgtgtgtgtgttttaatactacaaaaaaataagaaaaaagtacttctctaattaggccaagcagggctatgcctatttgcaggtggggaagtaaggatgtggctgggactggttgcagcggctcatgtctgtaaccccagctctttgggagtctgaggtgagtggataacttcaggccaggagtttgagaccaggctggccaatatggtgaaacccagtatctactaaaaacaaaaacaaaaatcagctgggtatggtggcacatgcccgtgtcccaggtactcaggaggctgaagcaggagaatcgcttgaacccaggaagcagaggtggcagtgagctaagatggcaccattgcattccagcctgggtgacagagcaagactccatctcaaaaaaaaaaaaaaaaaaaaaaaaagtggccgggagctgaagagcagctccaggagaggctcaggagggccaggcacaacccaggttcaccttgcaaaactgctctggttatgtttcttgtttctttttcttttccttttttttttttgagacagagtcttgctctgtcagccaggctagagtgcagtggcgccatctcagctcactgcaacttccacctccagggttcaagcgattcttgtgcctcagcctcccgagtagctgggattacaggtgcctgccaccgcacctggctaatttttgtatttttagtagagacggggtttcaccatcatggtcaggctggtctcgaactcctgacctcgtgatccacccaccttggcctcccaaagtgctgggattacaggcgtgaaccactgtgcctagcctggttacgtttctttaggcaggaatggagcctgagcatcgtggtcgctcgtgagaaataaagaaaaatagagtgtgtgtggtaagtgttctagactcaggaaggtttttggaaagcctctagtagggttgactgttaatttttttcattccatgagttaactctttccttatttgtcaacatttgttattttcctgagtattcaagttctagatattcatggttaaaaaaattataaaaaatgtaaaataaaaataaaaaacacaatgtgaataactcataatcttatcactaagttagccaatgttagcttattttgtttctgccccttttgtatacctggtttatttattcagtcattcaggatcagggaaaatgttatgtatagtttcataggcttggtgtgtttcccttaatatgattgagggacatgggaatggtctcacaacatgctaatcttcaaagctgggagattttagtggtttcatcctatttcatggtatgagttttcatctttgatttaactattactccctcagtgttgagcattcaggttccgtatcaccattgtaagtaaccttgcaacaaagcaccctttatacatgaatctttttctctagccatgattgtttccctggggagggtctaaaaggtgaagtctgagatggtggggtgtgaaccttcaaggtcttgatggtgctgcgttgactttgtgtcccactgccagggtgtgagtgtgcttgtcttgctgcgctgtgccagccctgagcactctacttattttcaacacactgctttgttttgatttgcatttttcagttactaatggggttaaatgtttttcagttgttcattaagttttccttaattttagttgttcatccattgctcttcccatttattttctttgggcttaaatagatgttttataaagcagatagcctttttatattattgattctgtttttctcagtttagcacttcactttggtgattattttcccttcaaggtagagaaaagtctgtccctattccaaatttatataaaattttacctatatatttcttcttctgcatgctttttttaaacatttatgttttcaattcatttggattatgttgagtgtaatatgctatgagattctcagctgattttcttccagatatttagccagtttactaaaactgtttgttaaataacccatttctaattagttttttatgcttaattaattatattaaaactatgtgtgcttgtatgtatagtgtttcagagttatctgttctcttccattgatctgtttgatccttgcatcagtaccatagtattttaattaccatggtaatcgtttttatttttcttcttcaaaaaatggccttgttcagaaactgtagtaatggtggcacttgtaatagtaaactattattgagtgcgaactacgtgccaggcatgaactcacttaatcctcagaacactatcactctattcctattttacagatgaggaaactgaggcatagaatggaaagttacttgcccagggacacactaattgtgtaagtggtagagctggagtgaactatagaatcaagactttactatccattaaaaaaaatgtcttatatggagtgattgggactatagttattttgacataaagggtgtcttaatttttcagataatcttaattctccacagcccaaaacatgtttctctttctccatctgtttctttaaaatttttattggtgaggttattcatagggctctcctattttctggtgctactggaattaggattgttttttctgttttctaatgatcaaggctgataagataatgctggcctttttcataatggcctttttgatagctaccctcaatgctttattaaaatttgatgcaatgtaagatgtaacattttattgattttcaacatatctcctactcacacaaaatggagacaatagattataatgttttaaagaacaaaggacatctactcaaagccctgttttccaggtgaacagtgtcattttttacaaagatctgtgaaaggaagagtaagctaaaatcagaacacccagggaaaaccaacatagtttgaaccttgtattttcctgttttgattaaaataagtctttaaagtatatttgtttttgagagcaggatctacttttggttctgaaataggctctgctttggaaaatcttagaaacttcctttgaaggtgagaggactcctgtctagggaaaagtattttgtttttgtttttttagactcgacctggaagtgttccttaggtcactctcaggccacttggctttagaaagaatgtagaaaaaccaagttctagtcaggatccattcttgaaagattgacaagctcctcagcattgctagaatttctgtcattgctgttagcaaatgtggcatttgattctttgttctctctcagcttctgtttctctacctcatgtattacaagtatgtaatgcaggatcagccagggaaattaaaagctatctggcgcaaacagaaaatcagtttttaaactgtcagtaaggacattcctgcagtgaatcagcataagaaaatgaggtgaaaattcagcatgaggttgactctgcagttcattttgcaagatttgtcatggcaaatcttcataatttctattgagcagagactgagactttattatttctgattgttggcgagattctgtggatttagatgctaagcaggcttttgccctgggttatgacaccttcatgtctttcttcttgcagtccactctcaagaaacacagaaaagttgcatgctccttaagtcacacgtcccttaagctggactggggttgagtttgtataaactgttgccgtttttctttttccctctcactttgtcccatttccagcatttccttctgtctcgcctcccgtgcgtatcagtctaaaaccacactccattaggaggaagttcatacggggtgagttggttgttttcttgagtctggtactgagaaagtacatacgtgtgtgttttctttttttgacaatttttttaacttcatttggataaaattttactcttagagaaagttataagtgtaagaatagtgcaagaacacctgtatactctcattatccagagtcacctatgtttatcatttgccttgtttgcttattctctctctctgtgtgtgtgtgtgtgtgtgtgtgtgtgtgtgtttgtgtgtgtgtataaatatataagctggaagggggtgactatttgagaatacgttgcaatcatcaaggtactttactcctaaatgttcagtatatttttcctaaaaataaggatatgcttttacataatcaatacagttatcaacctctgtaaatcttacattgaaaaaatactttaatctatcgttagtgttctagtttcatcagttgacaatattctttgtaacatttcttttcctccagatgttacacttagttgtcacatctccatagcctccgttaatttggaacatttccacagtcattctttgtcttccaggacattgacatttgtaaagaatatagttccaatttaaaagaacgttcatcttttggagtttttctgatgtttcctcatgaccaaataaagctggaatactccataagtcataagtgatgatgcatccttctcgagtatctcatctggaggtgtgtgatgtttagtgatattaattttgattacctgatcaaggacttgtcctatttctccactgtatagttactatttttttctttgacactaatgagcagtgagtggggagatagtgtgagaccatgcacatcctcctcatcagatttcccctagccaattctaattttatctaaactttattagatcatcttaagataaaaataattttctcttgaggccttaattggcaagcagatttaactactctcttttgaaattgtttctctagcaaggtgagcagtaattaacaaacataaaattactatacattgaagctgcactaaaaaaaatgccataatggttaagcttttttccactctaagctgtgcttctctctatttgtatccggttacctccccattagaaaagccatcaccattttattataggaaaaacaatcagttctttctcctcaggcagtttctaatgaaaacggtatcaggtatcagagatactaaacatttaccaaaagcttaaatattgatgaaaatttttactaagcaagtgaaattttttttaatttggtttttgtaaacactggcaggaaggtggacatatcaggatacctggtcataactcttccaccgtcttctcggggtgtgctcctggtagaggagagaagtccttttactttatcatatctgcctactgcagtgggccattcgctatccatacttgatgaaataattttggtgatattattctcagacccaaaatatgagttattttcgagtaatttagagcaatatgattactccaaataaattgaggttttgtgcctatgcctccatagatccctaaacaccagagtgctattcgttcttattggagaggaaagcagtttcttcgtggttaggtcagtttcctagatgctattctttatttcagaatcaaagtgtggaggcgtattgcacacagggtgtggaagagagctttgaagtcaggtgatctctggtttgactccagctctgtcactgtgctctcagtgagttttgagtaaatcccttaatgcctaatttcctttcctcatctgtgaaacagatgctgttacctgctatgtgaagttgctgggaggactgaatgtaatgcttgtaaagtgccttggcccctggctcctaggaggtgctcagcagagcaatagcagtgattattttcttgagaagttaattgaggtggtggatggcagtaccttgagaggagcctcccttcacaatttggtttgtgtttgccagggagctggggtccggagtgggatagtaatctgtcatggagtcccaggagcccaaatgtgcaggccagtcccaagtgctcagagcatgaggaggacgaggagtactgggctctccgtctcactggactgactgtcagccaggaggtgttgtttcagtcccaagatagcttggaaaaccccatggctaccattcaagcgctcttcagtcgggtgaccatgtgggtgagcccctgtgagtcccgagaggccatttaggacatccaggaagagcctcagagctagtctgtctgtgtgccggggtgaggatctctggcatgtccgggggagcagcttctgcccggagtattcttgactggggaagggccgggttaccaggcgccatcgggcagtctagacaccttgtcctggctatgccctggagactcacagtccatatgccaccagacagcaaagggattatgagacttgaaggcttggaataaacacacataaaatatgaccggagccctgcatttttagctaataacttcagtgggtgaggaattgtgggctggctcagagatggctgctgttagcaccatttgcctttctgcttccctagaacttgctgctgtttggcgaagggctgcagttttgctgcctaacttctgagagacactccttattcactttcatgactttccatacttgctgtcccaggtgggtaagctcaggagctagtctgtgtgtctgatattaaaataaaacaatccaaacagtcctcctaaaattaacattaataccactggaaacatttattatgcaaataattcagaataaggcaaagaccacttggattagcttgctctcagtttgatattttggttaaatgaaattattttatatttatatgttctttgtatttttaaaagtacatataaaaataaaggacccaaaaaaatcacactattttcaggtctctgatataactggtacgaagatatttgttgttctaatctttctggaaagcaaactaggtgagtgtaaccaaagttataaaattattcgtagcttctcttatccctggctggtcaattttaggactctatctaaggaaatatcttctctcccggaacagggaaactaaaagtgcgcttcatggctgaacatttataatcagctgaagtggaagcctgtgaggggtgtggccaggaaggctagtgtgttacataggactgaggtgtggcactaggaagcaatgctgcctgggttgttctctgaggagaggctgtgaggggaggaaagggtgctccccagttggtgtgtacaccccagatggtgtgtacatcgtgattctgaccacgtggctgagagccacctacagtttttacacactccttactccagcagctgtaggtggagtttctctgggagctcattaggactctcctcacactgggggttggggaggggttcctgaccatcttcaaacctgggcccctattgttctaagtctgtgtctctatcaatttagaacaatgtaaagggggtgaatgtttgtttacttacttatttctttgtttccctctaaagttgcttgaatttatatagaaataaaaccatgttacacgttatagtggttctttttttaagaccttgagtgtatgatcttgtactatttagaaaagcaggctgagtgtctacatgcttcagagtggctcagcagctgacatctttctctcaactgaatatgaataacttgcatttttaattaaaaatcacagatttatttttgagattcctgaagttcttggattataaaattccccaattctggacagattgaggattttatgtaagctaaggttttaaaatgaggatttccaattggtagaaagtaatgtatacatgtgtgtccaaattcttttgtgctgaaacttaaataaatgttgatgagctttcactggtgaatgttctagaggattgcaggaaggctggttgttgaagagccacacactttctacctgtacgtgtgtatttacacatggccacgtgcattttactaccctcatgtatatagtcaaataaatacatgtgcatgtgtacacacattctttcatatcacttcttgtctgatttggcaccttccaaaactcattttgaggtgccagaataagttttattttggcttttagatgacagcctccagaggaatggcatccacaattactcttcgtctctgggggcagcaaaatgtccacagcacttgggaacagtcgggtcagttggagtggcatgcccccaggaagacagaaaccttcttgtacagttgtctgtttttattatcatagacaggtggttgatagctgttttatttctcccaaatatggctttcgttttggaggaaaaacttggaataagtagtgacttacttcatagatgctctgcccttctccccgaccccaccagtggagggtgacattgctccttcagctccccacttctcagctctgggacatcggtgagttccccaggaaggatgcggacgaggacaaccatgtacctgccctaagtggggagaccaggcgtgtgtacagataaacttaatagagaggcaaaaatgaagcatgtcagaaacacagaagtgcggagattgttcagacctctcttgggtgattacagtggactccttattgatcttttagctaataaaatgaatggaaaaatatttcataagtgtacaatatgcagtaggaaaatagagtactgtttacttaaaagtctgaaaaacactgctgtactgcttccgtgcaatcacaactggggtttagacacccactatcttatcttgtctattccaaaaggagtctaacatttgtttctgactccacagccagcagtctttctagcacaacttgtgatcctccctggattagactctttcggctgtgggagaagattcccacctctgtgtgtgccttcgaaggcctttaggatctgggcccgcagccccgtctgtcactggctgcccctggttgccactgatccctaccaccagccacactgtaccatatgctgctttggcttttggaatttgaacaaaatctagcttaactcagacatgccctctaggactatattgctgtcatcatttaaggaatcagaactgtagtgaagaatactttgtaaatcagctttacatacagttttcaaaataatcatgtatacaaacatatataaggtgtatttgtcattcaccattcattgaagtgtttattacatgttctgttttgtccctcccagggaagaatcaaccaaagtcctgtcagccttccccaggaaggctttctatagaggacatgtgtgttagttatatgttgctatggaacaagttatctcaaaatttagcagcttaaaacaacaaacacattattgtacacagtatctgaggatcaggaatccaggtacagcttagctggggttctgaggttgcagtcaagctgttggctggggctgtggtcatctgaggcttgcctgggagggccctgcctctaagcttgctcatgtggttgctggcaggttcatttcctcttggctgttggcatgaggcctcagtgcctcaccacgtggacctcaccgtcagctgcctgagtatcctcacagcatagcacttctcttcccccagagtgagtgattcgagagaggggatccaagacagagatcaagctttatatttatatacaaccagaaaataagtggcacccaaatacctcaggcttaaaaaaagtgagacagcaagcatgggagcctttgttgataataatggcctcttttttccattttgagccatatgagattccctacgtgctgggggggagataactgctctaggtagatgtttgtgtatttcatgatctggtccataagcgttgttggaaaaaagtgaaaattaaaaggaaacaagtcttggctaaaggggaaaaaaaagtaagtacaattgcatcctttagatctcagattctctttctcatgactttattccaatttatgtccgttacttccttgaacatcccactggtgacaggcatagctgccagcttccaagagtcctaatgattcccagctcctgggactcacccttgtgcagtcccctcccacacagtaccagcggtggtctgtgggatgctgtcactttttgaaatccagtaaaaaggtttctgtcttttttacctcattggtgagtgattggggagtgggacccatgggccctttgattaatgtgactctgatgtcccagtgaaagtctttgtcattctcaggccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtgagtacagccagtcctccataatcagtggaaatggagcagatgatctaaaatagcagatggctctaaaatatctctttggttttgagttaacattttttcccttccatgctgaaatgtaggtgagtctaattttctagaaatgtatagaacttaaattatacctctacttgatgaaaaaacaaactcgcttatgggggggcctcctgacggtcccagttgttctggctgcttttttcttccatctcctcaccagacactaggacctctctggcatcagaattgcctgagctaaggtgcttgttctaagcttatctcttctcagattgaaaggcgccaggttgggatacagaggcaaatattttttgttttgttttaaagatttcccttttaaagctgacccacttgtgcttgtggggagaagaggctgtggatgtgttgggagacacagcttccaggtgctgaagagcagcaccgtccagttgaacttcccagtagtgagggaaatgtgctctctgcattgctcagaacagtagcgactagccacatctcgctatttatgtttaataaatttaatcatatttaaattgaattatttatttaatcacataaataatcaaatttaaattgaattaaacatttggattctcagtcacactggccacatctgaggtgctctgtggtctcgtgtggctgctacattcactagtgcatctgtaggatgtgccactcagtgtgaggcttgcagaatggcagcatgggcatcacctgggagtgggccttgccctggtccaaggagtcaaactctgggggatggccccatgatctgttctggcaagttctcatgtggtttttaggtcccccgcactttgagaagcactgctgtagaccacatgtgagagatgaggggctagggcttgttgaccagtggcagcgtctgagccagtcggaagggactcatggcattgctggcactttgtctaaattcttgcctttctttccctgttgtccctctgttttcctctcagtcagatattgcttctccccaacccctacccttagtttctttgagtcagtggtagctgtgctcttggctgagctctgctcacacacctcactccccacccccagtttaaaagctccctggccctgcaagtgccaagtgaacaagtcaggcaggcagggccactcctatcagggggagtggagagtgagtacccgtgagcaccttcctcatgatcattttaatcactgagtgaaatgtcaccttggcccactggcagtatccacatgttgccaccaaagaatcctggagtatccacatgttgccaccaagaatcctggagtgtggtggtaaacagccattagggttagaccagccagacttggaaaaatgtatgcgcttctttattgatttatttattccttcatttggtcaatagtgattgagcacctactgtatgctaggtgtcattctaagtcttgggatactgtggtgaacgagactgaccaaggcgctgctttcatggagcttacattctaatggaggagctgaataccaaaaatgtgaacagataagttaagcaatttcagatactgataaaggcaaaaataaagaaaccaggcaatgtggtagttgggggcaggagtagcaagggcgatcagggaaggtctcttcaaggaggtgacatttgagagccctgaaaagtctgtggggttcttcagagtttcatgtcgtcttctcttattttacatttttggttgtgattatagagtttccatggaaatcaaggcaatgaatagtgaaagatcatgaaagaaaattagttttgaggtcagatagcttctaggctggaagaccgggaaattgctagtgttagactccagggattggctagttccacaaactaatctaatctaacagtcctaaggaaggattgaaaggagctgactgtgatgcccagaaacagactttgtgtcttaggatcataccacatttcttccgctctctgagactcaaaattattctccaggcaagataatcattgcttctaatgatctgtaaataaaacaattagctttgagttaattaagtaagagataggggctgacataccctgtttttttttgttgttgttgctttggggtttgtgtggtccttctgtttcagttttattttattttttatttaacttatttttttgagggggagggacagagtcttgctctgttgcccagagtaatctgtgctgggattacaggtgtgagccactgtgcctggccttttccagttttataaatcaagaacctcattttctttttttctgagacaaggttagtctctgtggcccatgctggagtgcagtggcatgctcttggctcactgcatcctctgcctcctaggctgaagccatcctccacctcagcctcccaaaaagctgggactacaggcatgtgccaccacacctgactcatttgtgcattttttgtagagatggggtttcaccatgttgcccggggttgatctcgaattgaagagctgaaacaatctgcctgcctcagcctctcaaagtgttggaattataggcatgagccactgtgcctggccaagaacctcattttctttatctgcaaacttaggtgttggattagatatatttttgggttctttccattgctcacatgcaataaagtatccgaatccatttttgagagtgcccttcacattcagtacttagtccatcgtttaggcacctgtgaggcatgatctctgccctcaagaaaaacagaccatggggcaatcaaaatctaggggcagggaagggagagatctatgtgagcagtggtagtggagaggtgtccaaaggaaggggttcttgagttggctcttgaaggaggaaatgggaaaaagaagggagaacattccaggtaagaaaatgagctatgaaaaggggtcagagtcagcgtccccttgctaccagctgaacatgcgtagtgtgaagatgagactgagcccgtgatatgggggaaatgtaccacacgaattagtaatattatctagacttattcttcacaatgttgggtgaacagagtactttccaatgaatatgcatagtgtgaagatgagactgagctcatgatatgggggaaatataccacacaaattagtaatattatcttgacttattcttcataacgttgggtgaacagagtactttccaaaaacacccgagaactcttccagttttagacaagatagagtagacacacttgtgtttatttttcctgctaaggatgttatttataatacaagcataagaagacctgaaaagtgaagagaaaaagacagactggctaggaacctaaggacctaaggaacaacacaacagacacaactgaaaatcatttgtcatgccaagaatcaggaatacctaaacctgagtgaggaaaggccatcagcagatctcaacagcaaggtgactcagatagtggaattatagggcaaggatttgaaaacagctatcataaaaatgcttcataaaattacagatacacatgaaacaaatgaaaaatagtctcagcaagaactggaaagtttcagcaaaaacctagaagatagaagaatcaaatgaaaattttagaactatacaatagccaataaaaaagtcactgaatgggctcatcagcagaatagagatgacaggagaaagaatcagtgaacttgaaggtagaacaatagaaattacctgacaaagagcagacttaaaagaaaaagtaatgaacaaaatgaacagagtttctgggacctgtgggactataacaaaagatgtgacattcacatcattgtagtaacaggagatgagtgtggggttgaaaaagtgtttgaagaagtaatggctgcatttttgtcatatttggcaaaagacataaacctacattttcagtgaaccccaagaggataaactcaaattcatgccaagacataccatagtcaaacttatgaaaattaaagtcttgaaagcagtgaaaggaaagcagcaccttacctatagggtaaaaacaatatgagtgacagcagatttctcaggagaaaccatgaaggccagaaggaggtggtacattttccaagtgttgaaacaactgtcgactcataattctataagacattcacagatgaaggaaaactaagagaatttgtcataatagaactgctctaaaagaatggccaaaggaagttctcttatcagaaaggaaatggtaaaaggagacctggaacatcaggaaggaagaaagaacaatgggaagagtaaaactctgagtgagtgtagtgggcttttcttcctctgttgacttttgaagaattatgtttgacagttgaggcaaaacgataacattctctgatgtgttaaaaaaaatagctgaaaaaagaaaagaaagaacagtacctgagaaggaaaataaaatctcactgatacaatctttggcacctcctattacctagtaaagcatcagtagaagaaattggtgatggagtatttttattcatctatttggtaaatattgagcacgcactgtatgtcaggtactgttctatccactggagttttagcagtgaacaatagagagggagaaccagacatcattttatcagtaacccagtcctgccataactcactccctcccactataatggcattaatccattcatgagggctgcccccatgacctaatcacctcttaaaggtcccacctctatttgcatgggggttaagtttccaacacatgaaatgtgggggacacagtcaaatcatagcaggtgacttatgggttcttcaataatttgtttttcagaactctaagaggttattaccattgtatcccattgagttttatcccattgtatcccaatgagtgtgtcattgattgattttgctgccttctagttaatgtcataacattgaaaatgttatcaacaactttagttctttttcaagctggcagcttcatagtatgactaagcctcttgtttagaccttggggtgcacatgttcttggcagcagtgagtggatattatctgatcttccaggctgcttgcatgctacctcactgccttctaacttgtttaatatgatcagtgtctgtatgccctgctcagtctccccttcccgcttcttgattgtttaaataagaagttgaggtggtgatatcacaaatttgtcttctcatctggttggcctaggtacggcgagagacagtacttgactcatctgctgggcacagatgcagtaccagatactgggtcctgcttatgttctgactttaacaaccccagacctgaaaacatggatggagcaggcaggggaagaaatgcctcttagtatacaactatgtgcaagaaagcaaaacaaaaccacatgcatttccttgaaactgtgggaagggcccccaacattcctaataagcaagggattggatctggaggtcacaggatgaatgagatgtggcctctgaccccatggtgctcacagtcttatcttcactgtgcccaggataaattcttaccaagggcccccctacagccactgggcaggtgcaagggttcaggttcactcagcttcctttctttctcttaaggctccagtgcagaaaaaaagaatggttgggattactttcttctttctgcagtcttctttatttccttttcctgctcccagctcccagttccctcttctaattagcttctcaggaaaggctttctgcaaccaaaattctggctgttgaataaaaagtagactagaatttcacataaggcaaagactcctgaggttggcagatgctgtgatccttgttcttgcatttgggagtgtgcttttctcaacagggaatatcataagtgaatactgcagagagttgcacatcaacattttattgcataattttcagaaataatcttagggaaatcaaagggagtatcaaaatattaatattggagtgtttgcattctgctcaattttcaaattaatttttaatttgtaattgatataatgtacatatttatggggtacagtgtgatgtttcagtgcatgtatacattgtataatgatcaaatcagggtaatttccatatctgtcactttaaattatcatttttgtggtgatgacattcaaaatcttctcttctagctatcttgaaatatacactaccttgttatttactctgtagtcaccgtactgtgtcatagaagaccagagcaaattctccagctgtgtatcacagtccactctcacagagcctggctggaggcagaagctactgcaatcactgctgaactcagagtggaagaaaagggcccctgtggtgcccacctctgtgtcgcctcctttctacctcaggtggattccttgaatgcaaacaacaggaatggactttggctaacttaagtgaaaacagcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccaggaccggtagaaatgggatcacgggactgacgcagccaggaccagtagaaatgggatcacgggattgacgcagccaggaccagtagaaatgggatcagcttctggcacttgctgcgtgagctcactcctcttggggtgcagatctcagtcactcctcttggggtacagatctcagagaagttgccagggcctggcttgcccacttgttggctgggggcaagtttcctagaccgtacagtctcctaaagacaaccagagcactcttccaagaagggtgagcaggtgccaggaaccagaattgacgaggtccgctctgcatctcctcttcagacatgtattggcacctattgtatgccaggccccctcttcagatacaaccaccctgaacctcagaaggcttccacatgcactccctgctcttaccgggaaccttggctcagccccttttccatggttcacctgtcgaaattacatccaggcttaagcacccctggaagcctttcctgcccctgaccccacacatgcccctgttcctgcctgccccccagactccttcattgtccttgttcatgcctgtcctgtcctggtctgcgagctccatgaggtcagggtccttacctgtggtgcttctctatgcgcatctctgtgcctggctcctgtttgcccttccaccccatcagcgtgtgttgagtggatggatattatatgggccaagtaggaaggcactgtgatgggagcagagatggcccttcctttaccctggggcactcgggatggtgtggtagtgaaagaaaaataaacagatcatcgggtaaagctctggtgaactctttgttgcttttgtttgattttgtaatggtgtaagtgttggagaacacactgcagtcaggaggcctgagtaacagtctgtacggaggcaccctcacgtctctggctctcccacttctccatgtttcaaatgagcacttgatgtttgtggagaggcgggtagatgactgagcatcccagaatcctgggcgcttcactgctgctctgctgggtgccctcctgggccccgctggctcccaggctctcctcctcgcttcactccaacagttgagttccttccattcaggacaggtcgtgctcaggggtcctgtgtgcccatcatccgtcccggtgtgcctcgtcggactcacttcacagctctccccatggttggctgaaatctgtctgggctccaaacccactttgactttttgagctgtcacttggcagaaactgatgctgggactcggtgattcctgtcctgtttctgagtgctcctgaagagctgggcctcctgcctgggtaacaaaacatacctcaccctctcccagccttccaggcgtttcttttagagagttacctagcacaagattgaagaagaggaaaggagctctgaagcctgttctctcacttcttcccacaggtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacagga

SEQ ID NO: 11039 - DNA, 951 bp, Homo sapiens
gtggaaatgaaataaatttgtacatgtaaagcacaagaacatggaaggtgcttactaaatgttacttatctttactttctctgccttggtcctctcatacccactcctgattttaggtgattgggtggaaatggccattgaacatcatactctactaacaaagaccatttgagagttagattaatctctttcccgtttcaacaacaggaagaagccccacaaatcaagtatttcccttgttctataccttgtcattttgttgctactcccaccagccaaagagggaggaaagtttcttggtataattaaaatgttataggctgggtcgggggggctcatgcctgtcatcccagcactttgggaggctaagacgggaggatcgcttgaggctaggagttcaagaccaggctgggcaacatagtgagacccatctctacaaaaaaaaaaagatagccaggcatgatggcatctatctgtagtcccagctacttgggaggctgaggcaggaggatcacttgagcccgagggtttcaggctgcaggaagctatgatcatgccactacactccagcctgggcaatagagcaagactgtctctctaaaaaccaaaaattgttatagaatatagagttgaataacttttctggaatgagaaagctctcattttagatatccattcattcattcattcaatagtgtgctggatgccaggaatttaatggtgaggaaaatagacatgatctctgccttctgaggctcaagatcctccctctatttttaaaaatcaggtttattgaagtataattgatgtacagtaaaatttactctttttagtggaaacttctgtgggttttggcaaatgtgtaaccaacacaattaagatctagaacatcctgtctctcccctcccgattttcttgtgctcctttggagtcaacaactctcccccaacc

SEQ ID NO: 11040 - DNA, 951 bp, Homo sapiens; identical to SEQ ID NO: 11039

SEQ ID NO: 11041 - DNA, 2919 bp, Homo sapiens
ttttatttaatttatacttaagtttgaatagccacacatggctagtggctatcatactggtcaacatgggctatctaattctgatgtacagtctctgcatcatcattccattttctaaagtgggtttctcccacagcagttgttaaaacaaggatttggatacaaagagattatttaagaggtgatcctagacagcaggagagggattgaggaggtgagatggagaaggtgaatactagtaaaagactacattgatatgctgtaggcacttgaggtttctgtttgtttgtttgtttgtttttttggaaaccttcgagagacttatggaaaacactgtataattgtttcattgaggagcacggaactgatcatgtttattcaccaactctcatgcctttttggttgaaggatgctcctaggggcattcacacctgctctgaactccttcttcatctccagcctgcctcccttatgggccatttcatgccactgtacctagataaagccttagggccaagagattcaggtgcttgaggctgggtctatccttctgagctgcaaataacttccagggtggatcaagggaatgtggggtcaggatagattatattgcctctcatttacaaccaaccatattagctcatattagtgttttatctggaataggaggagaagcatttgagactgttagaaaaaaggttctgctatttaaaaaaaaagttttgaaactgtagctctaaactacattcctacctgttttcctgaccacctcaattactaacttgtatcgtgttccatattatttctagcacagcatggattctctaacattcttgcagtctgggccctgcaaggtagctgtaaaaatgctgccctgggactttctcagtggagacataagaagactcaagcattccagaaagtgtttgtttggttggcttttattgatgtatataaaaagattagagacagcaagagaagaaaatcagagagaacctatacttggttaaaaaaaaaaaaaagattttacagcagaagtagatagaagtggtgcaaatgatgatttctcctcttctgatatcaagctttgttaagttcctggaaaagcaaacgtgattatggcaggagtaaattgactgaaagccaagtcaaagaggcagatcagcttctgaaggaggtctgctcacttcagcaaagaaagcagggcaaagaatcctaggcttttgagctagttaggcccccagttcctacaaccatgggctgaaataatgtggagaactcttgatattgtaggcaaaatgaatgttagcagagttccatcagagataatggctggccatgagctaaagagagtttagccaccacaaagaagaacctgcctgtagagatatctctaagctaaaaacctctgcaagtttcctttcgaaattctaccttaaaaatttgaaataacctcagatcaaagttaacgcaagagtttccagaagagtgaagttcataatgccacaaggaaaaaaactagaggatgactaaagtaaaatttcattttaaaatttttattcatctagctgaggttggaaagagtaaaatttttacatgaaaatattaagtatctagaaactcttataaaaagaaaaattaaaaagcacaatgatagacaaaaaggatgagaataaacaattcagaaaaaaaaatagaactgatccataaaaagaaaaaaatggccaacttcacttattgcattgaagaaacacaaaataaaatataatactgcctattaaagttgtacatttttaaataaattaattaaaatgcccaatgtgggtacaattgtggaggcagtgagcactcttctacttgttggtagaagtggaaattaaattgttacatccttctaaaataatttggcaatctattaatatattcagatcctagaatagtttaaagcctccagtccaataatttattatatctatatattgtctgttcatatattttctatttatatatatatctataatctgtatctacatatatatctagcctactgcctatctttgtaaataaagttttattggaactcagccatactcattagtgcatggtattgtctatggctgctttccacctgcaatggtagcattcagtagtcgccctggagaccatacaactaaaaacatgtaatatgcagccctttgcagaaaaagtttgctaacccctgcaccagaatataaactctttgacatgtaagctcaatgagtgcaaataatttgtctgctttgtttgctattgcattcccagtggctagaacagtgcctggcacacagtagatgctcaataaatattagtgaagtcatcagttgctcctattaaagtatattcatattgtttttacatttagtgggtttttggttttacaaataatgttgcagtgaacacagatctttgcttacttttgcaattatatcagacacaatattttaaaaaaaatagttaacaactttaacaacctggaaaaatactgttgatatatcaaatttttaaaatagactaaaattttatagatgactctaaattttgtttttaaaagtgtgtgtgcatgtgtgtgcgtgtttgtgttaactataaataatttgaaggctaggaggtgggtggggtgattttgatttcctttcctttcttttctttttgttttttgttttgttttttttttttttttttgaagtggagtctcgctctgttgcccaggcttgagtgcagtggcgcgatctcagctcactgcaacctctgcctcccaggttcaagccattctcttgcctcagcctcctgaatagctgggattacaagtgcacgccaccatgcccagctaatttttgtgtttttagtagagaccaggtttcaccatgttggtcaggcagt

SEQ ID NO: 11042 - DNA, 224 bp, Homo sapiens
aagggacaaggactgaaaaactgcctattgggtactatgcccactacctagttgatgggatccttcataccccaaacctcagcattacacaatataaccatggaacagacacccctgaatgcacatgcaccccctgaatctaagacaagttcaagttattaaaaaaaaaaaaaaaagatgaagatggggataggttgagaatgaggaaagaacaagaggttttg

SEQ ID NO: 11043 - DNA, 286 bp, Homo sapiens
catgcttcatggttggagaaacaccaacatcagccgggcgcggtggctcaagcctgtaatcccagcactttgggaggccgtcactggcagatcacttgaggtcaggagttcaagacctgcctggccaacatggtgaaatcccgtctctactgaaaatacaaaaattagccaggcatggtggcaggcacctgtaatcccagctacttgggaggcaggggcaggagaatcacttgaatccaggaggcagaggttgcagtgcatcaaaggtagcactttggcatagcta

SEQ ID NO: 11044 - DNA, 4132 bp, Homo sapiens
gaagacgatgggaatcacattaaaaaggagaagcatcctctcctcgtcggacacatgcccgtgatggtggccaagcagcaggagttcaaggtgaagggaggcagggcccgcggcccggggtgggacgcacctcgcagctctgaatgggccacttgggagatgattcttaaggggcgtggtcagaacatggtcctcccaggttcaccacagtgaccgcttctctagaggtcatttatctggaaataagactgctgttgattgaaacctaaaaaaacgcccagccattgtctctgaagcccagtcctgggccaggaccctggggtattccagcagtgccacagcacctgaggccttgttagttaaagaggggacacgtgtttcacatttgtagctctgttttgcctttgcttggcaagcagtctgtttccacagtggatcgtaactccaggtctcctgtctgcttgaggtaccgtgcccgctctttgccttggcagactccatctccagggtggcgtcttattaatgttcccagtgttgctgactcaggcatcacaggccagggccttcagtgacgctgacaatgtcttattctttaagaaataaagatgtttcttctcaccctgctctctggccagggtttcccagcagctcccctgacccctcctgttgagagttgcaggcggtgcacaggactcctctgggagaggctggggtgggacagggaaggggagaggcacaggccatcacaggctgtacttgatgcctgcagggccagccctcccatctgaagcgccctgagctgccggatttcagtgtgctgatgggatctaaagattaagataccaaaggttgaatctccttaggtgttcacttctaaaaagctaacttctgagagttgtacttttaaactttcatcctccctattttaatctttggtaggtaatgaacctgtaatttctgtgtttatacattggaagtaagtcatccatttaagacgttatgtagtctaggagcctcttagctctgttttatatgtgagcgtttgattttattccattttagattgaatgtgctgcttataaccctgaaccttacctaaataatgaaagccagccagattcattttccacggcacatggtttcctgtgggtaagatgtgtttatttggttttggtacaagttcacagagaatcaacgttcatggtcggtgtgatgagagactgagatgtgaattgctcagtagagagttggcggtggcgtatcccagagtgtacttagaaacatgaaaacttctttgaaagggagctgatcacttttggaaaagatttacagttcttaggaatgcaaatatttgtttcttttccttttcatctaaaacatttaccagataaagttgagtccagagacaactaactaataagagaataattttaatatgtttttccattttggtgtcaacattgcatggattttttttcttgttccaagactggctttttccagtggaaacttagcagttaaaattaatttgttccaaatgaaatattgcatctgaaattaggctggaattgcagtagacgttcctggttcttgcaaaccagaggacattcttgaagctgtgtggtcccaggctctcccctctctggtttcctgtgttccctccctgcagcctcagactcgccctccagggctccactgtgcttttccaaactctcatcctttcctcccaggcgtcctgtgcagcacgccactgcctctcacttctcacatccacagctcctgcttggtcagtgttcctagttgagtgtcagaaattgaacaacccaattagctggtatttcatttgtaccaacctatgaatggaggagtagccttaattcccttgggggcttccacttctaagagaactgttttccgtccaggtaggcagacctgtcatggctgaagcttcatcacctggcctggtcatagcccccaggccctgtaggcaggacaggggcttggcagattggcatccttcccacaaaagcatgaaagtaggatgtctgtatgtagcgacaacaaatacaagaataaggagagtttaacaacattctcaaagttggtggaaaagaaaaagaatcaatgaaaacatcaccctaaaccagctagtgctttctgtttacagggatcagaccccttcccacttaaaaaaaaaaagacaaataaatttaagtttaaattgggaaactaactgtgctatgtgttctcgttgtagagattcaaacacacaggaagttcatgtacactgttgcagcaatgctactttagaaattccacggcaggcgtggtggctcatgcctgtaatcccagcactttgggaggccgaggcgggtggatcacaaggtcaggagtttgagaccagcctggccaaacatagtgaaaccccgtctgtactttcacatagtgaaaccccatctctactaagaatgcaaaaattagccggatgtggtggcacgagcctaaagtcccagtttctcaggaggctgaggtggcagaatcgcttgaacccaggaggcagaggttgcagtgagccaagatcatgccattgcactccagcctgggtgacagagtgagactgtctccaaaaaaaagaaaaaaaaagaaattccacagcataccacatgttgacttccaatgagctacttgggatgcattcttactgatgtttttcctatttgaaaggtttattttcttagcctaggtcattgaatattagtgttaagttattaaaattgataataatctgcttcttaggattttaaattgaggatagatgggcccttaccttcatattgtgatgagtacgtgatttttaaagtatagaaatgtgactttgtagaaatgaaagttacgcttttgctttaaaattttttgaaaactgaattaaatgtgttgaaaagaaaaaggggctctgtgagcaattgtttaagaatttttttttatttttttaagtgtgttgattctcacatgaaaatcgaagcttgtcgtggcctttaagggtcaggttccagcgtattatggaagccgccacatggtcgttttcttctttcctcctaattctctgattcagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggatggaggagggaaggtagggcatgctcactgcgttacagagaattagcaagctctgcccatggagggcgtggtggggagcctgtcctggaaagagtccttgactttgactcaggagtagcccgtgcaggaattaggggataccaggggaaatttttagggtcattgcactttgaaataactagtgaattgggcccatggaaattattctaggaaactcttaaagagaagtggtatttctttaaaggggacagtttggctgtttgccactgaaatgtctcatttatattaatggttttgaaaaggacattccccccttatattttggaataaaacagccatattctatgtcatgatcatactgaattgctgacaccatttaaaggagagttaaaatgattttcctgatgtgaagttccaagatacacagtaggaagaactaagttttttcatatatcccagaatttcccttttaaaaataaagaaatcaaggtggttgcaaattttttaaaagtactggcaagtgtccctaggaatggagaaggaagggcaagagggaagagttgaaatgtttgtgtttatgttaacaggcaccctcgttcttgttacaacgagcaaatatatttattagcttgtatttttctcttaaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccaggtg

SEQ ID NO: 11045 - DNA, 4131 bp, Homo sapiens
gaagacgatgggaatcacattaaaaaggagaagcatcctctcctcgtcggacacatgcccgtgatggtggccaagcagcaggagttcaaggtgaagggaggcagggcccgcggcccggggtgggacgcacctcgcagctctgaatgggccacttgggagatgattcttaaggggcgtggtcagaacatggtcctcccaggttcaccacagtgaccgcttctctagaggtcatttatccggaaataagactgctgttgattgaaacctaaaaaaacgcccagccattgtctctgaagcccagtcctgggccaggaccctggggtattccagcagtgccacagcacctgaggccttgttagttaaagagggacacgtgtttcacatttgtagctctgttttgcctttgcttggcaagcagtctgtttccacagtggatcgtaactccaggtctcccgtctgcttgaggtaccgtgcccgctctttgccttggcagactccatctccagggtggcgtcttattaatgttcccagtgttgctgactcaggcatcacaggccagggccttcagtgacgctgacaatgtcttattctttaagaaataaagatgtttcttctcaccctggtctctggccagggtttcccagcagctcccctgacccctcctgttgagagttgcaggcggtgcacaggactcctctgggagaggctggggtgggacagggaaggggagaggcacaggccatcacaggctgtacttgatgcctgcagggccagccctcccatctgaagcgccctgagctgccggatttcagtgtgctgatgggatctaaagattaagataccaaaggttgaatctccttaggtgttcacttctaaaaagctaacttctgagagttgtacttttaaactttcatcctccctattttaatctttggtaggtaatgaacctgtaatttctgtgtttatacattggaagtaagtcatccatttaagacgttatgtagtctaggagcctcttagctctgttttatatgtgagcgtttgattttattccattttagattgaatgtgctgcttataaccctgaaccttacctaaataatgaaagccagccagattcattttccacggcacatggtttcctgtgggtaagatgtgtttatttggttttggtacaagttcacagagaatcaacgttcatggtcggtgtgatgagagactgagatgtgaattgctcagtagagagttggcggtggcgtatcccagagtgtacttagaaacatgaaaacttctttgaaagggagctgatcacttttggaaaagatttacagttcttaggaatgcaaatatttgtttcttttccttttcatctaaaacatttaccagataaagttgagtccagagacaactaactaataagagaataattttaatatgtttttccattttggtgtcaacattgcatggattttttttcttgttccaagactggctttttccagtggaaacttagcagttaaaattaatttgttccaaatgaaatattgcatctgaaattaggctggaattgcagtagacgttcctggttcttgcaaaccagaggacattcttgaagctgtgtggtcccaggctctcccctctctggtttcctgtgttccctccctgcagcctcagactcgccctccagggctccactgtgcttttccaaactctcatcctttcctcccaggcgtcctgtgcagcacgccactgcctctcacttctcacatccacagctcctgcttggtcagtgttcctagttgagtgtcagaaattgaacaacccaattagctggtatttcatttgtaccaacctatgaatggaggagtagccttaattcccttgggggcttccacttctaagagaactgttttccgtccaggtaggcagacctgtcatggctgaagcttcatcacctggcctggtcatagcccccaggccctgtaggcaggacaggggcttggcagattggcatccttcccacaaaagcatgaaagtaggatgtctgtatgtagcgacaacaaatacaagaataaggagagtttaacaacattctcaaagttggtggaaaagaaaaagaatcaatgaaaacatcaccctaaaccagctagtgctttctgtttacagggatcagaccccttcccacttaaaaaaaaaaagacaaataaatttaagtttaaattgggaaactaactgtgctatgtgttctcgttgtagagattcaaacacacaggaagttcatgtacactgttgcagcaatgctactttagaaattccacggcaggcgtggtggctcatgcctgtaatcccagcactttgggaggccgaggcgggtggatcacaaggtcaggagtttgagaccagcctggccaaacatagtgaaaccccgtctgtactttcacatagtgaaaccccatctctactaagaatgcaaaaattagccggatgtggtggcacgagcctatagtcccagtttctcaggaggctgaggtggcagaatcgcttgaacccaggaggcagaggttgcagtgagccaagatcatgccattgcactccagcctgggtgacagagtgagactgtctccaaaaaaaagaaaaaaaaagaaattccacagcataccacatgttgacttccaatgagctacttgggatgcattcttactgatgtttttcctatttgaaaggtttattttcttagcctaggtcattgaatattagtgttaagttattaaaattgataataatctgcttcttaggattttaaattgaggatagatgggcccttaccttcatattgtgatgagtacgtgatttttaaagtatagaaatgtgactttgtagaaatgaaagttacgcttttgctttaaaattttttgaaaactgaattaaatgtgttgaaaagaaaaaggggctctgtgagcaattgtttaagaatttttttttatttttttaagtgtgttgattctcacatgaaaatcgaagcttgtcgtggcctttaagggtcaggttccagcgtattatggaagccgccacatggtcgttttcttctttcctcctaattctctgattcagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaaggtagggcatgctcactgcgttacagagaattagcaagctctgcccatggagggcgtggtggggagcctgtcctggaaagagtccttgactttgactcaggagtagcccgtgcaggaattaggggataccaggggaaatttttagggtcattgcactttgaaataactagtgaattgggcccatggaaattattctaggaaactcttaaagagaagtggtatttctttaaaggggacagtttggctgtttgccactgaaatgtctcatttatattaatggttttgaaaaggacattccccccttatattttggaataaaacagccatattctatgtcatgatcatactgaattgctgacaccatttaaaggaaagttaaaatgattttcctgatgtgaagttccaagatacacagtaggaagaactaagttttttcatatatcccagaatttcccttttaaaaataaagaaatcaaggtggttgcaaattttttaaaagtactggcaagtgtccctaggaatggagaaggaagggcaagagggaagagttgaaatgtttgtgtttatgttaacaggcaccctcgttcttgttacaacgagcaaatatatttattagcttgtatttttctcttaaagcatttccatttataaaagcagtcaaggcgccaagaaagtgagacttcagcactttttcactcctgagaagtccacagtcatgagcctggcttgcacgtctcagagcctgtacgctggcctggtcaacggggcagtcgccacctaccccagagccccaggtg

SEQ ID NO: 11046 - DNA, 1752 bp, Homo sapiens
gaagagaccttgggtaataagcttgccactgagtggctgctttatgtcctcaagggattgtaccatatcaagcactcagcattggtgtctgttgctaatggtcaggcattcagtagtggtggtagctagatcagccttggagagagagagcccatcatttcaggccatcacgactaatccattcatttatgggccctttgtaaggattgagatggctgaggacaggggctgacaggcattcattagaccagtcatcctgtccatatgcttattcagtgcttcttctgccacacgtgctctctggtgggctctagtgtgagacacaaagatcaacacattatgtgcccattcttatagctccagccacatgcctcttcctcagacatgcttggtttcaatcctctagtgttgttcccttgaggcccttgaccaagcaaccaagccattctccaccacctagaagtctgtgtatattcttacttttggccgcttctctccagacacaaagcagatgaccactggacttgaattggcacccagagttattttgggtgtgtctttagtgcagcaacagtccatatttttagctcacgccagcatatcatgctagcctaatccttataaagcccttttcctgctccttttctattctgtcaactgtctgtggagaaatccccaaggggccataggtattatgtctggaattggttctctccgaggggttcttggtctcgctgacttcaagaatgaagccatggaccctcgcagtgagtgttgcagttcttaaagatggtgtgtccggagtttgtgttttcagatgttcagatgtgtctggaggagtttcttccttctggtgggctcgtggtctcgctgacttcaggagtgaagccacagaccttcacagtgagcattacagctcttaaaggtggtgcgtccagagttgtttgttcctcccggtgggtttgtggtctcactggcttcaggagtgaagctgcagacctttgcagtgagtgttacagctcataaaggtagtgtggacccaaagagtgagcagcagcaagatttattgtgaagagtgaaagaaaaaagcttccacagcgtggaaggggacctgagaaggttgccgccactggctcgggtggccagcttttattcccttatttggccccgccctcatcctcctgattggtccgttttacagggtgctgattgccccattttacagagtgctgattggtccgtttttacagagtgctgattggtgcgtttacaaacctttagttagacacagagtgctaattggtgcatttttacagagtgctgattggtgcatttacaaacctttggctagacacagagcgcttattggtgcatttacaatcctttagctaggcagaaaagttctccaagtccccacccaacccagaagtccagctggcttcacttctcaatcctccttctaaacaggacaccacaagtgttgttgggaattggccgatgaccgctctagctatttcctgctggataggggcaaagaaggggccctgcagttgtagtgtcctccagaggggaactctttaggccagtgaaagggccagcaggttggtctggggtcctcagtagaagttgttagttgagctcatttggggttccatttgtaagaccatctgtagcttgatggcctcaattctagaggaaacaaatttgacaaggagattaaaaatacagggtccaaaggcaagaaatagcaag

SEQ ID NO: 11047 - DNA, 685 bp, Homo sapiens
gcaaacatggtgaaaccccatctctactcaaaatacaaaaattagttaggcatggtggcacacacctgtaatcccagctacttcggaggctgaggcacaagaatcgcttgaacccgggaggtgcaggttgcagtgagccaagatcacaccactgcactccagcctgggcagcagagtgagaccgtgtcccaaaaaagagaaggagaaacagagatcatgtggaaaaagttattttttatttatttacttagttttcagtttggtttgagactcgtgttttaaaccagagggcatggttactgagggataacatcaatagaactcctataattgaggggataattatcaaggtattagatgattcactggctattacaaagaacacagaaattatgaaacctggttctgtaacttatagtttttcatattatttttataccatggacaactcttctatgtgtattcataggtgtaagattactggcagtgtcatatgaaacaacgtattacattttttaagcctggaaagcatctagtatggctgtgcacgtagtgatgacattgactttttttacttaaagaagagctaccacttcaaatccacacggtggcagttctcctgcctagccagctgccactggactctctcccctgtatataagcccccaataactacgtcttattt

SEQ ID NO: 11048 - DNA, 618 bp, Homo sapiens
ctccaaactgttttccatagtggttgtactgatttagatttccaccaagagatatgtatgagagttcccttttctccacattcttgccagcatttgttattgcctgtcttttggataaaaaccatttgaactagggtgagatgacatctcattgtagttttgatttgcatttgtctgatgataattatgttgagcactgatatggtttggatctgtgtccccaccaaatctcatgttgaattgtagctcccagtgttggaggtggggtctgctggagggtggttggatttctcatgaatggtttcatactgtcctcttggtgctgttcttgtgatagtgagtgagttctcatgagatttggttatttaaaagcgtacagcacctccccgctcactctctcttgctcctgcttccgccatctaagatgccttactccctctttgctttctgccatgattggcagtttcttgaggcctctccagaagcagaagctgctatgcttcctatacagcctacaaaactgtaagccaattaaaactcttttctttataaattacccagtctcaggtatttctctgtagcagcatgagaacggattaatacaagtctcaggtattt

SEQ ID NO: 11049 - DNA, 614 bp, Homo sapiens
ctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtattt

SEQ ID NO: 11050 - DNA, 614 bp, Homo sapiens; identical to SEQ ID NO: 11049

SEQ ID NO: 11051 - DNA, 436 bp, Homo sapiens
tggcctcccaaagtgctgggattacaggtgtgagccaccgcatctggccaatcttttctttttctttcataaaagttgtactatttatgaagtacatgtgatattttgacacatagacacaatgtgtaataatcgaataaaagaaattcggatatccataacttcaggcatttatcatttctttgtattaggcacattccaattccactctcagttattttgaaatatactaaaaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttggctctcccataggagtgagaacat

SEQ ID NO: 11052 - DNA, 436 bp, Homo sapiens
tggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacat

SEQ ID NO: 11053 - DNA, 436 bp, Homo sapiens; identical to SEQ ID NO: 11052

SEQ ID NO: 11054 - DNA, 1311 bp, Homo sapiens
ggaggaattgctatttaagtggaaagtgcttgaacagccaaatgagcacctgtcatgtttattttcactttgaaaagtagaaacatgacagtatagtttccactgcctatccaatatgaacttctggcattcttgttatcttctcaggaactgcactgtttgcttcttgtgttcaatttttttttttttccagggatgaggatgtatctctcctcctgaaactttcactctaaaatatgcccccaaatactgacattttcaagcttgtgcttttttacttgatatctgattttttttaaatttttatttaatagggagaaggtcatgacttatggaatttactctaaggatagggatctgagcaggttcctgagtacttgaaaggctttatttacctcttacacttttttgttacatccaggtttttgctcatttctctatcatttgtgtcttgaactttacctgaaatgcatgtcttgagtgcctactaaggtccaggcattgtgctggcagatttgatatatttttgtttattccttattacaggactattacatagtagactctcattctgacactcactttttttttccagaaaaaaaaattaatggagattgattgctaatgggtacagggctgcttttaaggctatgaaaatgctctaaaattagtttgtggtgatggttgcacatctctgaacgtactaaaatacattgaattatatactttcttttttcttcgttttgcagcttttgctcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacggatctcttgaggtcaggagtttgagaccagcctggccaacatggtgataccccacctctactaaaaaaaaaaaaaaaaaaaaaaaattagccaggtgtggtggcgtgcacctgtaatcccagctactcgggaggctgaggcatgataatcacttgaacctgggaggcagaggttgcagcgagtcaagattgcaccactgcactccagcctgggcaacagagtgagactccgtctcaaaaaaaaaaaaa

SEQ ID NO: 11055 - DNA, 1311 bp, Homo sapiens; identical to SEQ ID NO: 11054

SEQ ID NO: 11056 - DNA, 611 bp, Homo sapiens
gaaataaaatgtagacattctctttccccttgctttcccatctggtcctttgtaagtgttagcgtaaagatagttatgttgacatatttaaatatatgttgctgctgctgtatttttaaaaaacataaatgatactttattataaatattactctagtgtttgttttttgtacataatatgtgctggaaatttttttatgtcagtatgtcattcatattattattgttattataaaaatactacatgcacaaggaaataaaaattgaaagatttaaaatggaaagttgaggaagatctaaaatggaaagtgaaaaactccacctatccccaagttccatcccttagaggtaactgcttttcactgtatttgcgttttattctttgattacctccctaacccttaaacatatatatacttgtacttttatttctttaataactttaagcattcttggttgttgatcagttaagaatgacagaaacaggcagattgctggagcccggaagtttgagtccagcctgggcaacatggcaaaactctgtctctacaaaaaatacaaaaaaaaaaaaaaaaaaagccaggtaagccaggtatggtggcaaacacccg

SEQ ID NO: 11057 - DNA, 611 bp, Homo sapiens; identical to SEQ ID NO: 11056

SEQ ID NO: 11058 - DNA, 295 bp, Homo sapiens
actactggccgggtgcggtggctcacgcctgtaatcccagcactttgggaggctgaggcgggcggatcatgaggtcaggagatcgagaccatcctggctaacacggtgaaaccccgtctctactaaaaatacaaaaaattagccaggcgcggtggcaggcccctgggagaggctgaggcaggagaatggcgtgcacccgggaggtggagctttcagtgagctgagattatgccactgcactccagcctgggcgacagagccagactccgtctcaaaaaaaaaaaaaaaaaaagaa

SEQ ID NO: 11059 - DNA, 200 bp, Homo sapiens
cccagcactttgggaggccgaggcgggcggatcacgaggtcaggagatcgagaccatcctggctaacaaggtgaaactccgtcactactaaaaatataaaaaattggccgggagtggtggcgggtgcctgtggtcccagctactcgggaggctgaggcaggagaatggcgtgaacccgggaagcggagctggcagtgagc

SEQ ID NO: 11060 - DNA, 303 bp, Homo sapiens
tctggccgggcgccgtggctcacgcctgtaatcccagcactttgggaggccgaggcaggcggatcatgaggtcaggagattgagaccatcctggctaacacggtgaaaccctgtctctactaaaaatacaaaaaattagcagggcgtggtggcaggcacctgtagtcccagctactcaggaggttgaggcaggagaatggcgtgaaccagggaggtggagcttgcagtgagccgagatcgcaccacggcactccagcctggatgacagagcaagactccgtctcaaaaaaaaaaaaaaaaaag

SEQ ID NO: 11061 - DNA, 305 bp, Homo sapiens
ttaccggccaggcgtggtggctcacgcctgtaatcccagcactttgggaggccgaggcgggcagatcacgaggtcaggagatcgagaccatcctggctaacatggtgaaaccccgtctctactaaaaatacaaaaaattagcctggtgtggtggcgggcacctgcagtcccagctactcggaaggctgaggcaggagaatggcgggaacccaggaggcgaaggctgcagtgagctgagatcgcgccactgcactccagcctgggcgacagagcgagactccatctcaaaaaaaaaaaaaaagaaa

SEQ ID NO: 11062 - DNA, 326 bp, Homo sapiens; identical to SEQ ID NO: 10184

SEQ ID NO: 11063 - DNA, 319 bp, Homo sapiens; identical to SEQ ID NO: 7553

SEQ ID NO: 11064 - DNA, 163 bp, Homo sapiens; identical to SEQ ID NO: 8667

SEQ ID NO: 11065 - DNA, 316 bp, Homo sapiens; identical to SEQ ID NO: 6716

SEQ ID NO: 11066 - DNA, 305 bp, Homo sapiens; identical to SEQ ID NO: 7558

SEQ ID NO: 11067 - DNA, 300 bp, Homo sapiens; identical to SEQ ID NO: 9955

SEQ ID NO: 11068 - DNA, 316 bp, Homo sapiens; identical to SEQ ID NO: 7560

SEQ ID NO: 11069 - DNA, 157 bp, Homo sapiens
gtggtgactccgctgtaatcacagcactttgggaggccgagacaggtggatcacgaggtcaggagatcgagaccatcctggctaacacggtgaaaccccgtctctactaaaaatacaaaaaaattagccgggcatggtggcaggtgcctgtcgtccc

SEQ ID NO: 11070 - DNA, 283 bp, Homo sapiens; identical to SEQ ID NO: 7561

SEQ ID NO: 11071 - DNA, 1052 bp, Homo sapiens; identical to SEQ ID NO: 6718

SEQ ID NO: 11072 - DNA, 203 bp, Homo sapiens
attttaccttgtgccgggcacggtggctcacgcctgtaatcccagcactttgggaggctgaggcgggcggatcaagaggtcaggagatcgagaccatcctggctaacacggtgaaaccccgtctctactaaaaatacaaaaaattagccgggcgtggtggcgggcgcctgtagtcccagctactcgggaggctgaggcaggag

SEQ ID NO: 11073 - DNA, 293 bp, Homo sapiens; identical to SEQ ID NO: 6719

SEQ ID NO: 11074 - DNA, 295 bp, Homo sapiens; identical to SEQ ID NO: 7564

SEQ ID NO: 11075 - DNA, 138 bp, Homo sapiens
ggctaatgcctgtaatcccagcactttgggaggctgaggcgggtggatcactaggtcaggagctcgagaccatcctggctaacatggtgaaaccccgtctctactaaaaatacaaaaaaattgaccgggtgtggtggc

SEQ ID NO: 11076 - DNA, 167 bp, Homo sapiens
gcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggc

SEQ ID NO: 11077 - DNA, 300 bp, Homo sapiens; identical to SEQ ID NO: 7568

SEQ ID NO: 11078 - DNA, 183 bp, Homo sapiens; identical to SEQ ID NO: 6721

SEQ ID NO: 11079 - DNA, 184 bp, Homo sapiens
gtgcagtggctcacgcctgtaatcccagcactttgggaggccgaggtgggtggatcacgaggtcaggagatcgaggccatcctggcccacatggtgaaacctcgtctctactaaaaatacaaaagttagccaggcatggtggcatgtgcctgtagtcccagctactcgggaggctgaggcagga

SEQ ID NO: 11080 - DNA, 306 bp, Homo sapiens; identical to SEQ ID NO: 7570

SEQ ID NO: 11081 - DNA, 294 bp, Homo sapiens; identical to SEQ ID NO: 7571

SEQ ID NO: 11082 - DNA, 127 bp, Homo sapiens
ccaggagcagtggctcaggcctgtaatcccagcactttgggaggccgaggcaggtggatcaccaggtcaggagaccgagaccatcctggctaacatggtgaaaccccatctctactaaaaatacaaa

SEQ ID NO: 11083 - DNA, 299 bp, Homo sapiens; identical to SEQ ID NO: 7575
  misc_feature (18)..(18): n equals a,t,g, or c
  misc_feature (27)..(27): n equals a,t,g, or c

SEQ ID NO: 11084 - DNA, 321 bp, Homo sapiens; identical to SEQ ID NO: 10185

SEQ ID NO: 11085 - DNA, 316 bp, Homo sapiens; identical to SEQ ID NO: 7580

SEQ ID NO: 11086 - DNA, 130 bp, Homo sapiens
cctgtaatcccagcactttgggaggccgaggcgggcagatcacgaggtcaggagatcgagaccatcctggttaacatggtgaaaccccatctctactaaaaatacaaaaaaaagttagccgggcgtggtg

SEQ ID NO: 11087 - DNA, 257 bp, Homo sapiens; identical to SEQ ID NO: 9968

SEQ ID NO: 11088 - DNA, 102 bp, Homo sapiens
cccagcattttgggaggccgaggcgggcagatcacgaggtcaggagatcgagaatatcttggccaacatggtgaaaccccgtctctactaaaaatacaaaaa

SEQ ID NO: 11089 - DNA, 318 bp, Homo sapiens; identical to SEQ ID NO: 6723

SEQ ID NO: 11090 - DNA, 298 bp, Homo sapiens; identical to SEQ ID NO: 7593

SEQ ID NO: 11091 - DNA, 140 bp, Homo sapiens; identical to SEQ ID NO: 6724

SEQ ID NO: 11092 - DNA, 306 bp, Homo sapiens; identical to SEQ ID NO: 7596

SEQ ID NO: 11093 - DNA, 223 bp, Homo sapiens; identical to SEQ ID NO: 6725

SEQ ID NO: 11094 - DNA, 143 bp, Homo sapiens
atcccagcactttgggaggctgaggcgggcggatcacgaggtcaggagatccagaccatcctggctaacatggtgaaaccccgtctctactaaaaatacaaaaaaattagccaggcatggtggcgggtgcctgtagtcccagc

SEQ ID NO: 11095 - DNA, 1575 bp, Homo sapiens
tgggccaggcgcggtggctcacgcctgtaatcccagcacttagggaggctgaggcgggcggatcacgaggtcaggagatcgagaccatcctggctaacatggtgaaaccccatctctactaaaaatacaagaaaattagccgggcgtggtggcaggcgcctgtagtcccagctaatcgggaggctgaggcaggagaatggcgtgaacctgcgaggtggagcttgcagtaagctgagattacgccactgcactccaacctgggtgacagagtgagactctgtctcaaaaaaaaaaaaaaattccaacccctttacactgggtcagtatattgaaatatataaactttcacttgggaattattttttacctttgcacccatatttgcctgaagccgtttaagttgtcgaagtcgcatgtattcagatttcacttttcttttccagtaagtgatacatttggaggtagggggatttggtatttccatcttgctgtaatctaagagagacagagatgagaaatagcattttattgcctggaaataaagcattcctcaaatacaaaaaaaaaaaaaagatcaattatgctttcattcccattaaatttactcataaaaacacacatttaaagaacccaaatgtgtgagttcaacagaaagtttcaatttaaaaaaaagaggcaggggctcacacctgtaaaaccaacactttaggaagccgaggtgagagcactacttgagcccagtgatttgagacaaccttgggcaacatggtgaaaccccatctctacagaaaatacaaaagttagccagatgtgttggccagtgcctgtagtcccagctactcaggaggctgatgtgggaggactgcttgagcccaggaggtcaaggctgcattgagccgtgaccacgccactgcacttcagcctgagtgacagagtgagaccttgtctcaaaaaacaaaacaaaacaaaaaaacaaaaaacaacaagaagtccaggcacggtggctcacgcctgtaatcccagcactttgggaggccaaggtgggtggatcttctgaggtcagtagttcaagactagcctggccaacatagtgaaaccccgtctctactaaaaatacaaaaaaaaaaaaaaattagtcgggcatggtggcttgtgcctgtaatcccagttatgtgggaagctgagacacgagaatttcttgaacctgggaggtggaagttgcagtaagccgagatcgcaccactgcactccagcctgggtgacacagtgagactccatctcaaaaaagaaaaaaaaaaaagtccgggcatggtgattcatgcctgtaatcccagcactttgggaggccaaggtgggtggatcacgaggtcaggagttcaagaccagcctggccaagatgctgaaaccccgtctctactaaaaatacaaaaattagctggatgtggtggcacacgcctataatcccagctactcaggtggctgaggcaggagaatggcttgaaaccgggaggtggaagttgcagtgaaccgagatcacatcactgcactccagcctgggcgacagagcaagactcc

SEQ ID NO: 11096 - DNA, 279 bp, Homo sapiens
cccccgcctgtaatcccagcactttgggaggccaaggcgggcggatcacgaggtcaggagatcgagaccatcctggctaacacggtgaaaccccttctctactaaaaatacaaaaaatcagccgggcgtggtggcgggcgcctgtagtcccagctactcaggaggctgaggcgagagaatggcgtgaacccgggaggcggacttgcagtgagccgagatggcgccactgcactccagcctgggcaacaaacagagcaagattccgtctcaaaaaaaaaa

SEQ ID NO: 11097 - DNA, 146 bp, Homo sapiens; identical to SEQ ID NO: 8670

SEQ ID NO: 11098 - DNA, 271 bp, Homo sapiens; identical to SEQ ID NO: 7599

SEQ ID NO: 11099 - DNA, 296 bp, Homo sapiens; identical to SEQ ID NO: 7601

SEQ ID NO: 11100 - DNA, 270 bp, Homo sapiens; identical to SEQ ID NO: 10187

SEQ ID NO: 11101 - DNA, 243 bp, Homo sapiens
tcggccgggcgcggtggctcacgcctgtaatcccagcactttgggaggccgaggcgggcggatcacgaggtcaggagatcgaccccatcctggctaacgcggtgaaaccctgtctcttctaaaaatacaaaaaattacccgggtgtggtagcgggcgcctgtagtcccagcttctcgggagtctgaggcaggaaaatggtgtgaacccgggaggcggagcttacagtgagccgagatcgcgcc

SEQ ID NO: 11102 - DNA, 100 bp, Homo sapiens
actttgggaggccgaggtgggcagatcacgaggtcaggagatcgagaccatcctggctaacgtggtgaaaccccgtctctactaaaaatacagaaacaaa

SEQ ID NO: 11103 - DNA, 281 bp, Homo sapiens; identical to SEQ ID NO: 6726

SEQ ID NO: 11104 - DNA, 319 bp, Homo sapiens; identical to SEQ ID NO: 7609

SEQ ID NO: 11105 - DNA, 311 bp, Homo sapiens; identical to SEQ ID NO: 7611

SEQ ID NO: 11106 - DNA, 300 bp, Homo sapiens; identical to SEQ ID NO: 6727

SEQ ID NO: 11107 - DNA, 277 bp, Homo sapiens; identical to SEQ ID NO: 7615

SEQ ID NO: 11108 - DNA, 17946 bp, Homo sapiens
aagatttttcaaggaattttcttctctataatataattaatgatctcctacttggacttctgtaaaagattacagtaaatcgtgaagtcttatggaggtttttgcgggagtgggtgggagtagttgtctattactgcgtctttgaatctaaaacagtaccaggatggggccagagggcatctgggctcttcacggattatataggcttgaccttgttagtactgcatgctgtcagagcctcatccaaaaaccactgagatgtttttgtgcaggggaaataaaatttcaagcactggcctatcatctaaagtgacttcttttcttgacccagtagttttctggtgggttataaagtgactttttttatgccgagaactattgaaacaatttatttttgtgtacaaatatgtatgttttgaattaactataaatattacgttataaaacttttttatttttatttttataaaacttgtgtttttaaattggaaattacactcattgaattgttttacacatgcagacacacagacacacacacacacacagcgaaacaaaatcctgagtgacagcaccctgtaactaactgtggtgagatttgattcaagttgacagactcttctgttttagagagtaaatgcctttggattataacttacatgtctttctcaggaaaccagaatgggaggtgggtaacgaaatattctttttggaaatggaagaatcttagaataaaatataaattcaaattgccaatactggcttgacggtaaagtggcaaatctcaccaagacagaggattgtgtgcattaccctgagctgccactcattcatcaggggtttactgagcatttgttatgtgcctggccctgtgctaggccccggggatggcaggataaatccaatgtggcttctgcctgtgaggttctgtaagtttgtggggaagagggatgtctcagcagaagcttgtgagactgtagaaggggtctcagggacactggaggtgcaaaaactagctcttcctggagtgggagtaggactagcttccctgaagcagctgccctggtgctgggccttgggaacagatggaggagccggtgtccccagccaggactccgtaaaggtgtggcattgcaggagggcctggtctgttctgaagagggtagggtgagactggaaagccaaacgggccagattgtgtggaggttttatctcatgggcagcgtaccatttggcccaggagtgccatgcctggggttgtatttttaaaaatatagtaaccatctccccctgcactctcatctaccctgctgcgtattcttggtgatacgttccaagacccccaatgaatgcctgaaaccacagatggtactgaaccctgtatatactacacacgaatttcacttttcttcacaatttcatgggtagaagattcgttcttaccgaagatcttaacatccttacctctttttttttccttattgagacttttgccgtttcacttaaaggaagcatttttggcttctctttggcatatctgaattgccagcatcactatccttacactttgggggcccttctaataaataaagggttacttgaagacaagcactgtgatactgagacagttgatctgataactgcgttggctactaagtaacaggctggcagcatccacagcatggacacgctggacaaagggatggctcgcagtttttgtaatggcaaaaatttcatcacactactcagagcgacatgtagtttaaaacttacgacttgtttatttctggaattttccatttagtatttttgaaccggagttgaccatggataactgaaattacagaaagtgaaacgtggctaacggggtgctagtccctcagtcatccccaagcccttcaccaactctgccctgtatttcagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctaggtactgcaggcagtttatttccccaagcattgtacattttgcttgacttcatatgggtaaattttattgatggctctcattacatttagttgtggggtgatgtcaccttcgtagctcattttaagtctttagaccaccatcagtcataattttcaaagaagctaattttgtctattaaatggaacagaaacttcctcactctgaattttggataagtttgtcatttagcccatggtgggggtaagagtcccactttctaaattggcgatttctgtcacatgtctaaggtagaaccagctgcaggcagtggggacttggggactagaacaggcagggaggtggagagctattctggtgggatgtcctaggggctgatgaaagtgagccttgacagcagctttgttctaaaggagcttaaagagaaagcagtggccgggcgcagtggctcacgcctgtaatcccagcactttgggaggccgaggcgggtggatcacgaggtcaggagatcgagactatcctggctaatgtggtgaaaccccgtctctactaaaaatacaaaaaaaaaaaaaattagccgggcgcgttggcgggcgcctgtagtcccagctactcgggaggctgaggcaggagaatgtcgtgaacctgggaggcagagcttgcagtgagcagagatcgcgcccctgcactccagcctgggcgacagagcaagactccgtctccaaaaaaagagagcagtgaagaaggaagtagagccgccttgcctccctttttgtctcataggcttaaatgtctaaggatcaaggccaccagacctaatttgttctgctgctgtttcataatgtactgagtaatattgctgggacctggggtacctacactgtaacaagtgtaaagtgcaaataaataagtgtcagtcgcaaaccagcaaaacccactttttgaggagtaaggctccatgatgagaaagcacccagagcttgcccctgggacttggcagcaacattgggctgacccaccctggcctgttcccaggaatttgctgatgcccttgactacacacaatgaagtgagaattcaaaagccacgttagttcagcctcattggaaacgggagggagggtcagtgtatgccgaatggagaaaggaggaatttggtagggaaggaaacctttcatttcaagttttaaagtatgaactcaacagtagactcagagcttctacatatgagtctttttagccatcctctttcaaatctaggtgaagcttgtttcttacattagacacatttgtgaaaaggctttatgtaaatattgatttttctatatcaagttacatattataaatccaagagttcctcactgtgtaaaagaaccctgtgaccagtcactttttgaagggcataaatctgtcgatattatagattactcccaattcatgttatctaaagtcattttgatgtgttgagctttcttaaaatgaaacaagcattttttttttaaatgggaaagagactccagagaaatggggtcagtgttcctacaagcatgtatttttgaggtagtctgtattagattttcctgaattccattcagtaatgctcaagtgtttaatgacctcataatgtgttcactttgaatttaagggtaattgaaagaagccttctttagatttctttccatcttctgtatcttctctgaaatgtttagcctagctgttctttgtcctgcagttagtgacagaattcttagggagcttgtaaaaaacacctactgtgtgtcattgttggtttagagacttaactcataaatcagctgtctctaggctagtttcagaatttaggctttattcagattaggaaataattcttggtttcatgtttcaaaaacatagccaactaagtgtttctcagatgctgatcatgaattctctttagtattcacatgacattcttcacttcctcttccattctgcacgctgcattgcccattgcacctcaaaatggagggagttagaagaaagaaaaagaactgaaactttagctgagtgcaatggtggacgcctgtagtcccagctactctggaggctgaggtaggaggatcgcttgagcccaggagtttaaggctacagtgagctatgattgcagcactgtactccagcctgggcaacagagtgagaccctgtctctttaaaaaaaaaaaaaaaagtgaaattcaaattagtattgtttcagatgaagcaaaggactctgaagatggcagaatttgtggtaaaactgttggttcaaatcaggtttttgattattatgggttttatgtatttttccactacatataattttttcttaacctttaaaaaaagaaacttaaagaaccttaataaaggaaacaaaaaactgtagctccttgtcctcaaattaatgagcatttaaacacattccacactactgtagcttgtgcagttgtcacatttgtggttaagcttaaaggtcttagtattatagggtgaaatttcttgaaaagatggtggcttgttgatgatttatacagtctcacttggtgtctatttgtggaccagtccttttaaaaaaagaatagtctatgaatattagagcatctaacattgcatagtgttttgttatccacattactgtctgctgagttaatactaccagagctaaacctgatgccacccgggcagctttgtttggggttttgctgataggtgaaatgttaaaaatgtgagcctatgaagtcatttgagtttttaaaatgtggagtttaaaagtaggccagctattctctttgtatctagaggagagttgatctcattttctctttatttttagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggtatggagtcatgagaggcaaaagttaagccatctgtccctcttaaaataatttccaaactacagttgttggggtgagcagctgtttttgatgtatagaagagtaaccacgtgatggcccaattatggaccgtgaatgaattacatgtggtttttaaatttcagaaaagtgctccagaaagcacagtattggaaagacctaaagatgaaaattttcactgtaatatttgcataggtagcatttttcgggtgcttgctggattctaagcaatgaggaaagaaatgaagaagagcccatttcccggtgcaagtaacatctgtcttccctttcccacaggacgttctcctgctctattacgctccgtggtgcggcttctgtccatccctcaatcacatcttcatccagctagctcggaacctgcccatggacacattcactgtggcaaggtaagcaggcctcttctgcagcgctttgggctgtatgcccattttcactcttatttgcagcttagccatatggtgtgtgagggtctgcccattttccattaacctttggtaggacttggctgaatttaattgtcaggttgaagccatgagcaaagcctctttgaaactgaacttttcctcatgaattctgagtgttccttccatgatgttgatgtttagccctgactagattcgtaggtggctgagtgcagttctgtggggagagcactgacctggttgccaggatggccccgtggaataccatgggacagttgccccaggcaatgccagtgggtcctgggatcccaagcagatctctccaccagccctggtttatctcatttgtgaaattaaaaggaaagaccaatagatatccacattctggtattgtgattccatgggtactgtatgtgcgcttttgagtaaacaaaatttttaaaaatattttttgggaaaagaaggctcaaatacagagtctttagatggggtagtaagcagttttgggtgaggaaaactgttcacatttaaccccccacctcccccaaaaccctacagatagataagagttaaatataaaaaaatcaaaacaaaaaataggatttgctgattcctctgggagatggaaactttccaaagtggaagcagttggaaaaataaagagagaaaaatggacagattccactagaaatacgtgcagtgaaaacagggaaagcagacaaaaagggggaccattaatatattttccagtgtctctgtgtcacctgttatatgcactgtaagtaataattagaatcaaatctgaggagttactatgttgggagagtttttgatatacatattacctgactgagtccttgcgacgcttagtgaaggcactctagttaaaaaaagaaagtgctatttgtgttgaggaggaaactgagacatagaaagattcgacaagttgcccagagtttcaagctgcaaatgaggggccaggattaaatcaggcattcatactccagcctccccggaaattaaaatggtttagaagatggctgagaccgattccattctgaacaaaggatgtgagcaggtttttcttttaagaggagagagtaaataaacaagtggggaaattataacctaataaatgtaaattaaaacagtaacaaagtatcatttaacatattaaagtaatcagtggttttaagtgacagaatcttgtgttgataaaataaaatggaaactgcagtcagatgtatctaatggaatgagtacattgccataactcttttggaaagcattttggcaacatttacaagaaatcaacaaaaacagttaacacatttttgacccagttaattttactttggagaagtaatggaataggaattccgaagaagcatgagctcatcattatagcattgtttacatccaccaggagatgaatgtttaagtaaattatggctgggcatttaatggaatttttatccttcaacagtgcttttcatacagttaatggaaaagaacagagtatgaaatatatgacaactcttcttaaaaatatgtaaggatataggcgaggtgcagtggctcatgcctgtaatcccagcatgttgggaggccgaggtgggcggatcacctgaggccaggagttcgagaccagcctggccaacatagtgaaaacctgtctctactaaaaataaaaaattagccaagtgtggcggcacgtgcctgtagtcccaactactcaggaggctgaggcaggagaatcacttgaatccagcagccggaggttacagggagctgagattgcaccactgcattccagcctgggcgacagagcaagactgtgtctcagaaaaaaaaaagtaagcatatagaccaagcctgcagcctgcataagaaaggggggccttatttagcccaatggaattctgagtggattttgacaatgttttaattttatagtttgctttctttgaagtaagaatcaagtgagaaaaagcatttaattatggaatatagtgttcactcccacttgtttagaaaggaacactaatgttttaggtaggctggcacaggtgaggcaggagtgctgttttgttagtaaacttttggtaaatggttttcatttggttatgccttttgttgctgttgttgttttttgtttttgtttttttttttgagatggagtcttgctctgttgcccaggctggagtgcagaggtgcaatctcagctcactataagctccgcctcccgggttcacgccattctcctgcctcagcctcccgagtagctgggactacaggcgcccgccattatgcccagctaattttttgtatttttagtagagacgggtggcgtttcaccgcgttagccaggatggtctcgatcacctgacctcgtgatctgcctgcctcggcctcctaaagtgctgggattacagacgtgagccaccacgcccggcgttgttgtttttttgagacagggtctcactctgttgcccaggctggaatgcagtggtgcaatcacagctcactgcagccccaacctcccaggttcaggtgattctcccaccttcccaagtagctgggactacaggcatgtgccagaatacccggccaattttttgtagagacagggtttccccatgttgcccaggctagtctcgaactcctgggctcaaacagtccacccacctcggcctcccaaagtgttggatttacaggcgtgagcccctgtgctcagcctggttgtgccattttttgaaaagcaaatttcatccttttggacacatacatgacacttaccgcaccctcactccccccagttatgctttctaaaaacttctgtcaaggtaaagattgaaaacatgttcatcttttgtgtgcactgtttatgaatagtagctgaatagcccctccgcaaggaggatgcagccccttccataaaggatgctgttgtggctccatgtctgcttagcccgagtgtgggcgcccagctgtgtgcccagctctgtgccagctgcccggggcaggcctctagagcagttgcggttagctcccacagtgattgagcacaggctgggtgagttagtacagatgtcattttctgtattagaaaattaatgtcaaatctgctaagaaaataggctgtttttggtctctatccagatttacaacataaagagggtataattttccatcttcagaggggcttgatgtattttgctcaatgatttcctttcttttcccagagctattcagggattaaaatacttggctagatcctgtcaggtgaggagtgaatgactcctcaggtgtcagtgcggcattttctgcaagttcatttttactttcaggacatcacattgccactcagtggaaagcgtccacgtagtagaatgttgtatgtcttggaagtatcagcgcccagctcacacctggtagtacattcatcgagaagggactagcccaatgtggggtgtaaaaaatgcaccaggttcttgaagttatctgagaaggttctttcaagttggtgtttcttgggctgatcatctgccatttctgttctttccctttaccaggattgacgtgtctcagaatgaccttccttgggaatttatggtcgatcgtcttcctactgtcttgttttttccctgcaacaggtaatgccaaatttttgtcactggtgggcagttgggattcttttgtggaggtctgaaaatgaaatgggtttaagatgtaaatcattcattatgttcaaaaaatgttcccttaggaaccaggcgtggtggctcatgcctgtaatcccagcactttgggaggctgaggcaggcagattgcttgagctcaagaggttgagaccagcctggccgacatggtgaaaccccatcagtacaaaaaatacaaaaattagccaggcatggtgacatatgcttgtaatcccagctactctgaggctgaggcacgagaatctcttgaacctgggatgcggaggttgcagtgagccaagatcacaccactgcactccaacctgggtgacagagcgaggctctgcctcaaaaaaaaaaaaaaaaaaaaagtgtccttagggacataaaagggttgtagtgtcaggatgttatgtgtggtatggatcttttaaaggttgtttttcccagtctatctcttacccgagcttgaatgtggccgtgagaattcttagctttcatggcctgtatgaacatatggaggacgcagagactgacaggattcttctgttgccctggctggagtgcagtggtgcaatgtttgtgtggggcaaaacagcagagaatctgtggagccctgcctgccccaagccttccacttgcttgtctctcagttggcctcccagcagctcctcatccctctcgtacagaggacagggtggctttcttacccatggcacgtccttttctcggattccaggaggcctacaaaggggttttctcccatgcgtgcagactgctgtgaacgtccgccatgggatggtcgcttgattttttcacacttgcctaatcagtattccaggtgcagttcttaacggcaactaccccggaagcccctgcaagcaggacattaacaagggggagcggacttccagttagtaaacgtagatgcagatgttttagtggaaaaagaaattaactcttggtcctttagagcctaatacactggatgtttgctccctttttatagattccctttggtttttagaaagttgagtccttttggggacccactcacatgactttgacagtatcttctctccaggggaaagtgtctgcagcatcatttagggagttccctggctcgcatgtatgacgtttgctgttttaatttcctgcctcccttttgcgattcagcttgtcatgtttctctaggagagtgtttccttcatatctattgaatcattcccttggtttttgctttgtatctcaaagaatttttgcgggagtacttctgtggtagtagggtcttgtcacatcatgcactaaaaacagaatgtgactcacccttttctactgctgactgagttgtgatgaggctttttctttctaagaagtgtttaaattaccacatagtccaggaatcacggacagtaacactaacactttcatctgtgtgggccaggagttgggcatgtagtttaatgacgtataatttttgaattccaagcatagtttgaaaaaatatgaaaatcttagcacccagcacatgccttttaatgaagaagttctcagcagctggcagaaatgcatctgtgtagagagacacaggcggaacaggtggcagggtggggcgtcatctggaggcctgcgtctgggctgagtgaccttcgttcttaggctgcctggtgtgggaaacgtgaagatgtgcgcatttctccggccccatgctgggcacttgctgcaggcccttacccttgtcgtttctaaatatcgaacataagaagactgtccacttctcttttaatgtaaggatgttggtaaaccaaagctttatggctttggaatggaatttttctcatttcctaaaaataaatggtagaagtaaagtatgctcatcatgagctggtcccaagcgagtgtttggtttagccagaaggtaaatgggcaagcagcgtgagctgacagcttgcaaaagaggaaatgaaaaaggctgttggataacatgtagtaagacctttttcattgtccacctgcttatgctatttttagtgaaaagaatatgaaattgtatatttactgtgataaaatataaacttgtgcatgtgctaggtggagatgttcacagaggggaaaatgttgaggtgttaacattgatgacttcagaggagtgagattgcaagtgatttgaaggtgctgcttgtatgtttttacatcccttgcaaattgtctacaaagagcatgtcttgatttataaaaatcatgaaggaaaaaaatgcaagagcctgtccttgggaggaagaggaaggggtggggccttgagggagacatagccttcctgtgcagaggcatcttggagccacttgctccaccgagcaggtgctcctccagccagcacttgcgtcagactctgtgtgacattgcaaaatataggtgctctggcctggccctgggccagggtgatgagggggagatgggtgctcctgtccaccaagagactctgatgtgtcccaggggaagaatcacagttttttagaggtgtgccctgccactccctcagggttagaggagagttgcatagacatggggacctcttcccaccatagtttcacatgactgctttcctggaagtagactgttgacattctctgtccctgctactttcacaaagtgtggcagtattttagtgtgcccattagggacattgatggagagtgcaccaagacctcttagttagcagatagcatgctcacggatgtcactgtcctgtaaatgtctggaggtagacatcctgagggatcttggcagctttttctgggaagtaattcacgtttactctgccttacaagaccaggcttgtgccgcagaacgtgggggcaggtccagcgtctggtattcttccatgggcccacttgacagggccacgatgtgttttcagttgttgtggggttttttggttttctgtttttgagacaaggtctgactctgttgcccaggctggagtgcagtggtgcaattacggctcactgcagtcttgaactcctggactcaagtgatcctcccacctcaggctcctaagtagctggatctacaggtgtgtgccaccttgcctggctaatttttttatcttactttttatacagatgaggccttactatattgtccaggctggtctcaaactcctggcctcaagcgatcctcccacctcagcctcccaaagcactgggattacaggcacacagcaccacacccagctttgtcatttgaatggctgggccccacttgaagaaagcttatatgttaagaaaactaagctttaaaggaggggatggttgaatgtttaccccaaaattataaaacaatttacggccgggtccagtggccctgggcagccaggctctggagtccctgctgttgacttccattctgttaacacctgagggagacaaactcggctgccggcccacctcatacctaagtgcataaagctggtagttttgatcaattgcagccaggctgtacaggcacaggtaaatagatatgtgagagaaacatcatcagacgattaaatgacaagttctgaagaggaattttctagatctctagatcaggacctggaacaaagctgtagggaaaacccctttctatgtcaccttccttccttattctgtgctctcagggctgggcagcctgaattcatagtcctttggttgggctgtttgccagttatcaggttgccaggtgtgagccagatgtacctggggaatgggggtacagtcacccccagttgagaacccctgccttagagaatgtgtaataaatgcttgctgaagaaacagactgggtatctttcaagttcttcctttttctccgggcactgtcagtgggcacaagagggacataggtgggacactcctgcctcccctggacgctcttcctgacacagccgctgggcatctccgagcacacagaggccccatgcctacacactcctggggccctgcatcactggctttaggcctgggcctaggagctcttgtctttcttggagggtgtgggtgaagctgagctctggcttcaggaacagataagccatcttaattacagaacgagcatatgggacagcctcagctttgtagagaatttcttgcccaggcaacattttccttactttcagtaagtaaaatccacggaacgtcttttcttggtgagaagtagatggcctggcctcaggtacagcctgcttttggactcattgtgttggtgtgactcctgtctttgcttcctttccctctctctccagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaaatcagcttgaatgtcattcagcatttattgaagaaggatgacatcccttccacttattgcacaaacttggtagctttgagacaaatacagtagcacagtccgtttgaagatttgtccaaaaaattagtccatattttagtggctcagtgtcaagagttccctccctgtgcccccactgttgcttctgcagtgatacgaaggatgaatgcttaatttcttattagtcagaaaacttgaatgcaacagttgggcattcaaaaataatccagagaggtcataacctacttagccatttgagtgtggctctggtgtctgctaaaaaaagtagctattgaaaaaacagtgagagctatgatgtggttcactcattctagaagcattttcattttcctcccgaaaacccccccagtgcctcaccgagccccggaccttcacccaacacggctgccacgctcaaatgggcctgattcaaactcccaggtacgtccctggcaccagggagtaggataagaaaacctccagaagtgaaactgatgaggaagtgacatttaatcacttcaaaaccgaaacttcactggcaaggtcaaaaccccaggccaaggctgacaatcgagcgctggtcagttccaggggtcaggctcggaacctgaaaatgcagatcctagctgttgctgcgtccctcaggtgtggaggaaggaaaaacagcctaggtgtatgtgctggctgtggtgagagtcgaggtagaaagcctggaagttctgaaacgtgaggggatggatcacacgccccagccttttctcactcaccaaagcaaacttttacccccttcttccagtcggcacctttggaacttgttctccctcctaggcctggtttcagtggcccccaccacgtgtcctgcccacccagcctgcagggcttctgctgacatcacgcctaccccaccaccacctcttctgaacttgccacaccatcagtagccagaggtgttgcctctcctgcttcctaaggtctcccaagagcccagctgaggtgtttcattaccaccttctgctcaggtggcccagccggctgtccctcttccaccccaagctcctacttaatgtttaaacccccaatttaggtgtatgctgcttaaacgaacagctccctacttctcccgcctcggggttccagaacgtggattcattcaacatggtttttagaagaggcttgggtgaggccagaggaggtgcctttagtctgagcaggaggccagagctctgagctcagccatgaagggccagtgctctgtggttaagccggggctgaccttccatctattacagggatgggcaggcacgagtcacatttgaatcataaataaaattagtatgtgcttgtggtgggattaaaaatcaaagtgagctcactgaaatgtacataggggaggccttggagacaggctgtggagacactagctcaccagagagccaccagctcaccacctgtgggagagtcaagtcctgaacttcaagttcacctctgccctgccccggctccctgccgcaagcacaggctggcaggaagcagtctggtggctcttaggggaatgtgcacgtgagaaatgttccctgggtcctaagtgcctttagagctgggtcaggggactggagacccgctgaggaaagtgaagtcagaaccccataggcggacggtcatcagagaggaaaggaagccaagtgatgtgaagagggaagaggaaaagaagaaaaaagacagaacctcaacagtcccctcccctccagtgcagaaaataggaaacaccaacacaaaacatacaaccttttctctttcctgggccaagtgggtttcagaccaaaagtagccaccacaggctctatgaggaccaaagcaatttcagcgaagccttcactcggggtggagggttggtggggggcttggcgtgctgaagacccaagcggcaagaaactgctctgctacaaggacgctggcagcctccaggacgcgtgccctgactcgcccttcactggctcccaggcaggtccggtagcttccctgcagtaactccactctcaacagaactgctatttaacaagtgagtctatgcagaaagaacggaggggtgcggggggtgtggtttttcttccacccatgactaatgaagcagagatcacccaagcaccccaactggtcagcctcaagaccccaaattggcatctcacttccttgacatacacgcagatggacacacatgagagacccctgccgagtgtggcgtgggcctttacaagcctatgaccctccagggtcttgactcagcttgtcattagtacagccagaataccagtcccgtgtgcgctagatgatatttttaaaaatcagcaaaagggcttaagcacgtgcttccaggggcctatttacagttcacaggtttgttagttcacgcattacagtagtagctccatcaaaaacaggctcagctagacattcaagtaacaaaagcgctacagggccatgagccccagcaaggtcaggcctgcccagtgcctgcaatgggcagcctcacctggaggccgaggggaagcccaggacagccaggtccccgggcatcagtgcatgcgatgacgaagcccgcagaggccatgccagcaagtgtcagcccttcctctcagacagcagcgcatccgtatggttttgcccctcccagcgcctcttggccggctgcaaacaggaccaggagccttgcatcctggctcagccgtggacttccgggccgttgggagtcatcagcttggcctttctctccacgcacggtcccttggccgaatactgcaccagcaggaagggttccttggtctccccatcccccacgatgctctcctcgtcctctgactggctgatgcgctgcagccgcaggtagcaccagcagcccaggatcaaggcccccagggccgcgatggcaatgaggatgacgatgactgtgaccacgcccgtggtggggctgtggtccataatagacat

SEQ ID NO: 11109 - DNA, 140 bp, Homo sapiens
ccacacctgtaaccccagcactttgggaggccgaggcgggcggatcacaaagtcaggagatcgagaccatcctggctaacatggtgaaaccccatctctactaaaaatacaaaaagttagccgggcgtggtggcaggcgc

SEQ ID NO: 11110 - DNA, 268 bp, Homo sapiens
tgtaatcccagcactttgggaggccgaggcagggggatcacgaggtcaggagatcgagaccatcctggctaacatggtgaaacctcgtctctactaaaaatataaaaaattagccgggcgcggtggcaggcgcctgtagtcccagctacccaggaggctgaggcaggagaatggcatgaatctgggaggcggagcttgcagtgagctgagatggggccactgcactccagcctgggggacagagcgagaccccgtctcaataaataaa

SEQ ID NO: 11111 - DNA, 301 bp, Homo sapiens; identical to SEQ ID NO: 7619

SEQ ID NO: 11112 - DNA, 2548 bp, Homo sapiens; identical to SEQ ID NO: 7621

SEQ ID NO: 11113 - DNA, 6141 bp, Homo sapiens; identical to SEQ ID NO: 7622

SEQ ID NO: 11114 - DNA, 130 bp, Homo sapiens
ccgggagcagtggctcacgcctgtaatcccagcattttgggaggccgaggcgggtggatcacaagctcaggagattgagaccaccctggccaacatggtgaaaccccgtctctactaaaaatacaaaaaa

SEQ ID NO: 11115 - DNA, 272 bp, Homo sapiens
cgggcacagtggctcacgcctataatcccagcactttgggaggccgaggtgggtggatcacaaggtcaggagatcaagaccatcctggctaagaaggtgaaaccctgtctctactaaaaatacaaaaaattagccgggcgtggtggcgggcacctgtggtcccaggtactcaggaggctgaggcaggagaatggcgtgaactcaggaggtggagcttgcagcgagccaagatggtgccactgcactccagcctgggcgacagagcaagactc

SEQ ID NO: 11116 - DNA, 205 bp, Homo sapiens; identical to SEQ ID NO: 6728

SEQ ID NO: 11117 - DNA, 167 bp, Homo sapiens; identical to SEQ ID NO: 6729

SEQ ID NO: 11118 - DNA, 299 bp, Homo sapiens
ggtgcattggctcacgcctgtaatcccagcactttgggaggccgaggccggcggatcacgaggtcaggagatcaagaccatcctggctaacacggtgaaactccgtctctactaaaaatacaaaaaattagccaggcatggtggtgggcacctgtagtcccagctactggggaggctgaggcaagagaatggcgtgaacccagggggcagagcttgcagtgagccgagatctcgccactgcactccagcctgggcgacagagtgagattacatctaaaaaaaaaaaaaaaaaaaaaaaa

SEQ ID NO: 11119 - DNA, 288 bp, Homo sapiens; identical to SEQ ID NO: 7627

SEQ ID NO: 11120 - DNA, 282 bp, Homo sapiens; identical to SEQ ID NO: 7628

SEQ ID NO: 11121 - DNA, 275 bp, Homo sapiens; identical to SEQ ID NO: 7629

SEQ ID NO: 11122 - DNA, 133 bp, Homo sapiens
tgccgggcgcggtgactcacgcctgtaatcccagcactttgggaggctgaggcgggcggatcatgaggtcaggagatcgagaccatcctggctaacacggtgaaaccccgtctctactaaaaatacaaaaatt

SEQ ID NO: 11123 - DNA, 181 bp, Homo sapiens
aaagcaagcccgggcgcggtggctcacgcctgtaatcccagcactttgggaggccgaggcgggcggatcacgaggtcaggagatcgagaccatcctggctaacacggtgaaaccctgtctctactaaaaatacataaaaattagccgggcaaggtggcaggtgcctgtagtcccagctact

SEQ ID NO: 11124 - DNA, 301 bp, Homo sapiens; identical to SEQ ID NO: 7637
  misc_feature (98)..(98): n equals a,t,g, or c

SEQ ID NO: 11125 - DNA, 301 bp, Homo sapiens; identical to SEQ ID NO: 7639

SEQ ID NO: 11126 - DNA, 111 bp, Homo sapiens
taatcccagcactttgggaggccaaggtgggtggatcacgaagtcaggagatcaagaccatcctggctaacgtggtgaaaccccgtctctactaaaaatacaaaaacaaaa

SEQ ID NO: 11127 - DNA, 182 bp, Homo sapiens; identical to SEQ ID NO: 8672

SEQ ID NO: 11128 - DNA, 300 bp, Homo sapiens; identical to SEQ ID NO: 6730

SEQ ID NO: 11129 - DNA, 611 bp, Homo sapiens; identical to SEQ ID NO: 7640

SEQ ID NO: 11130 - DNA, 291 bp, Homo sapiens; identical to SEQ ID NO: 7641

SEQ ID NO: 11131 - DNA, 308 bp, Homo sapiens; identical to SEQ ID NO: 7642

SEQ ID NO: 11132 - DNA, 197 bp, Homo sapiens
accacggtgaaaccccatctctactaaaaatacaaaaaattagccgggtgcagtggcaagcgcctgtagtcccagctactcaggaggctgaggcaggagaatggcgtgaacccgggaggtggagcttgcagtgagctgagattgcaccactgcactccagcctgggcgacacagcaagactctgtctcaaaaaaaaa

SEQ ID NO: 11133 - DNA, 114 bp, Homo sapiens
cagcactttgggaggccgaggtgggtggatcacgaggtcaggagatcgagaccatcctggccaatatggtgaaaccccatctctactaaaaatacaaaaattagctgggcatgg

SEQ ID NO: 11134 - DNA, 297 bp, Homo sapiens; identical to SEQ ID NO: 7649

SEQ ID NO: 11135 - DNA, 307 bp, Homo sapiens; identical to SEQ ID NO: 7653

SEQ ID NO: 11136 - DNA, 226 bp, Homo sapiens; identical to SEQ ID NO: 6731

SEQ ID NO: 11137 - DNA, 280 bp, Homo sapiens; identical to SEQ ID NO: 7656

SEQ ID NO: 11138 - DNA, 305 bp, Homo sapiens; identical to SEQ ID NO: 6732

SEQ ID NO: 11139 - DNA, 148 bp, Homo sapiens; identical to SEQ ID NO: 10886

SEQ ID NO: 11140 - DNA, 3905 bp, Homo sapiens; identical to SEQ ID NO: 7664

SEQ ID NO: 11141 - DNA, 130 bp, Homo sapiens
ggccgggcgcggtggctcacgcctgtaatcccagcactttgggaggccgaggctgacggttcacaaggtcaggagttcgagaccatcctggccaatatggtgaaaccccgtctctactaaaaatacaaaa

SEQ ID NO: 11142 - DNA, 275 bp, Homo sapiens; identical to SEQ ID NO: 6733

SEQ ID NO: 11143 - DNA, 264 bp, Homo sapiens
atcccagcactttgggaggccgaggtgggcggatcacgaggtcaggagatcgagaccatcctggctaacacagtgaaaccccgtctctactaaaaatacaaaaaaactagccaggcgtggtggtgggcacctgtagtcccagctgctcaggaggctgaggcaggagaatggcgtgaacctgggagccagagcttgcagtgagccgagatggcgccaccgcactccagcctgggagacacagagagactctgtctcaaaaaaata

SEQ ID NO: 11144 - DNA, 163 bp, Homo sapiens
ccgggcatggtggttcatgcctgtaatcccagcactttgggaggccgaggcgggtggatcacgaggtcaggagatcgagaccatcctggctaacacggtgaaaccccgtctctactaaaaatacaaaaattagctggacgtggtggcatgtgccagtaatccc

SEQ ID NO: 11145 - DNA, 237 bp, Homo sapiens
agaccgaggcgggcggatcacgaggtcaggagatcgagaccatcatggctaacacggtgaaaccccgtctctactaaaaatacaaaaaattagccgggcgatgtggcgggcgcctgtagtcccagctactcgggaggctgaggcaggagaaaggcgtgaaccccgcgggccagagcctgcagtgagccgagatcgccccactgcactccagcctgcgcaacagcgagactccatctc

SEQ ID NO: 11146 - DNA, 310 bp, Homo sapiens; identical to SEQ ID NO: 7672

SEQ ID NO: 11147 - DNA, 176 bp, Homo sapiens
tggctcacacctgtaatcccagcactttgggaggccgaggcaggcggatcacgaggtcaggagatcaagaccatcctggctaacacggtgaaaccccgtctctactaaaaatacaaaaaattagccagcgcagtggcacgtgcctgtagtccaagctacttgggaggctgaggcag

SEQ ID NO: 11148 - DNA, 278 bp, Homo sapiens; identical to SEQ ID NO: 7675

SEQ ID NO: 11149 - DNA, 176 bp, Homo sapiens
gcagtggctcacgcctgtaatcccagcactttgggaggccaaggtgggcagatcatgaggtcaggagatcgagaccatcctggctaacatggtgaaaccccatctctactaaaaatacaaaaaactagccaggcgtggtggcgggcgcctgtagttccagctactcgggaggctga

SEQ ID NO: 11150 - DNA, 2364 bp, Homo sapiens; identical to SEQ ID NO: 6735

SEQ ID NO: 11151 - DNA, 298 bp, Homo sapiens
tattatgaggccgggcgctgtggctcacgcctgtaatcccagcactttgggaggctgaggtgggcggatcacgaggtcaggagatcgagaccatcctggctaacatggtgaaaccccatctctactaaaaatacaaaaaattagcagggcgaggtggcagacgcctgtagtcctagctactcgggaggctgaggcaggagaatggcgtgaaccccggggggtggagcctgcagtgagctgagaccgcgccactgcactccagcctgggcgacagcgagactctgtctcaaaaaaaaaa

SEQ ID NO: 11152 - DNA, 276 bp, Homo sapiens; identical to SEQ ID NO: 10742

SEQ ID NO: 11153 - DNA, 289 bp, Homo sapiens; identical to SEQ ID NO: 6736

SEQ ID NO: 11154 - DNA, 261 bp, Homo sapiens
gtgcctcacgcctgtaatcccagcactttgggaggccgaggcgggcggatcatgaggtcaggagatctagaccatcctggctaacacagtgaaaccccgtctctactaaaaatacaaaaaattagccgggcatggtggcgggcgcctgtattcccagctactagggaggctgaggcgggagaatggcgtgaacctgggaggcggagcttgcagtgagccgagattgcgttaatgcaatccagcctgggcgacagagcgaga

SEQ ID NO: 11155 - DNA, 169 bp, Homo sapiens
ctgtaatcccagcactttgggaggctgaggtggacggatcacgaggtcaggagatcgagactatcctggctaacatggtgaaaccccatctctactaaaaatacaaaaaattagccaggcgtggtggcaggcgcctgtagtcccagctacttgggaggctgaggcagga

SEQ ID NO: 11156 - DNA, 312 bp, Homo sapiens; identical to SEQ ID NO: 7681

SEQ ID NO: 11157 - DNA, 284 bp, Homo sapiens; identical to SEQ ID NO: 10189

SEQ ID NO: 11158 - DNA, 298 bp, Homo sapiens; identical to SEQ ID NO: 6737

SEQ ID NO: 11159 - DNA, 282 bp, Homo sapiens
ttaaacctgtaatcccagcactttgggaggccaaggcaggcggatcatgaggtcaggagatcgagaccatcctggctaacacggtgaaaccccatctctactaaaaatacaaaaaaaaattagcagggtgtggtggtgggtgcctgtagtcccagctactcgggaggctgaggcaggagaatggcgtgaacccaggaggcggagcttgcagtgagccgagattgtgccactgcactccagcttgggtgacagagtgagactccgtctcaaaaaaagaaagaa

SEQ ID NO: 11160 - DNA, 138 bp, Homo sapiens
ctcatgcctgtaatcgcagcactttgggaggctgaggcgggtggatcacgaggtgaggagatcgagaccatcctgggtaacatggtgaaaccccgtctctactcaaaatacaaaaagttagccgagtgtggtggtggg

SEQ ID NO: 11161 - DNA, 311 bp, Homo sapiens; identical to SEQ ID NO: 6738

SEQ ID NO: 11162 - DNA, 131 bp, Homo sapiens; identical to SEQ ID NO: 6739

SEQ ID NO: 11163 - DNA, 158 bp, Homo sapiens
gcagtggctcacgcctgtaatcctagcactttggaaggccgaggggggtggatcacgaggacaggagatcgagaccatcctggctaacatggtgaaactctgtctctactaaaaatacaaaaaattagccaggcgtggtggcaggcgcctgtagtccc

SEQ ID NO: 11164 - DNA, 6150 bp, Homo sapiens
aagatttttcaaggaattttcttctctataatataattaatgatctcctacttggacttctgtaaaagattacagtaaatcgtgaagtcttatggaggtttttgcgggagtgggtgggagtagttgtctattactgcgtctttgaatctaaaacagtaccaggatggggccagagggcatctgggctcttcacggattatataggcttgaccttgttagtactgcatgctgtcagagcctcatccaaaaaccactgagatgtttttgtgcaggggaaataaaatttcaagcactggcctatcatctaaagtgacttcttttcttgacccagtagttttctggtgggttataaagtgactttttttatgccgagaactattgaaacaatttatttttgtgtacaaatatgtatgttttgaattaactataaatattacgttataaaacttttttatttttatttttataaaacttgtgtttttaaattggaaattacactcattgaattgttttacacatgcagacacacagacacacacacacacacagcgaaacaaaatcctgagtgacagcaccctgtaactaactgtggtgagatttgattcaagttgacagactcttctgttttagagagtaaatgcctttggattataacttacatgtctttctcaggaaaccagaatgggaggtgggtaacgaaatattctttttggaaatggaagaatcttagaataaaatataaattcaaattgccaatactggcttgacggtaaagtggcaaatctcaccaagacagaggattgtgtgcattaccctgagctgccactcattcatcaggggtttactgagcatttgttatgtgcctggccctgtgctaggccccggggatggcaggataaatccaatgtggcttctgcctgtgaggttctgtaagtttgtggggaagagggatgtctcagcagaagcttgtgagactgtagaaggggtctcagggacactggaggtgcaaaaactagctcttcctggagtgggagtaggactagcttccctgaagcagctgccctggtgctgggccttgggaacagatggaggagccggtgtccccagccaggactccgtaaaggtgtggcattgcaggagggcctggtctgttctgaagagggtagggtgagactggaaagccaaacgggccagattgtgtggaggttttatctcatgggcagcgtaccatttggcccaggagtgccatgcctggggttgtatttttaaaaatatagtaaccatctccccctgcactctcatctaccctgctgcgtattcttggtgatacgttccaagacccccaatgaatgcctgaaaccacagatggtactgaaccctgtatatactacacacgaatttcacttttcttcacaatttcatgggtagaagattcgttcttaccgaagatcttaacatccttacctctttttttttccttattgagacttttgccgtttcacttaaaggaagcatttttggcttctctttggcatatctgaattgccagcatcactatccttacactttgggggcccttctaataaataaagggttacttgaagacaagcactgtgatactgagacagttgatctgataactgcgttggctactaagtaacaggctggcagcatccacagcatggacacgctggacaaagggatggctcgcagtttttgtaatggcaaaaatttcatcacactactcagagcgacatgtagtttaaaacttacgacttgtttatttctggaattttccatttagtatttttgaaccggagttgaccatggataactgaaattacagaaagtgaaacgtggctaacggggtgctagtccctcagtcatccccaagcccttcaccaactctgccctgtatttcagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctaggtactgcaggcagtttatttccccaagcattgtacattttgcttgacttcatatgggtaaattttattgatggctctcattacatttagttgtggggtgatgtcaccttcgtagctcattttaagtctttagaccaccatcagtcataattttcaaagaagctaattttgtctattaaatggaacagaaacttcctcactctgaattttggataagtttgtcatttagcccatggtgggggtaagagtcccactttctaaattggcgatttctgtcacatgtctaaggtagaaccagctgcaggcagtggggacttggggactagaacaggcagggaggtggagagctattctggtgggatgtcctaggggctgatgaaagtgagccttgacagcagctttgttctaaaggagcttaaagagaaagcagtggccgggcgcagtggctcacgcctgtaatcccagcactttgggaggccgaggcgggtggatcacgaggtcaggagatcgagactatcctggctaatgtggtgaaaccccgtctctactaaaaatacaaaaaaaaaaaaaattagccgggcgcgttggcgggcgcctgtagtcccagctactcgggaggctgaggcaggagaatgtcgtgaacctgggaggcagagcttgcagtgagcagagatcgcgcccctgcactccagcctgggcgacagagcaagactccgtctccaaaaaaagagagcagtgaagaaggaagtagagccgccttgcctccctttttgtctcataggcttaaatgtctaaggatcaaggccaccagacctaatttgttctgctgctgtttcataatgtactgagtaatattgctgggacctggggtacctacactgtaacaagtgtaaagtgcaaataaataagtgtcagtcgcaaaccagcaaaacccactttttgaggagtaaggctccatgatgagaaagcacccagagcttgcccctgggacttggcagcaacattgggctgacccaccctggcctgttcccaggaatttgctgatgcccttgactacacacaatgaagtgagaattcaaaagccacgttagttcagcctcattggaaacgggagggagggtcagtgtatgccgaatggagaaaggaggaatttggtagggaaggaaacctttcatttcaagttttaaagtatgaactcaacagtagactcagagcttctacatatgagtctttttagccatcctctttcaaatctaggtgaagcttgtttcttacattagacacatttgtgaaaaggctttatgtaaatattgatttttctatatcaagttacatattataaatccaagagttcctcactgtgtaaaagaaccctgtgaccagtcactttttgaagggcataaatctgtcgatattatagattactcccaattcatgttatctaaagtcattttgatgtgttgagctttcttaaaatgaaacaagcattttttttttaaatgggaaagagactccagagaaatggggtcagtgttcctacaagcatgtatttttgaggtagtctgtattagattttcctgaattccattcagtaatgctcaagtgtttaatgacctcataatgtgttcactttgaatttaagggtaattgaaagaagccttctttagatttctttccatcttctgtatcttctctgaaatgtttagcctagctgttctttgtcctgcagttagtgacagaattcttagggagcttgtaaaaaacacctactgtgtgtcattgttggtttagagacttaactcataaatcagctgtctctaggctagtttcagaatttaggctttattcagattaggaaataattcttggtttcatgtttcaaaaacatagccaactaagtgtttctcagatgctgatcatgaattctctttagtattcacatgacattcttcacttcctcttccattctgcacgctgcattgcccattgcacctcaaaatggagggagttagaagaaagaaaaagaactgaaactttagctgagtgcaatggtggacgcctgtagtcccagctactctggaggctgaggtaggaggatcgcttgagcccaggagtttaaggctacagtgagctatgattgcagcactgtactccagcctgggcaacagagtgagaccctgtctctttaaaaaaaaaaaaaaaagtgaaattcaaattagtattgtttcagatgaagcaaaggactctgaagatggcagaatttgtggtaaaactgttggttcaaatcaggtttttgattattatgggttttatgtatttttccactacatataattttttcttaacctttaaaaaaagaaacttaaagaaccttaataaaggaaacaaaaaactgtagctccttgtcctcaaattaatgagcatttaaacacattccacactactgtagcttgtgcagttgtcacatttgtggttaagcttaaaggtcttagtattatagggtgaaatttcttgaaaagatggtggcttgttgatgatttatacagtctcacttggtgtctatttgtggaccagtccttttaaaaaaagaatagtctatgaatattagagcatctaacattgcatagtgttttgttatccacattactgtctgctgagttaatactaccagagctaaacctgatgccacccgggcagctttgtttggggttttgctgataggtgaaatgttaaaaatgtgagcctatgaagtcatttgagtttttaaaatgtggagtttaaaagtaggccagctattctctttgtatctagaggagagttgatctcattttctctttatttttagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggtatggagtcatgagaggcaaaagttaagccatctgtccctcttaaaataatttccaaactacagttgttggggtgagcagctgtttttgatgtatagaagagtaaccacgtgatggcccaattatggaccgtgaatgaattacatgtggtttttaaatttcagaaaagtgctccagaaagcacagtattggaaagacctaaagatgaaaattttcactgtaatatttgcataggtagcatttttcgggtgcttgctggattctaagcaatgaggaaagaaatgaagaagagcccatttcccggtgcaagtaacatctgtcttccctttcccacaggacgttctcctgctctattacgctccgtggtgcggcttctgtccatccctcaatcacatcttcatccagctagctcggaacctgcccatggacacattcactgtggcaagg

SEQ ID NO: 11165 - DNA, 142 bp, Homo sapiens; identical to SEQ ID NO: 8007

SEQ ID NO: 11166 - DNA, 281 bp, Homo sapiens; identical to SEQ ID NO: 7692

SEQ ID NO: 11167 - DNA, 147 bp, Homo sapiens
tcggccgggcgcggtggctcacgcctgtaatctcagcactttgggaggccaaggcgggtggatcaagaggtcaagagatcaagaccatcctggctaacatggtgaaaccccgtctctactgaaaatacaaaaaattagctgggcgtg

SEQ ID NO: 11168 - DNA, 312 bp, Homo sapiens
aaacagaagcccttggccgggcgcggtggctcacgcctgtaatcccagcactttgggaggctgaggcgggcggatcacgaggtcaggagatcgagaccatcctggctaacatggtgaaaccccgtctctactaaaaatacaaaaaattagccgggcgaggtggcgggcacctgtagtcacagctactcgggaggctgaggcaggaaaatggcgtgaacccaggaggcggagcctgcagtgagccgagatagtgccactgcactccagcctgggggacagagcgagactccgtctcaaaaaaaaaaaaaaaaa

SEQ ID NO: 11169 - DNA, 129 bp, Homo sapiens
gggcgctgtggctcacgcctgtaatcctagcactttgggaggccgaggcaagtggatcacgaggtcaggagatcgagaccatcttggctaacacggtgaaaccccgtgtctactaaaaatacaaaaaaa

SEQ ID NO: 11170 - DNA, 277 bp, Homo sapiens; identical to SEQ ID NO: 7700

SEQ ID NO: 11171 - DNA, 175 bp, Homo sapiens; identical to SEQ ID NO: 6740

SEQ ID NO: 11172 - DNA, 309 bp, Homo sapiens; identical to SEQ ID NO: 7702

SEQ ID NO: 11173 - DNA, 310 bp, Homo sapiens; identical to SEQ ID NO: 7703

SEQ ID NO: 11174 - DNA, 253 bp, Homo sapiens; identical to SEQ ID NO: 10751

SEQ ID NO: 11175 - DNA, 303 bp, Homo sapiens; identical to SEQ ID NO: 10047

SEQ ID NO: 11176 - DNA, 292 bp, Homo sapiens; identical to SEQ ID NO: 7708

SEQ ID NO: 11177 - DNA, 287 bp, Homo sapiens; identical to SEQ ID NO: 7710

SEQ ID NO: 11178 - DNA, 130 bp, Homo sapiens
tgcctgtaatccaagcactttgggaggtcgaggcgggtggatcacgaggtcaggagatggagaccatcctggctaacatggtgaaaccccatctctactaaaaaatacaaaaaattagctgggcatggtg

SEQ ID NO: 11179 - DNA, 273 bp, Homo sapiens; identical to SEQ ID NO: 7712
  misc_feature (18)..(18): n equals a,t,g, or c

SEQ ID NO: 11180 - DNA, 279 bp, Homo sapiens; identical to SEQ ID NO: 8074

SEQ ID NO: 11181 - DNA, 308 bp, Homo sapiens; identical to SEQ ID NO: 7714

SEQ ID NO: 11182 - DNA, 158 bp, Homo sapiens
aaaccccgtctctactaaaaatacaaaattagctgggcttggtggcgcatgcctgtaatcccagctactcgggaggttgaggcaagagaattgcctgaacccaggaggcggaggttgcggagagccgagatcatgccattgcactccagcctgggcaa

SEQ ID NO: 11183 - DNA, 320 bp, Homo sapiens; identical to SEQ ID NO: 6742

SEQ ID NO: 11184 - DNA, 124 bp, Homo sapiens
gcccatgcctgtaatcccagaactttgggaggccgaggcgggcggatcacgaggtcaggagatcgagaccatcctggcaaacacggtgaaaccccgtctctactaaaaatacaaaaaaaaaaat

SEQ ID NO: 11185 - DNA, 308 bp, Homo sapiens; identical to SEQ ID NO: 6743

SEQ ID NO: 11186 - DNA, 300 bp, Homo sapiens; identical to SEQ ID NO: 6744

SEQ ID NO: 11187 - DNA, 226 bp, Homo sapiens
tggtggctctcgcctgtaatcccagcactttgggaggccgaggcgggcggatcgcgaggtcaggagatcaagaccatcctggctaacatggtgaaaccccgcctccactaaaaatacaaaaaattagccgggcatggtggcgggcgcctgtagtcccagcaactcgggaggctgaggcaggagaatggcgtgaacccaggaggcggaggttgcagtcagccaagat

SEQ ID NO: 11188 - DNA, 308 bp, Homo sapiens; identical to SEQ ID NO: 7726

SEQ ID NO: 11189 - DNA, 140 bp, Homo sapiens; identical to SEQ ID NO: 6745

SEQ ID NO: 11190 - DNA, 287 bp, Homo sapiens; identical to SEQ ID NO: 7730

SEQ ID NO: 11191 - DNA, 266 bp, Homo sapiens; identical to SEQ ID NO: 7732

SEQ ID NO: 11192 - DNA, 142 bp, Homo sapiens; identical to SEQ ID NO: 6746

SEQ ID NO: 11193 - DNA, 157 bp, Homo sapiens
cgtgactcacgcctgtaatcccagcactttgggaggccgaggcgggcagatcacgaggtcagaagatcgagactatcctggctaacacggtgaaaccccgtctctactaaaaatcaaaaaaaattagccgggagtggtggcggttgcctgtagtccc

SEQ ID NO: 11194 - DNA, 322 bp, Homo sapiens; identical to SEQ ID NO: 6747

SEQ ID NO: 11195 - DNA, 5125 bp, Homo sapiens; identical to SEQ ID NO: 10190

SEQ ID NO: 11196 - DNA, 140 bp, Homo sapiens
tggctcacgcctgtaatcccagcactttgggaggctgaggcaggcggatcacaaggtcaggagattgagactatcctggctaacacggtgaaaccccatctctactaaaaatacaaaaaattagctgggcgttgtggcgg

SEQ ID NO: 11197 - DNA, 146 bp, Homo sapiens
ccaggcgcggtggctcacgcctgtgatcccagcactttgggaggccgaggcgggcagatcacgaggtcaggagattgagaccgtcctggctaatatggtgaaaccccgtctctactgaaaatacaaaaaattagccgggcaaggtg

SEQ ID NO: 11198 - DNA, 281 bp, Homo sapiens; identical to SEQ ID NO: 6748

SEQ ID NO: 11199 - DNA, 166 bp, Homo sapiens
ggccgggcgcagtggctcacgcctgtaatcacagcactttgggaggccaaggtgggtggatcacgaggtaaggagatcgagaccatcctggctaacacggtgaaacctcgtctctaccaaaaatacaaaaaattagccgggcgtcgtggcacgtgcctgtagtccc

SEQ ID NO: 11200 - DNA, 270 bp, Homo sapiens; identical to SEQ ID NO: 6749

SEQ ID NO: 11201 - DNA, 296 bp, Homo sapiens; identical to SEQ ID NO: 6750

SEQ ID NO: 11202 - DNA, 160 bp, Homo sapiens
cccagaactttgggaggccaaggcggttggatcacgaggtcaggagatcgagaccatcctggctaacatggtgaaaccccgtctctactaaaaatacaaaaaattaaccaggcgtggtggtgggcgcctgtagtcccagctactcaggaggctgaggcag

SEQ ID NO: 11203 - DNA, 238 bp, Homo sapiens
aaaaggccgggcacggtggctcacgcctgtaatcccaacactttgggaggctgaggcaggcggatcacgaggtcaggagatcgaggccatcctggctaacatggtgaaaccccgtctctactaaaaatacaaaaaattagccgggtgtggtggcgggcacctgtagtcccagctactcggggggctgacgcaggagaatggcgtgaacccaggaggcagagcttgcagtgagctgaga

SEQ ID NO: 11204 - DNA, 301 bp, Homo sapiens; identical to SEQ ID NO: 7745

SEQ ID NO: 11205 - DNA, 278 bp, Homo sapiens; identical to SEQ ID NO: 6751

SEQ ID NO: 11206 - DNA, 195 bp, Homo sapiens; identical to SEQ ID NO: 10940

SEQ ID NO: 11207 - DNA, 299 bp, Homo sapiens; identical to SEQ ID NO: 6752

SEQ ID NO: 11208 - DNA, 218 bp, Homo sapiens
ggccgggtgcagaggctcaagcctgtaatcccagcactttggggaggccaaggtgggcggatcacgaggtcaggagatcgagaccatcctggctaacatggtgaaaccccgtctctactaaaaatacaaaaaattagccgggcgtggtggtgggcgcctgtagtcccagctactcgggaggctgaggcaggagaatggcgtgaatccgggaggcagcg

SEQ ID NO: 11209 - DNA, 296 bp, Homo sapiens; identical to SEQ ID NO: 7752

SEQ ID NO: 11210 - DNA, 295 bp, Homo sapiens; identical to SEQ ID NO: 10192

SEQ ID NO: 11211 - DNA, 107 bp, Homo sapiens
tcccagcactttgggaggccgaggcaggtggatcatgaggtcaggagatcgaggccatcctggccaacatggtgaaaccccgtctctactaaaatacaaaaaaaaaa

SEQ ID NO: 11212 - DNA, 318 bp, Homo sapiens; identical to SEQ ID NO: 7753

SEQ ID NO: 11213 - DNA, 217 bp, Homo sapiens
tggctcacgcctgtaatcccagcactctgggaggccgaggcaggtggatcaggaggtcagcagatcgagaccatcctggctaacacggtgaaaccccgtctctactaaaaacacaaaaaattagctgggtgcggtggcgggtgcctgtagtcccagcttctcgggaggctgaggcaggagaatggcgtgaacccgggaggtggagcttgcagtgagc

SEQ ID NO: 11214 - DNA, 307 bp, Homo sapiens; identical to SEQ ID NO: 7758

SEQ ID NO: 11215 - DNA, 306 bp, Homo sapiens; identical to SEQ ID NO: 6754

SEQ ID NO: 11216 - DNA, 663 bp, Homo sapiens
gaaacaacaggtgctggagaggatgtggagaaataggaacacttttacactgttggtgggactgtaaactagttcaaccattgtggaagacagtgtggtgattcctcaaggatctagaactagaaataccatttgacccagccatcccattactggatatatacccaaaggaatataaatcatgctgctataaagacatatgcacacgtatgttcattgtgccactcttcacaatagcaaagacttggaaccaacccaaatgtccatcagtgacagactggattaagaaaatgtggcacatatacaacatggaatactatgcagccataaaaaaggatgagttcatgtcctttgtaggtacatggatgaagctggaaaccatcattctgagcaaactatcacaaggtcagaaaaccaaacaccgcatgttctcactcataggtgagaattgaacaatgagaacacatggacacaggaaggggaacatcacacaccggggcctgtcgtggggtgggggtagtggggagggatagcattaggagatatacctaatgctaaatgacgagttaatgggtgaagcacaccaacatggcacatgtatacatatgtaacaaacctgcacgttgtgcacatgtaccctagaacttaaagtataattaaaaa

SEQ ID NO: 11217 - DNA, 214 bp, Homo sapiens; identical to SEQ ID NO: 7765

SEQ ID NO: 11218 - DNA, 1096 bp, Homo sapiens; identical to SEQ ID NO: 7766

SEQ ID NO: 11219 - DNA, 1902 bp, Homo sapiens
tcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccagagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcactggactaaactggaccgcgaagggaatagccggaacccgccaggctcagagccctgccgcccctcactcaccccgagcctcggccgccgcgacccggttcacaacatccgcccaacctctc

SEQ ID NO: 11220 - DNA, 1087 bp, Homo sapiens; identical to SEQ ID NO: 6755

SEQ ID NO: 11221 - DNA, 523 bp, Homo sapiens; identical to SEQ ID NO: 6756

SEQ ID NO: 11222 - DNA, 470 bp, Homo sapiens
ccgttaacgggattctggaatttgttaggataattgcttttcaatatcaagagatctggcaatcaaatttaataatatcaagcttgcttggtgagcatggatttataagatagaatggtttgtgggggagaatatagttacaaaaaagattattgtttcccataatgcctggtattgtattaagtactttgcatacagtagggcatttcattgtcccagtgatcctcctgcaaagtaggtacaattatcttcaatttacaaatgaggaaaccaagctctcttcaagctgataagatgctgaactgagatttgaaccaagtccctctgcccctaagagcccctacccctagctgctactatatgctgtacccatctaagctttgtgaaataaccttgttccactgcagagaagatgttgtgtcacctatctctagtatttcttggctttgggcagttctggagtcaaaatg

SEQ ID NO: 11223 - DNA, 2327 bp, Homo sapiens; identical to SEQ ID NO: 6759

SEQ ID NO: 11224 - DNA, 131 bp, Homo sapiens
tatttattttgagatggagtctcgctctgtcgcccaggctggagtgcagtggctcgatctcggctcactgcaacctccgcctcctgggttcacgccattctcctgcctcagcctcccgagtagctgggact

SEQ ID NO: 11225 - DNA, 126 bp, Homo sapiens; identical to SEQ ID NO: 6762

SEQ ID NO: 11226 - DNA, 531 bp, Homo sapiens
cctgtatcactcgagaagccctgtatgtcacatttattattccttttagacacatcctcagccaagtgtagtaaatgtccacactccctccctgcttccctcccttccttccctcttttttcaagaagaggaggtttgtgttgccttcagatgactgttgatttaattgacaggcagcttttcttcattgtgtgctttttgcttttgctcacaaaagtgcattcactattctatagtatgttgaaacttttaaatggaaacggcttttcattaacaaaggaagcattttcttccccccttccatgccttagctttctccgctaagtcttggcttcttcagcagctgtacctccaccagaaatgacaaaaggtgcaattgtgctaggagatggcgatgaagatatgccagtggagttttgtgtgtgggctgctggggactgttttccttctgtgtttggttttgttttatttttgttattccagaaagttgagagcacatctaaaaaccaaaaaaaaaaaaaaaaaaaaaaa

SEQ ID NO: 11227 - DNA, 531 bp, Homo sapiens
cctgtatcactcgagaagccctgtatgtcacatttattattccttttagacacatcctcagccaagtgtagtaaatgtccacactccctccctgcttccctcccttccttccctcttttttcaagaagaggaggtttgtgttgccttcagatgactgttgatttaattgacaggcagcttttcttcattgtgtgctttttgctattgctcacaaaagtgcattcactattctatagtatgttgaaacttttaaatggaaacggcttttcattaacaaaggaagcattttcttccccccttccatgccttagctttctccgctaagtcttggcttcttcagcagctgtacctccaccagaaatgacaaaaggtgcaattgtgctaggagatggcgatgaagatatgccagtggagttttgtgtgtgggctgctggggactgttttccttctgtgtttggttttgttttatttttgttattccagaaagttgagagcacatctaaaaaccaaaaaaaaaaaaaaaaaaaaaag

SEQ ID NO: 11228 - DNA, 518 bp, Homo sapiens
caagttaacaatgagcaaaattcagtaaactagttacctctggaggcagagacagagggatgggatagggaagaagtatactagtagatacaaccatattggcaatgttttagttcttaagttgggtagtggattcataggcatttattattaccaggcttcatagcttacagatatagtatatgtattcttttgcatttttcagaattttaaaggcagctaaaggatgttgtctaaatagaatttataaaagagaggagtagaagacagtatgtcatgcatgatttgtttgtatatgtcttacatccttaactaaaagtgtaaattaattgagcataaagaccgtatttaatgcttctattttattatctatattatagattctataagacctactataattccgtctacaaaataaggactcagtctgtgtttattgattacatgatttgaaatagctataaaacagtaagtttaaacactttattttcagaaaaattcaaattgatctgttgggg

SEQ ID NO: 11229 - DNA, 512 bp, Homo sapiens
caagttaacaatgagcaaaattcagtaaactagttacctctggaggcagagacagagggatgggatagggaggaagtatactagtagatacaaccatattggcaatgttttagttcttaagttgggtagtggattcataggcatttattattaccaggcttcatagcttacagatatagtatatgtattcttttgcatttttcagaattttaaaggcagctaaaggatgttgtctaaatagaatttataaaagagaggagtagaagacagtatgtcatgcatgatttgtttgtatatgtcttacatccttaactaaaagtgtaaattgagcataaagaccgtatttaatgcttctattttattatctatattatagattctataagacctactataattccgtctacaaaataaggactcagtctgtgtttattgattacatgatttgaaatagctataaaacagtaagtttaaacactattttcagaaaaattcaaattgatctgttgggg

SEQ ID NO: 11230 - DNA, 1014 bp, Homo sapiens
gccaagcttcaaacatagatctcctgactccattcatatgaccctataaactgtctcaaaacaaaaagataaattaatataaatatttattgaatatgtctttgtagagaaagcataataagcataaagggcaatgcgttaacctttatcacaagcaaccctattggaatgtgtcaacttatcagaatgaatcaggccagaatatcaagtataaatgaagcctgtagttaactgaaagttgcatatcaatcaggcactccagtttctctcctcaaactctgaatattcaatgaataagataaagaaatggctaatttgattttacctttcatttttttgacctaattctaaggtgactactcactcctcaagatttaactaatgttgctttatttttatccctctggggagacagaagagatgattgggaaacacatgtttgaagtttgtaagttctgctgctttcaaccccacagatgtctcttactgcccacttgggccctggtgattaagcaactagatttggagccagtcaggcttttgtttagacattttaactttttcttgctttccttgcaaactcctcagccttcagactggttggaaagtaaatgtacaatcttacataaattttcaggtaatagcatttcagctttttccccaagattttttgcttgggaggagacagattagactggattcggagtcttgattttgcaaaggtaacaaaagacatgtttttttataagacttttcatcataagtttattttattcaacagaagcaaaatctaatataatggaaaaaataaagatctgtgataaatctgatctgtgtggataaacacaattagaaagacttaaagattaagtattgaaacaaactaccaaaatattttaatactgatttgtaaaaatttcagtacatttttcttctttgcttaattctactgggtcctgtttttcatcaaaacattctatcatgttagtatacaatagccaaaaaaaaaaaaaa

SEQ ID NO: 11231 - DNA, 1015 bp, Homo sapiens
gccaagcttcaaacatagatctcctgactccattcatatgaccctataaactgtctcaaaacaaaaagataaattaatataaatatttattgaatatgtctttgtagagaaagcataataagcataaagggcaatgcgttaacctttatcacaagcaaccctattggaatgtgtcaacttatcagaatgaatcaggccagaatatcaagtataaatgaagcctgtagttaactgaaagttgcatatcaatcaggcactccagtttctctcctcaaactctgaatattcaatgaataagataaagaaatggctaatttgattttacctttcatttttttgacctaattctaaggtgactactcactcctcaagatttaactaatgttgctttatttttatccctctggggagacagaagagatgattgggaaacacatgtttgaagtttgtaagttctgctgctttcaaccccacagatgtctcttactgcccacttgggccctggtgattaagcaactagatttggagccagtcaggcttttgtttagacattttaactttttcttgctttccttgcaaactcctcagccttcagactggttggaaagtaaatgtacaatcttacataaattttcaggtaatagcatttcagctttttccccaagattttttgcttgggaggagacagattagactggattcggagtcttgattttgcaaaggtaacaaaagacatgtttttttataagacttttcatcataagtttattttattcaacagaagcaaaatctaatataatggaaaaaataaagatctgtgataaatctgatctgtgtggataaacacaattagaaagatttaaagattaagtattgaaacaaactaccaaaatattttaatactgatttgtaaaaatttcagtacatttttcttctttgcttaattctactgggtcctgtttttcatcaaaacattctatcatgttagtatacaatagccaaaaaaaaaaaaaaa

SEQ ID NO: 11232 - DNA, 1142 bp, Homo sapiens
gtttgttttctatttttctcatatattgcttgttcctcagtccttcttttcctgatttcttttacgttaaatgtttattttaccattttaattctgttgtctttttaaagctacatttctttgcattcttcttataatgattactatagggactataatatgtgtatttaatttatcacaatgaaaactatttgcgaattaaccttggttttacatatataaatcttgcaacactaaagttctgcttacctcccgtctatcctttggtgctatagttgccatatacattacatctatattttttaaaacacaaaatgcagtgctacaagtttgtctttaagaaactaagaacagtatgaaaaggatgttaaaatatctgggtagttattaaaataaattatctctaaaatgaattttgtaatctattattataattttactagttagaattttcaattgttattttttatatctttaagaggtgaaccgagtatagagtatagaacaagaaaaatgtcaggcagtcagctggactcacttgttccctggacgaatctgtttcagttaaatgacagatcaccataatcatatggaccttcaggttttcccaccaaaaggccaaactgaaaatacgaaattcctgacccataaatatcttactgcattgtaaatcatttagcattcattaatcactatttacaattttttaaaaaaaataaggcttgtgccttttctcatctgtttagaatattcagtttagtaactgtatggcaacgtaagttactgacagggaaagccttgtaagacagtactcatttacttaaaatgtggagtttttgcatttctttacaattgaatggaaaaattaccagcagtgctttgggttatagtgacacctggtggtacggtttgaggttttaaaaaaattctttttaaatttgttactcttttttttttctagaccattttttgtaaggaatcattttatcaactaggatgacaagaggcctctcccatcctggttgcacatcactttctataacagagagacatgggccagaagccctgatggagaaagcagccaatgtcccttacatttccacctttggcttgaaaaaaagatctgtgcactaaatacaggg

SEQ ID NO: 11233 - DNA, 1142 bp, Homo sapiens
gtttgttttctatttttctcatatattgcttgttcctcagtccttcttttcctgatttcttttacgttaaatgtttattttaccattttaattctgttgtctttttaaagctacatttctttgcattcttcttataatgattactatagggactataatatgtgtatttaatttatcacaatgaaaactatttgcgaattaaccttggttttacgtatataaatcttgcaacactaaagttctgcttacctcccgtctatcctttggtgctatagttgccatatacattacatctatattttttaaaacacaaaatgcagtgctacaagtttgtctttaagaaactaagaacagtatgaaaaggatgttaaaatatctgggtagttattaaaataaattatctctaaaatgaattttgtaatctattattataattttactagttagaattttcaattgttattttttatatctttaagaggtgaaccgagtatagagtatagaacaagaaaaatgtcaggcagtcagctggactcacttgttccctggacgaatctgtttcagttaaatgacagatcaccataatcatatggaccttcaggttttcccaccaaaaggccaaactgaaaatacgaaattcctgacccataaatatcttactgcattgtaaatcatttagcattcattaatcactatttacaattttttaaaaaaaataaggcttgtgccttttctcatctgtttagaatattcagtttagtaactgtatggcaacgtaagttactgacagggaaagccttgtaagacagtactcatttacttaaaatgtggagtttttgcatttctttacaattgaatggaaaaattaccagcagtgctttgggttatagtgacacctggtggtacggtttgaggttttaaaaaaattctttttaaatttgttactcttttttttttctagaccattttttgtaaggaatcattttatcaactaggatgacaagaggcctctcccatcctggttgcacatcactttctataacagagagacatgggccagaagccctgatggagaaagcagccaatgtcccttacatttccacctttggcttgaaaaaaagatctgtgcactaaatacaggg

SEQ ID NO: 11234 - DNA, 7024 bp, Homo sapiens
  misc_feature (6957)..(6957): n equals a,t,g, or c
cctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtaagtgtttcatgttatatcggcgaacttttcaagaatgttaaccaagtagtttagtagatattcataagtttctgctatgtgttccgcactactctcagacaagtgagacatagtctctgccaaatccagtgaaagacaggctgttttagtacaacttggtgaatgttgtaaatattcagcaaatgtaaatgcctgtatgtgccatatacttgctaggcaattgagaggttagaacagtgaaaaagaaattttacctattatttagtgtgtcccaagttcgaggcactgtattaagctctttaaatgtgttttatcctcacagtaagcctataagataggcaattttctattttgcacatgaggaaactaaggcaagttgagtaactttcccgtggtcacacagctagtaaatggaaggaccaggatactacccagtttgagagagaaggctggagtgagaggcagcaggttactgatttaactgaatctcaaacaataagtaggagtcagccaaccaacaattgagggtgaggtatgttacagtagagggagtagaacaggtaattaggtggcactccattggccaggcagcaggcatgcagtatggtgcaaacagttggatgttgttgtatcaggtggaaggccgggggagccaggaggaaagtgcagagagtgctgggctgggccaggccatagagagcttgctaatgggttgggactccacttccaagtaatgcctgatcaagaagtcacaaagccaaaaatatgcttttgtataagtggttctcaactaggggtgtttgagaatgagtaggagtgttttgaattgtcccagtgacttgcatttattgagcagggccagggatgctgaatgtcctgtataggggacagtcccatgtaatggccaaacatctgtagtatcctcattgaaatgaaacctagtggtttttttatattttcattataatgatattaccagaatttattaacttctttccaaaattatttctagaaaatgcatatgcaaaactgtctatatttttgttccatttggacagaaaaatgagaaccctaaggggatagaaggaggaggaaacattggcagataatttggattaagataataattgatttcgaagattgttgcgtgaacagcattgactaccagaaacaaacatgaaaacaatctttggatttctggttttataatatttactatgtgcaaaagtcatagaaattatgatattttatttcagaaacacttctgaaatttattgggcacatttaagcataaatttaagcatatgccaaattctgtgctggatgttaaagataaaaagccagataaacttggcctttgccttcctagaacttatagtttagtcagggagcaatcaaggcatggtaataggttctacggcctgtgtaagcaatgtgccagaacaacaaagagaaggtgtctaggcagggcacggattatggtgggcagggtgggatgggaggtctgctgtcaggaaagaatgagcaagcattagggagatgaaggggaagttagggagaagttaccaagttgttttctagagctagcttgctaaaattataaactggaaataataatttcctctctttttacattaattacatctatgtgtaagacagaaacagtaataaattcctatttatatcttgaaaatttgaacatatttaagtatcctggagcattgggtttttcttctgttttgttttgtttttccttctctctctccctctctctctccacctacctctccccacctccctctcctccatctccttctcctctccctgcttctttctctcaaacagctaactctaggggttcccaaggagtacagaacagccatcagtcacctgggaggctttttaaactatacaagcttccaattctcccttctctaggtacttccattgttgcaaataactgtgatagcatgcttctgttactgtgtaatggtaacctcacaagtttttctgaaggcagaaaaaaagatggtggtctaattggcaaacattctttagagacttgcctcctagtttattatcttcctcttaccaatttccagctgccttaaatatgtagctgtgctcagatctctttcatactccccaaaaaaagttatcagggttggtgtctgctttgtttgcgtggcttggctagtggtttactaaggtaccatctttccttctttccctgttgctggtgatccactaatgatatccagatagagtaccgttttttgtttgtttgttttttcctttctaggtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggtaagtttatatttgatgttttatagttaaattgggggtgggggggagtatatatctaagatcattcccagttttacctaaaatctatgggaacacttgatgggaacatctgagacagccagccaacagtaccatctgtcctgttcagctgatttaataatgtcagctgcaaccccccagctttgcagaattaagaattaccaacatgcctgtggagcagtgctttggatgacatgtagttatggatgcagatgagctctttcatttggtgggcactaacactgcctttcctatttctcatttcacatgaaaggtgagtcaagaatccagccaagttccacatgaattaacaacagatgtctctcttccacacagctagcatatacagagcaaaaagacattctgaaaggatttgtctggtttaggggagaccacaaatttaaaaatgaataatactggtggcaaatactgaggatcaaatgtgtgaaatagagaatgaagcacaggagttcagggatcttgaactgaaaaaaataagtctgggaaagaacagtcctggctcaaatgtttcatgttcattaatctatgaaacctttattaaaccagtactgtgtatcaggcacatgatttcctaaaggagaaattttaacattttaaatgggggttaagggaagttaacatctttaacccactttttccttgatttctttttctttaaaagtggttgttgttgatgtttctcttttgtgcctgacatagttggaggcagaggaaatacgttgttttaaattggttctgaagaaagtaatgtttaagaggatgttttaagaaaatacactgtgcactggttagggcttcatttgttttggttaagtcctgtggcttgaacttgcaccctgttgcctttacaggatggttcccacatcagtagaacgactccgagaaggagggagcatccccaaggtcctccgaagcagcgtgagggtggcccaaaagggagagccctctcccacatgggagagtaacatcacagagaaagactcaggtgagcccatggccttctgctgccaccacattcagggacacatgagccgagtcctgtacagttcatgcctagtgctgagttgaggtgagtcagtttctgatgcagttgggctccaccgcatgctaggttccagcccacttatgctcatttgggctaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactgggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacatttctacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctantttggtttcctttttttcccagccctcttgcatccccttcttttctaccctgtcctacaactatcat

SEQ ID NO: 11235 - DNA, 3488 bp, Homo sapiens
tttcatgttcattaatctatgaaacctttattaaaccagtactgtgtatcaggcacatgatttcctaaaggagaaattttaacattttaaatgggggttaagggaagttaacatctttaacccactttttccttgatttctttttctttaaaagtggttgttgttgatgtttctcttttgtgcctgacatagttggaggcagaggaaatacgttgttttaaattggttctgaagaaagtaatgtttaagaggatgttttaagaaaatacactgtgcactggttagggcttcatttgttttggttaagtcctgtggcttgaacttgcaccctgttgcctttacaggatggttcccacatcagtagaacgactccgagaaggagggagcatccccaaggtcctccgaagcagcgtgagggtggcccaaaagggagagccctctcccacatgggagagtaacatcacagagaaagactcaggtgagcccatggccttctgctgccaccacattcagggacacatgagccgagtcctgtacagttcatgcctagtgctgagttgaggtgagtcagtttctgatgcagttgggctccaccgcatgctaggttccagcccacttatgctcatttgggctaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcat

SEQ ID NO: 11236 - DNA, 13138 bp, Homo sapiens
ctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattccaaatgtttctttactatctttcttccccatctcagtaagagaatgggaaacctcagggtcattgtggcctgttacctggtagcctctcatcttggcagcccctatgcttcccaaaataggcatactgctaccacaaatcccattcatgtatcttttgcatgcagtccatcaatctccataagtttaggtagtaagcatgctagatctccatcgttatctttactgtatactttggtcaaaataggcctctagctgcctgtagtatctgttagtaacactagcctgagagcacagatgatattgattgattgtgtcttcgtttctaggcctttaaataagtgaagtgtctttcccaggttgtttggtattttcattgtggccttagcagagatttagaaaacattggggtatggcttatggcgaatgtgggttttttccactccaggttactttccctctttgttataatgtcttaggaatcagaagtagacaagaggctagcaacatgtattcatgagacaaatttattaccttcactgttggattaagttagaaatgtctgcctcagctgtttcaaaaagtaatcttgaatcactttagtgttcaggtttgggtgacagcaggtttcaatagaatccatgtatacttttttaaaacacttcatctattgcatgttactttgatttgtaattaaaatggacactgtctcttttttccttctcagaaaaatttgttctgaccactaaacacactctgctgctctgcccccttgtttgcacttctccagatgtgttttttgagaaaggtgaacattttaaccaatcttacgtttcctattcagcttttccaagtatgaggattcagaatacttagcttttatgagtaactaagaggcagctagcaacattgaaagcagaactgtattctttcttaccctagacctctacttttggagcagacctctttctgggtgagggaaaaaacctcctggttacatatcagttatctagggaaattactctttaccagattatttatgaaattctttcagccagataataaagcagctgattcaggcctttctaacttgactttgtctacttgcaattgactttgcagtttgcacctagagctttatagtaaggtatcatgagaggaattctccctggagggcataagattataggaatagagtgtcatactttatcaatacaggttttattataaatgtggaattatgaaaattagaaggaggccgggcgcagtggctcacacctataatcccatcactttgggaggctgaggcaggcggatcacgaggtcagtagatcaagaccatcctggctaacgtggtgaaaccccgtctctactaaaaatacaaaatattagccgggcgtggtagtgggcgcctgtagtcccagctactcgggaggctgaggcaggagaatggcgtgaacccgggaggcggagcttgcagtgagccgagatcgcgccattgcactccagcctgggcaacagagcaagactccgtctcaaaaaaaaaaaaaaaaaaaaaagaaaatcagaaggtaagtcactttgcaaaacaagcgggttcagtactcagtgtgttccttatcccttgtagcatttgggataactattaaacactgcaaatataaagtggttttggttttgttttgttttgttttttttaattggtgatcattttaataatacagtccatgcataatgttagaataccaggagggaaggaaaatattaaatagtaaaaggtccaaggcatggtttcacttgcaatttaaggaaattttacctttctcatcaataatagaacagatttcaccaccctgacccattctaatcaccattttaatggccatactctttgctgtattctagtacagagaggtggggagccttttttgtagcaaaggctgtgacacattgtgaaatatcaaaaaggtgtcacgtataaagaccagcttaggctgggcatggtggctcacacctgtaatcacagtgctttggaaggctgaggcaggaggattgcttgaggccaggggtttgagaccagcctgggtaacatcgtgagaccacatttctgcaaaaataaaatacaaaacttagccaggtgtagtggcatatacctgtagtcccagctacttgggaggctgaagcaggaagatcacttaagaccaggagtttaagactgcagtgagccattattgtgccactacatgccagcctgggcaacagtgagatcccatctctaaaaataatttaaagaccagcttaggccaggtacagtggcacacacctgtaatcccagctactcgggaggccaaggcaaaggaattgcttgagcctgggaggttgcagggagccaagactgcgccactgcattccacattccagcctgggcaacagagggagactctctctcaaaaaaaaaaaaaaaaaaaaaaaaacaaccttactagattagtttggggaaggatatttttgagaaggaaaaaagcattcaggaaaatggtgagaagtcttaagtgctaaggggaagaaggtaagaagataaacagtggaagagaacaagatcttcaggaggggaaagcatctagaaagaagagtggaagcaacattgggaggacaagcttagttagcctctcctttctaccagaataaccctcccctcctattcttgccctgagagccatactccacccgccatttcacacatacgtgcacctagatgtacaccacccactgtccatgccaagtaaaattcacagccaaaaccctgctttgctgaagcagcctcatttcccctacctcagcatgtgcctgccacctaggccacagttattcagagtctacattaggcaccctctccttacctcagccctagcacccctgagtcattgtcacactaccaccttcactctcttcacgtgttcccatttacatctttccattaagcactcactgctcagtctctgttatgggactgctgcctcacctgaaagtcccaaggtaaagtcctaccctctgtaggatacagggacctaagtatacacatacatgctttttctgctctgttgccaaaagtacaatggattttacaaaataacattaataggggtggctcaggtctaattagattatgccaagaaccaactctagcctgtgagctagggattccatcaatcacatttcctgtaactgtcattcaagaggaactggccatctccctaaccatgtcagcccccagcacactaatgtctccccctggatagcactgggagggcctgaggcatataagagaataaagaaatgtgacaagcagaagaggcattggatgaaggaacaaggtccatgtaaggaggaataaggggtagggtgcccctcaataacaaatactgtaggttgctaaactctcatctaaaatacaaagacgtataacactaaaatttcaccagtctaactctttccttgtatgtgcttgagatgtttacttacagcatgaaacattataaccaatttatccttaaatgctttcagagataccaggaagcattttaacaagtcattctgtccattgagatgagttctgcagttaaatatttcccctatgcattcttattcaacttccccgcccccgaaaaaagttatggctaacatctatgcttgcttttattttttgttttgttttgcttcttgacttcgagtagatgaataataacaagatgcttttccctcctctagaacatatcctcccctgagagttcccctgcgcataggcccgagtccctgtcacccgaggtagttatcacaccatctcaatcacacttggaggctgagagtgagtgttcatgaatgtgttcctgagtgtgtggggagggctggggatctgagtcagtggggtgatgggctggagggcggccactcagtcacagtaagttgaatgagtcttcctgtgtgactgtgactacacaggactgtcaatgtagatggaggaaaatgaaggtaggagcgtgtgtgtttgtgtgtgtgtgtgttgtgtgtgtgtttggtggggttggtttttgccgtttgggggagggggtggctggagttctattaaagaatagaatctagaagtcaagatgctgatatgtggtaggagccttgttaaagaaaggctaataaatcaggaaagttgagtcaaaagttgtaagagctgttttttgagttgggtggtgacttatgccttgttctagggttaatctaacagctctgtaaaccagatgttttgacctttggttgatagattgagcagcttcttcaggaagggaaagtcattctgtctttcagctttcctacattttctctgcagctccttactgggtgcacaaggaaaccaagtgagtccctggctttctgtcacaggccaccattctgcaatggttaggatatggttgctatacaagtgttatctctttaggatatcagtagagtggttttctcacaaaccctactgctgtggatatgtcaaactcagattttagtgctagagtttctattataagctttcagatttagtaacattaactctgaatctattaatacatgggaccttttttctcttgaagagaaagttagagtctctcagaaatagtcaactgaactttaaccctatccccttccaataaaaaattagggcataattcagtgacagtctactaagttctgaatcagtagtagttcacaggttaatatgaaactgaaaaaggttttattccactagtatattagagattttcttggtgttttgactctagcttgttaggaaagtaaagctctctctcctcagttgttaaagattctaagataacgtaatttgaagactgatatggtatggtatctggttttctggtaccattctttgtcggttagctgtagttgacctagtgttggaagtttggaggttatgataaccaaatagtaggtggggtttatttttggtacatttcagcatttcagaatctgcagtgatgagcattagtggtcttgtggtatgttgacgtacattagaggataaagaagaattgagtggccagaaagttgtatgagaaacacagcttctttaacagtgaaagtgagtgaagaactggttggttgatgtctttaatgccatcctcctttactgaaccagtaacttaagtacttgcctttccgtctaccttctccttcctccacctttttcccttccccccaccttccatcaatattaatttagaaattgataaccccggaagccagttatcttaagacaccagtctcatctttgttttgtgcatggggctaaggtaaattcctaattataccacttgtcccttagtgtagtacaaggtgactcagcaacctgatgaaaggctaagcaggcaaaatagtcacatttagccaattacctaattctaactttcccagtatttcccatccagaaagacttgaaagcaattttggaaaggccaggattctttagtactctggcccatgtacactgttgctacgtgggacttttacagaatataatggctttatctgctctacttccgtccctcttatctttccctgttcacctgtgtccctctcccctcctttctgccctttgactttttcctttctcccctaccccatgtctccgttgatttttattctttcagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtaagtgtttcatgttatatcggcgaacttttcaagaatgttaaccaagtagtttagtagatattcataagtttctgctatgtgttccgcactactctcagacaagtgagacatagtctctgccaaatccagtgaaagacaggctgttttagtacaacttggtgaatgttgtaaatattcagcaaatgtaaatgcctgtatgtgccatatacttgctaggcaattgagaggttagaacagtgaaaaagaaattttacctattatttagtgtgtcccaagttcgaggcactgtattaagctctttaaatgtgttttatcctcacagtaagcctataagataggcaattttctattttgcacatgaggaaactaaggcaagttgagtaactttcccgtggtcacacagctagtaaatggaaggaccaggatactacccagtttgagagagaaggctggagtgagaggcagcaggttactgatttaactgaatctcaaacaataagtaggagtcagccaaccaacaattgagggtgaggtatgttacagtagagggagtagaacaggtaattaggtggcactccattggccaggcagcaggcatgcagtatggtgcaaacagttggatgttgttgtatcaggtggaaggccgggggagccaggaggaaagtgcagagagtgctgggctgggccaggccatagagagcttgctaatgggttgggactccacttccaagtaatgcctgatcaagaagtcacaaagccaaaaatatgcttttgtataagtggttctcaactaggggtgtttgagaatgagtaggagtgttttgaattgtcccagtgacttgcatttattgagcagggccagggatgctgaatgtcctgtataggggacagtcccatgtaatggccaaacatctgtagtatcctcattgaaatgaaacctagtggtttttttatattttcattataatgatattaccagaatttattaacttctttccaaaattatttctagaaaatgcatatgcaaaactgtctatatttttgttccatttggacagaaaaatgagaaccctaaggggatagaaggaggaggaaacattggcagataatttggattaagataataattgatttcgaagattgttgcgtgaacagcattgactaccagaaacaaacatgaaaacaatctttggatttctggttttataatatttactatgtgcaaaagtcatagaaattatgatattttatttcagaaacacttctgaaatttattgggcacatttaagcataaatttaagcatatgccaaattctgtgctggatgttaaagataaaaagccagataaacttggcctttgccttcctagaacttatagtttagtcagggagcaatcaaggcatggtaataggttctacggcctgtgtaagcaatgtgccagaacaacaaagagaaggtgtactaggcagggcacggattatggtgggcagggtgggatgggaggtctgctgtcaggaaagaatgagcaagcattagggagatgaaggggaagttagggagaagttaccaagttgttttctagagctagcttgctaaaattataaactggaaataataatttcctctctttttacattaattacatctatgtgtaagacagaaacagtaataaattcctatttatatcttgaaaatttgaacatatttaagtatcctggagcattgggtttttcttctgttttgttttgtttttccttctctctctccctctctctctccacctacctctccccacctccctctcctccatctccttctcctctccctgcttctttctctcaaacagctaactctaggggttcccaaggagtacagaacagccatcagtcacctgggaggctttttaaactatacaagcttccaattctcccttctctaggtacttccattgttgcaaataactgtgatagcatgcttctgttactgtgtaatggtaacctcacaagtttttctgaaggcagaaaaaaagatggtggtctaattggcaaacattctttagagacttgcctcctagtttattatcttcctcttaccaatttccagctgccttaaatatgtagctgtgctcagatctctttcatactccccaaaaaaagttatcagggttggtgtctgctttgtttgcgtggcttggctagtggtttactaaggtaccatctttccttctttccctgttgctggtgatccactaatgatatccagatagagtaccgttttttgtttgtttgttttttcctttctaggtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggtaagtttatatttgatgttttatagttaaattgggggtgggggggagtatatatctaagatcattcccagttttacctaaaatctatgggaacacttgatgggaacatctgagacagccagccaacagtaccatctgtcctgttcagctgatttaataatgtcagctgcaaccccccagctttgcagaattaagaattaccaacatgcctgtggagcagtgctttggatgacatgtagttatggatgcagatgagctctttcatttggtgggcactaacactgcctttcctatttctcatttcacatgaaaggtgagtcaagaatccagccaagttccacatgaattaacaacagatgtctctcttccacacagctagcatatacagagcaaaaagacattctgaaaggatttgtctggtttaggggagaccacaaatttaaaaatgaataatactggtggcaaatactgaggatcaaatgtgtgaaatagagaatgaagcacaggagttcagggatcttgaactgaaaaaaataagtctgggaaagaacagtcctggctcaaatgtttcatgttcattaatctatgaaacctttattaaaccagtactgtgtatcaggcacatgatttcctaaaggagaaattttaacattttaaatgggggttaagggaagttaacatctttaacccactttttccttgatttctttttctttaaaagtggttgttgttgatgtttctcttttgtgcctgacatagttggaggcagaggaaatacgttgttttaaattggttctgaagaaagtaatgtttaagaggatgttttaagaaaatacactgtgcactggttagggcttcatttgttttggttaagtcctgtggcttgaacttgcaccctgttgcctttacaggatggttcccacatcagtagaacgactccgagaaggagggagcatccccaaggtcctccgaagcagcgtgagggtggcccaaaagggagagccctctcccacatgggagagtaacatcacagagaaagactcaggtgagcccatggccttctgctgccaccacattcagggacacatgagccgagtcctgtacagttcatgcctagtgctgagttgaggtgagtcagtttctgatgcagttgggctccaccgcatgctaggttccagcccacttatgctcatttgggctaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcat

SEQ ID NO: 11237 - DNA, 3169 bp, Homo sapiens
gtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggtaagtttatatttgatgttttatagttaaattgggggtgggggggagtatatatctaagatcattcccagttttacctaaaatctatgggaacacttgatgggaacatctgagacagccagccaacagtaccatctgtcctgttcagctgatttaataatgtcagctgcaaccccccagctttgcagaattaagaattaccaacatgcctgtggagcagtgctttggatgacatgtagttatggatgcagatgagctctttcatttggtgggcactaacactgcctttcctatttctcatttcacatgaaaggtgagtcaagaatccagccaagttccacatgaattaacaacagatgtctctcttccacacagctagcatatacagagcaaaaagacattctgaaaggatttgtctggtttaggggagaccacaaatttaaaaatgaataatactggtggcaaatactgaggatcaaatgtgtgaaatagagaatgaagcacaggagttcagggatcttgaactgaaaaaaataagtctgggaaagaacagtcctggctcaaatgtttcatgttcattaatctatgaaacctttattaaaccagtactgtgtatcaggcacatgatttcctaaaggagaaattttaacattttaaatgggggttaagggaagttaacatctttaacccactttttccttgatttctttttctttaaaagtggttgttgttgatgtttctcttttgtgcctgacatagttggaggcagaggaaatacgttgttttaaattggttctgaagaaagtaatgtttaagaggatgttttaagaaaatacactgtgcactggttagggcttcatttgttttggttaagtcctgtggcttgaacttgcaccctgttgcctttacaggatggttcccacatcagtagaacgactccgagaaggagggagcatccccaaggtcctccgaagcagcgtgagggtggcccaaaagggagagccctctcccacatgggagagtaacatcacagagaaagactcaggtgagcccatggccttctgctgccaccacattcagggacacatgagccgagtcctgtacagttcatgcctagtgctgagttgaggtgagtcagtttctgatgcagttgggctccaccgcatgctaggttccagcccacttatgctcatttgggctaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcaccaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctc

SEQ ID NO: 11238 - DNA, 554 bp, Homo sapiens
atgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaa

SEQ ID NO: 11239 - DNA, 426 bp, Homo sapiens
cagctctgtaaaccagatgttttgacctttggttgatagattgagcagcttcttcaggaagggaaagtcattctgtctttcagctttcctacattttctctgcagctccttactgggtgcacaaggaaaccaagtgagtccctggctttctgtcacaggccaccattctgcaatggttaggatatggttgctatacaagtgttatctctttaggatatcagtagagtggttttctcacaaaccctactgctgtggatatgtcaaactcagattttagtgctagagtttctattataagctttcagatttagtaacattaactctgaatctattaatacatgggaccttttttctcttgaagagaaagttagagtctctcagaaatagtcaactgaactttaaccctatccccttccaataaaaaat

SEQ ID NO: 11240 - DNA, 309 bp, Homo sapiens
ttaaatgctgagacctcagcagagtacttttctttttgttgtttcccccacaaacccatcagtctgggagagcattgcaagtggaaatcatgttgcctgggatggctggattctttgtatattatataaaacgtatgtaaatgtctctccattcgctctgaggattgcattctccccttggctagttaaccaaggggagaggacagcgggcaggcgatcctcaccctgcctggcacgtgcagagaccccagacactctgtgtgggcaaggtgctgtcaagaccagacctcttggggggggaggggcggg

SEQ ID NO: 11241 - DNA, 1586 bp, Homo sapiens
cagaatacttagcttttatgagtaactaagaggcagctagcaacattgaaagcagaactgtattctttcttaccctagacctctacttttggagcagacctctttctgggtgagggaaaaaacctcctggttacatatcagttatctagggaaattactctttaccagattatttatgaaattctttcagccagataataaagcagctgattcaggcctttctaacttgactttgtctacttgcaattgactttgcagtttgcacctagagctttatagtaaggtatcatgagaggaattctccctggagggcataagattataggaatagagtgtcatactttatcaatacaggttttattataaatgtggaattatgaaaattagaaggaggccgggcgcagtggctcacacctataatcccatcactttgggaggctgaggcaggcggatcacgaggtcagtagatcaagaccatcctggctaacgtggtgaaaccccgtctctactaaaaatacaaaatattagccgggcgtggtagtgggcgcctgtagtcccagctactcgggaggctgaggcaggagaatggcgtgaacccgggaggcggagcttgcagtgagccgagatcgcgccattgcactccagcctgggcaacagagcaagactccgtctcaaaaaaaaaaaaaaaaaaaaaagaaaatcagaaggtaagtcactttgcaaaacaagcgggttcagtactcagtgtgttccttatcccttgtagcatttgggataactattaaacactgcaaatataaagtggttttggttttgttttgttttgttttttttaattggtgatcattttaataatacagtccatgcataatgttagaataccaggagggaaggaaaatattaaatagtaaaaggtccaaggcatggtttcacttgcaatttaaggaaattttacctttctcatcaataatagaacagatttcaccaccctgacccattctaatcaccattttaatggccatactctttgctgtattctagtacagagaggtggggagccttttttgtagcaaaggctgtgacacattgtgaaatatcaaaaaggtgtcacgtataaagaccagcttaggctgggcatggtggctcacacctgtaatcacagtgctttggaaggctgaggcaggaggattgcttgaggccaggggtttgagaccagcctgggtaacatcgtgagaccacatttctgcaaaaataaaatacaaaacttagccaggtgtagtggcatatacctgtagtcccagctacttgggaggctgaagcaggaagatcacttaagaccaggagtttaagactgcagtgagccattattgtgccactacatgccagcctgggcaacagtgagatcccatctctaaaaataatttaaagaccagcttaggccaggtacagtggcacacacctgtaatcccagctactcgggaggccaaggcaaaggaattgcttgagcctgggaggttgcagggagccaagactgcgccactgcattccacattccagcctgggcaacagagggagactctctctca

SEQ ID NO: 11242 - DNA, 313 bp, Homo sapiens
ttaaatgctgagacctcagcagagtacttttctttttgttgtttcccccacaaacccatcagtctgggagagcattgggagtggaaatcatgttgcctgggatgctggctttctttgtatattatataaaacgtatgtaaatgtctctccatttgggctggggttagcattctccccttggctatttaccaaggggagacgccagcggcaggcggcctcaccctgcctggcacgtgcagagaccccagccactctgtgtgggcagggtgctgtcaagaccagacctcttgggggggtaggggcgggggggtgg

SEQ ID NO: 11243 - DNA, 124 bp, Homo sapiens
tcacttgaacccgggagacggaggttgcagtgagctaagtaaatgccattgcactccagccttagcgacagagcaaggctctgtctcataaataaataaatgaataaatgaaagaattttatat

SEQ ID NO: 11244 - DNA, 900 bp, Homo sapiens
gctggggtttgccattttgtgtcttttttagtgttcttccaaattaaattttcaagatcaaatatgggactcattgtcctgtttatggagctttttttcttttggttgactattcttttgtttcctacagtcttcaacaactgttagtgcttacaatggatacatcatgcatcttaattgataggatggatatgataataccttttttggtccaaggtcccgctcattaaaaaaaatagtttataaagctgaaaagtttttatttctattttttgtaaaatgattttcatgataggattttatataaaggggaagggttttttgtatcatttttataacatttttgaaatgaatacttattctctttcatcatctattttagactcacagttttatgagtaatgcagtaaaggtcatgtggcacattagtaaaatatgttctgaacacagaaactattctccttatcacaaattaaattttatgttaagtttgaagagcactggcctggggtatactttgctgtgaaaagatcattttggtcacttaaattacaatagaaatatttgtgttaagaaaattaagtaaaaattaggctgggcacagtggctcacacctgtaattccaggactttgggaggcctaggcaagtggatcacctgaggtcaggagttcaagaccagcccaaccaacacagtgaaaccctgtctgtactaaaaatacaaaaattatccaggcgtagtggcaggagcctgtaatcccagctccttgggaagctgaggcaggagaatcgcttgaacccgggaggcggaggttgcagtgagccgagactgtgccactgtaccccagcctgggtgacaagagtgaaactctgtctcaaaaaaaaaaaaaaaaaaaaaaagg

SEQ ID NO: 11245 - DNA, 145 bp, Homo sapiens
ctgtagtcccagcttcttgggaggctgaggcagaagaatggcgtgaacccgggaggcggaggttgcagtgagccgagatcgcgctactgcactccagcctgggcaacagagcgaggctccatctcaaaaaaaaaaaaaaaaaaaa

SEQ ID NO: 11246 - DNA, 1668 bp, Homo sapiens
atagatagatagatagttggagtttggataaaaatctcgagttgagatctgagagaccattctgagggagtgtgtgagtagaagaccaagatttgaaccctggtaaacatggtgcaagaggaagaaaatgaaggagacattctaggtggaaggagaacggtagtattattgggatggtaaagagaagagtttaaagatatttggaatagtgaattgtgtttggcacgaggatttgtgacagccatccttagctctgtcagctgattatcgactggggccgggagtgtgggcagtggagactgtttggaaatgtatggtggtgttggagattgccacagtgattgtaggacactactgccacttactaggctggggctagggatgttgaactttgtccagtgcacaagaccatcccatacaagtccaaaatttaatagcacctctgctgagaaatataatgccagggatctatttcagttctccacactccattggtcaccatgttcattcatgtctgccttctaaacatctcaatctagccctttcttcccccttctcagagccactgccatacttgaggcttccattgtctcctgattggactatttatattgccgtaacttcctaccttgattgtctattgccactctctttgccacctcccttctgtttaccaccagaaccgtgaatctaaaatatttcctcttcattaaaagtgaaagaacattatcacgtcatttcctgtttcattaaaagtgaaacattttttaaaaggaaaaataatagcccttcaaggtctggcgctaagctcattttctcgcagcttcaccatggtatctatcttgtattccagctgcagacctccacattcctcagataagtctttccttttttgtactcctttatatgtcagtgtgttcctccttttgtctgggctgtcatttcccttacccacatagagaactccttcctttcaagaatcaactcctgtgtcacctactttgccagtacgatctgttcctctctctctctcgctccaaaagactaatctgcacactctgttacagcacttgtctaattgtgctgtagcgtttatttacatgtttgtttctcctctagccagtgagcacctctcaagcagaattatcttccttgtttctctggcaccctaaatatttgttgaattaatagtccttctcttcttttgtaattttgctttctgtaatagaagcttaattttaagtatagttatatcagtaatcaaaatgaatcacacactgagaaatcaatgtggatgccctttaagggttctgttattttttttattgccattgagtaaaataagatactctgtgataaagtatattagcattaaagtgttcaaatctgatctttattagtaggcctcaagtgaatccttgctgacatttaaggtttatgacatttccttcacgttcgttcttgactggaaggcataaatggctgacagtaaagagcaattaataattttccaagtaaaacattttcagggacatctgcctttattgctccccagatgagagtacagcctgtttcttatgtgttccaaagatgatttccctatcagctttttggtcagttaaccaaaaaaaaaaaaaaaaaaaaaagaaaagaaaaaagaaaaaaaag

SEQ ID NO: 11247 - DNA, 2674 bp, Homo sapiens
aaataggcgagtgttgtgtataaaggaagttgaaatcctgggccttatgtgtgtagactggcaatgtccatttgaagattttgtatttcctcctagtgtcagtgaaaatgtgctaaaaatttcagttaaggtaagaaaacatgtcacacctttagagctaagagttcattgcttttagactgttttgcagttaactacacaaaatatttgaaggattagtgtcgttattactactatatgctgagatgtgaagaaagatgtaatcaatttatttgaataactgtacttattttctggcagtcttgattgcatagagtgaaatatcagtctacccacccaaataattaagattctcatatgctgatattttctttttggtagaattaagcattagtaaataggagaggttttttttttaacttcatatggacacccatgttgctgtaatcttagacatttctggaaagattccctctttttaggtttttagaagattattaagtgatttgataaaatgtcttttctcccatcattttgtaaggaagcacttttattttaattacatagtaatttgtaaaagtgatactctgtcttttgcttagttcttagactcaagtacttaactttctttgaaatatgtttgttacattatatattataaatttattttcatgcctttaaaaaactataaattattattctaaatatggcaatttctttagtgcatttgttttccctaaacaataatgttatttctattagtgaaactatctgcaaaactaaacgttttttactgggaaatttagtagctagaagaacatttactgtgaaatttaatagctatagatgtgagtactgttaccctttaatttatgtttacttatcttttcatggaaatttacaaataaaggaaacaccgtgttaccctaccattttgtatttcagcattactacattgtagagtgtcaaaatttaaggaatgttttgatgtatgaaatatagttttcaaactaggaaagactatgtcactgtgcatatattttatagtttcctcagttatcacttctctttcacatcaatggtgagaattgactcagtgtattttacattatacagaaattttatgtatcagccaaagaaatgaaggaagggttttttgatttgtcagatgtgatgagttaccaagtggtgtttctgtaggctatttatcatagcctgcagaaagccattattttatacagatagatgtatgctcatccaattttataagttctaacaactcacatatggaaataccgtccttgttccaagatgatttatttcatatcttacttgaatatgtgtatttggttagcctacttgttataagatagagttgacatttaagtatacaattaaaagttaggaatttttttcttcctcagaataatttcttttctgtcattgtttcttttgaaacaggaacagggtctgttccacaaaaaagacagtgccaatcaaggctgtgttcgaaaagtttacctgaaggacaccgccacagcagaggtaaacaatttaaagagcatgcctcaattttttttagctgaaatacttttttaaaagcctcttataatgaataccattatttctcccaaagctctcccaaatataactatggatggatatataaacttaatatgctgtggactcagtcgggtgcaagggtcttatttttatatgacacatctggactgtatccttggtccttagctgttggtcctgtttggagagcttcagcccttgctttcatacctttcccttcaaccaaatgagcctatacttgtctttaaaattcataataagtattttactttacagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaa

SEQ ID NO: 11248 - DNA, 320 bp, Homo sapiens
ttggcagaattctaagatccctgtttctttgacctctgtcagccagcgagctgctcttagctcctagaagctacccttattccaacccaacaagggtgctttgaatctctgacttcttggtctcttacgcagatttatagtccatgaacttaggtcaggcccacctacataaactatttttgctcagagtcacctgtgccttataataacctaatcttggaagtaaaatccattatattcaaagtccagggcactatacagagatatataccagggttggggaatcttggagacttgtcttagaattctgtctaccatag

SEQ ID NO: 11249 - DNA, 1344 bp, Homo sapiens
aggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcctggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaag

SEQ ID NO: 11250 - DNA, 186 bp, Homo sapiens
tgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatac

SEQ ID NO: 11251 - DNA, 17000 bp, Homo sapiens
ggatgaaaggattcagaggaaagtagagaaactagagcaacaatgtcagaaagaagccaaggaatttgccaagaaggtacaagagctgcagaaaagcaatcaggtaaacgttttgttaagaaatgggtattttatataggctataatatctttattttcttccagttttaagctcttaaaaaagtctagtcagatgatagtaactgtcaagatttctttctactgctttagtcccatggggtaaaatgttaatgaattgttatcaagtactcttggcattggctttccacagagtgttggtttaggatcacagtactcttcttaggatagagtggtatccagtttagtgtggtccttgattctcctctaacaatgcgaactttgaagaatgacacttcagtagacccctagttttaggaactctttattagcttggatatttaggtagtcatttgctttctctttaatcgtaaaacaaagtaatatgaaagcagctattgtctgaattaggttttcccttgagaaaacctggtctgggaagtttcacaaaagtcatgagggtatgctccaatgagaattctagtgtaactgtaggaaaaactgccttgatctgttttggagtaaaaccaaatcactagattggtcctggggctcagcaggccaaacttcttagtcactcttaggtcctagacttaatctggaacctctgaatcccattcacaggctgggccttatctggaatttgattccccccttttttttttaagacagagttttactctgtcgcccaggctggagtgcagtggtgtgttcttggctcactgcaacctccacctcccaagttcaagtgattctcctgtctcagcctcccgagtaggtaggattacatgcacatgctaccacacccagctaatttttttgtatttttagtagagattttgctatgttggccaggtttgtcttgaactcctgacctcaggtgatccgcctgcctcggcctcccaaagtgctaggattacaggtgtgagctactgctcctggccttgatttcccttagtgtagtttggaatattgtttagctttgctgcctctcagggatcattagttctttagtgttagggattagcaaactgattgctgctaaagtttcaattttttagattccttttcttaaacatatgtggctatgagaaataaggaagtcagtaatttaagataaggaatgcatttttaagagttaaggtgacagtttctaaatacttttaatgcagttttcccttggtaataataataatagttaagctaataaactctgggacaagtctgcctgagtttgagtttcagctctgccgcttatgaactgtgtaatctcaagcaatttaaccttttcatggctcaggtttttttttaatctgtaaagtgtgttgttgagagaattatataagtaaatacatgtaatatgcttagaacagtgtctagtctagcacagagaaagtccttaataaatgtttacagctcttccccacctcagtttaaggttggaaaaacgtcccacactagattatcagcaattccactgttggcaattacaaggcattcattgcattcaatttccatatgccacaggacaatcagtgtaccctgggagaagggaaagaatattctagaaagtaatatacctttgccttagtagaataattgctacttttctgttttcaaaactgggaaagaactattttactttatatataaacatcactttttaaatatttaaaataaattggtatattttaccactgactttttttttttttttttgaggcagagttttactctgttacctaggctggactgcagtggtgcaatctcagctcactgcaacctctgcctcctgagttcaagcgattctcctgcctcagcctcccagctagctggggttgcagggcccaccaccaaacccagctaatatttgtatttttagtagagattgggttttaccatgttgtccaggctggtcttgaactcctgacctcaagtgatctgcctccctcggcctcctactgacatattttttattcttttcagtttagtagcaagagagctctttagatgtctggtccttttcatacttagctaattgttttcagaatcatcatttggggctaaatggtgttgagtgtttttttaaaacaggatgaggagtaaacagctttttttgtttgcttttttgttgattaatgtactcacgataaatattattttaatagttaatggtataaaagtttgcagtttggttaacagattttcagatcatgtcacactaatgagcatgaattttgtagatcatctcgtatataacttctgttatctttagttagtagcaataagagtagtagtttagattataaactgagcacactgattgtattttatgcttatgcacatttttcctaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaaggtaagtgctgtcagaggataaaaccaaatcacagcattaataacagtgccctaattatgagctgcaataattgctttccagagttagacttcaaatcactgagtagctgacttattaaaagtttttattgttctgaaatgtaaactaatacagtttcttgtagattgctgatgaagtgttaatattgagatgtttaattgggtttcctggcatttttttaatgaaattttttgtggcttaaaaatgctgtggtagctgtgttcataaatatctctttaccatagatttctttcaatattaacagaatttctatagtttttaaatagtgacagtccattgggtggtggtggggtggtctgacctaaatcattgataagctgagatgcttttctgtaaagcaataaggaattcagaacttctggtttttattacttgaataaagatctcttataaagaattaaagcagtttggaccaaggagagctgaaaaaaattctgaattaattgtttatgttaatccttttcatagcactagtcacttactcctggtctaagggtacatggtattggctgctctacaatcttgaaagaaggtaatttagctcactttcttcccctcaggggaaaaaaaatcaaaatgtgcaagaaaatggacattcttatggatcttgtatgtacatagcaacattgtccactcatattgaatacagtcttcctgaattattccagatttactccatagaatatttcagatagtggaatgtaaaagctaagtattattgacactcactttgaattaagcaacacttttttttaatagaactctatagggttatagaatttataatttttagagttctttggaaaatagttatgtgtgtacagataattcctctaaagaaaaggtgtttttgaaaaatttagtttttcaagtacaggtggttttttggttataagaatgagttctttagtgttaaattctgagattttagtgtacctgtcacccaaacattgtacactgtatccaatatgtagtcttgtaccccttattcccctctcaacttccgcctttagagcccccaaagtccattatatcactgtgtatgtttttgtgtcctcatagcttagctcccgcttataaatgagagcatatggtatttggttttccattcctgagtaacttcatttagagtaatggcctcccgctctatccaagttgctgcaaaagacattattttgttcctttttgtggctgagtagttttccatggtgtaaacgtaccatatttatctttatctgctcgttggttgatgggcacttaggttggttccatatctttgcagttgaattaatttttggcctagttctaccagttagccatccttaagaactcatatagtattagattgccaattattagataaactcctagctgtctcaatttctggactctgtaccaatcaccttcccaatggaaagaaaaggaaaaagcacccacagagctagaccagtgtgtgattgtgggaggaattagaatgggataagatatcaacacatcatattcttttccttctttccccctagtcatttttgtttttttaattgttcttttttggcatcttggctgggtgtggtggctcaggcctgcaatcccagcactttaggaggccaaggcaggatgattgcttgggcttaggagtttgaaaccagcccgggcaacatggtgaaaccgcatctctaccaaaaaaaaaaaattagctgaccgttgtggcacatgtccatagatcctagcactcaggaggctgaggcaggaggattgcttgagccccagaggttgaggctgcagtgagctgtgactgccacactgcactccagcctgggtgacagacagaccctgtctcaagaaaaaaaagaatcttctcatattctgaaaacaaaaacaaaaacaaaaaaaaccctattatgtgtttacctctgtccttacacatatgttggttttgtttttttttcttttttttcttttttttttttttcagacggagtctcgctctgtcccccaggctggagtgcagtggcgcaatctcggctcactgcaacctccgcctcctgggttcatgccattctcctgcctcagcctcctgagtagctgggaccacaggcgcctgccaccatacccggctaattttttgtatttttagtagagatggggtttcaccatgttagccaggatggtctccatctactgaccttgtgatccgcccacctcggcctcccaaagtgctgggattacaggcatgagccaccgcacctggtctgtttttcttttttacctagaatggcagcttattgttcctcatgtggataatacttgatgactgtgattatctttaacactattagcaagggtagtctctcacctcacccaaatgtcaataactattagaatatagttttgccagcttttgttacttattgttgtagtatgttttaactgactaaatgttgtatattgtaaccttaagagatatctgtgctttacacaatttttataaaataatttgctatggaaattcaatataaacaagtgccatttacccctatactagttagtacattaaacaaagtttgcaatagcacaatgatgatgatgacttcttaaaagaacaaaaactccttatggaagcatagagcaggctgtgtgccaagtatattatttctgaagtgggtattaagggggtattggtgaggagaaaatgatggattttgctaatacaactaaatggcatggtgaggacagatactgcagtgatatttgtgcccatatacaacaggacagagtgagtgtttggtagttgaaaatgatagtgacctgctgactaggagaaaagggatgactgaagcagaaatgctatattcactataatttggagcaagaagggagaagaggctctgctgttgttattcacagttgcttgtcagagttcacatgcctacttagaaaaatctatattgggcagggcgtggtgtctcaagcctgtaatcccagcactttggaaagccaagatgggcagatcacttgaggccaggtgttcaagaccagcctggctaacatggcgaaaccccgtctctactaaaaaaataccaaaattagcgggtgtggtggtgcatgcctataatcccagctacttgggaggctgaggcatgagcattgcttgaacccaggaggtggagattgtagtgagccaagatcatgccaccgcactccagtctgagtgaccgagcaagactctgtctcaaaaaaaagagaaaataaaaaaaatctatattgatgttcttagctcttccttcgtatttatgagtctcactgttttttcaaatgtaaaagaaaatgaatcttcataaaatgaattattaaaattgtgccaaagtaaaactgagaactagtttgagatttaaagaataaatgaacattgtaaactcccctgaactgttgtgtaaataagcacagatatctgcattaaagaattttagaactcttgcctaagttccttagttccacaacttgaataaatttacacatttctggctgggctcggtggctcacgcctgtaatcccagcactttgggaggccgaggtgggcggatcacctaaggtcaggagttcaagaccagcctgaccaatataaagaaaccccgtgtctactaaaaatacaaaaattagccgggcatggtggcatgcgcctgtaatcccagctactcgggaggctgagacaggagaatcacttgaacccaggaggcggaggttgcagtgagcagatatcgcgccattgcactccagccttaagagatatctgtgctttacacacaagagatatctaggccacaagatatctgtggccttaagagatatctgggccacaagagtgaaactctgtctcaaaaaaaaaaaaaaagacagaaagaaaagaaatatacacatttctatattatatttcatcatggggctttacattaaactttatattttcttttagaacaagtgttataaattcatatgatcagtaatgacaggcatttaacttacagtaggatatatgtggcagtatgctctaaattatttttataaatctcgtttatccttttcgggttcataaacttagaattctgagatttacacctggctttcagcaagcaatgatttaaatttctttggaataaacttgaactacaggtttcattgggaagggattgtggcatcaaaaaaatcacagaatttcagtaccagaaagctaaatgtttatgttattattgactcattattggtaacaccccaaatgtattcttgttgctcataaagttttatttgttgtggatttttaaaggaaatttttttagggaagggactgtgggcacatgcagggagatattactaatttcagatatataattattttttgatatgcctaaaagttttttaaattattgcttttatttattttttcatagataaaggaagcagcagacatcattcagaagttgcacctaattgcccaagagttaccttttgataggcaagttcatttctcaagagctaatttgaatatgtggtataatttataaaataaaatagtatcttttcctgtatgattttctttgcccattaattaaacggaaatttattgagcacttgctggttcatttacttgctagtttattcactttgtacaagatgcagtgtaaaatagtttattgaaaaaatacagtctcttcttaatatctaaatttaatgataggccttgaaataatttcagtccctgtctcctgaaaaaaaatttgatgaaggagaattttgaaatcgactgaggttaaatttggattttcatactttggactttgagaaccaggtaggggatagagagaacacttttcctatttcctgatgaaggttcttaggcttttggaggccttggacacctttgaaaagctgatgaacgctatcacctttcttcaggaaattaagatacacacagattattgtatacaatttcatggagttttagactctagcctatccacagaactcttcctagggacttcaggttaagaaccccttttttttaaaatgcaaggccccagagccattactaagttagatttcatcctaaaataaactatccactgagaaggaaattttttcatgatttcttctagtgtatggaatgtcagactctttaataaactgttggtaaaatagtacttcctccatgtgaatatttgaaagaaatatgatttaatatattataaatgatacatagtaatagacatataatatgttatttttgttcatacttgaagatcttcaggaacaggtaaaatatggatatattgctatacttagcttaaccattatctcccaaacatgtaatgaattccccctaaaaatgtatctattttattctcaactctgattatcatgaagaattagcaataatgatcatctatcattcttaataataatctggtagttgcccagcattatgatttaacttactgtaatactttttaaagtcacccaccaaaacttctctttaactttatgtcatttcagaattggactatttacttaaatgggtaaaatgtctagctcaaaataggctcataataattattgactgcatccccctaccctgtcttcatcctatttttccactccagaacacacatgcatatatacatatatatatgaatatgaatatgtgtgtgtgtgtgtgtgtgtgtgtgtgtgtgtgtatatatatatatatatatatatatatgtctaattaggatatatattcaactccaaggcttggtgaagaggccaaaacaaaaccataagagaagtatgtacctgagtggtggtgaatatgagtgtgtgtgtgtgtgtgtgtgtgtgtgtgtgtatatatatgtggagttgaatatatatcctaaatagattcaattttttcacacagattaatatggccttatatgtgatctgatctactgtgactttgatacatcatttttgtataacactctagatttttgtttccttcttcatttgtctttggcatctcttttgccagccactctcctctctcttcaaacaattgcacacaatcttaaaatatttctttttcatgctatgcatttcacttagatatttgagatttgaaaaaattctactgcgtggtattttagttttttaatttgtaaagattgaatggctactctgctaggcacattgctgggtcttatcatttgtcattaatatatcatcatataatatattatttgatcatctttttcttttgaataataatgatggaactttatttttaaaaataccaaccatgggaatggggagggagacaaataatcaagtgtatttaaaatgccagcaaataaaagtaagaacagtaagtcagttttgggactggctgggttgttagtgtcttatgcagagcagttgattctttaaaaagagaattgattttcaatgtgaatttcctaaatgagaaccagctacctacctacattaagttttatcacctggcatgcttcctatcagaattctctcctctgattttgtcttttttctttttacaataaccttttaactttataatggttttggatttacagaaaagttgcaaagatagtacagatggttctcgtatctcctgcacccagtttcccatttggttagcatcttacattgccataggatgtttatcacaactaacaaacctcatggttggtttttgtctttcagattttcagaagttaaatccaaaattgcaagtaagtgatgtatttattttaccttttttttaataagtaaaaaaactacttgtgtaaaaataaaacagcaaaaggagaaaaagcaggaacaatgtcatcttcctaccctagtaggctactgcatagaagatccctgagtttgatttctcttccctcaaaacaaccattaccagtttttttggatattcttgcagaataatctatggatatacaagcataagacataaattctatatatgtgtgtgtgtacatatgtatgtgtatgtatagatatttatatgtacttctatcctcatttatttttaaataattgctaccatactatataaatagctttataccttgcatttttaatttaatagtgcattttggaaatcctgtgctttccatacatctatctctgaataagattctctctttttttttttaagattatataagcatttcagtatctatttaactccttacatgattagtttggttcttgccagtcttggattttagtttaggttagatcattctaggtttttgaaaagaccactaaatttgcaggttctgtggtagctggggtcactatttagagtaggccactgcatagaagattcaaagattcatctatattcccaaaaagtcttagaataaggatgacacagctagttagacttcctgggaatatttttgatcacaatagattggtctgaagttcaggtgttcgttaagaaccatactagcctcaagaatatagtgaatagggccggacatggtggttcgcacctgtaatcccagcactttgggaggccgaggcgggtggatcacctgaggtcaggagttcgagaccagcttggccaacatagtgaaaccccgtctctattaaaaatacaaaaattagctgggtgtggtaatgggtgtctataatcctagctactcaggaggctgaggcaggagaatcgcttgaacccagcaggtggaggttgcagtgagccgagatcgcgccactgcactttgactgggtgacacagagaaactctgtctcgaaaaaaaaaaaaaaaagaaaatgaaaaaaatataaatactgcatattatcaggatgagatttggtgttcagtcatcagtccactattgttctaggtagaggcatcagaactctagtaaagagttctgtagtcctcttcaccctttccatgtgtaggatttttcatgtgtgttgctatcagaaatagcatctggaggattttttccagtcagctactggtttaagtaacaatggcatatgacagtcagaccctggaaagctcagtaattttgccagtttggaagttttttgtcttgaaaatatagatttatatgccacagtatattacaggggctgggttcacggcctataatctcatttgtttttgtaattccttcaaaagaaagctatattcatagtcattatatttgtaaataatgtagatactcttaaataacgtggatgccttgtatgcctcagtgtagctgaatgactttatttttaggtaaataccatgatttagaatgccagctgattcaggagtttaccagtgctcaaagaagaggtgaaatctccagaatgagagaagtagcagcagttttacttcattttaaggtaaatagtaggaattaaaaatgaatagtgttcaaggctatggaaattacgtaagttctatatattatagtctctgatttcccccattcattatgtaactatcacagtgataattttcactgttttgagtaatttgtacatttgatactctgtaaatggtattgaatgttatatatttaatatttaaggttttatattcaataatattaatattgaattaaaattaattgatcaattaaatattgatgaatttttatactttgataaagaaaatcatattgtctgcctttttgcttccacatattataatataggtgaaaagaaagaaaacgtgaccgtaaatatctgtaggatataggaaccagagagtagatggaacatgactagtaagagacttaaatccaggggacctcaggaggtaatacaaaagaattttgtattacggaattgtttacctagaatttgaactcgggagagaatccctgtgtaggagtatatttctgcaaagaaagtgcttaaagaaatggttcttccttcaatctgtttctttgatttgtatcagattagggaaggggaagctatttgttggacttttcattttggtaaaatctgaatgagtattgagaatggctcttgagacagtagtgcactttatattgctttccttactggtttttatgtatgatttattaataggcaaaaatctcattatggtgagcttaatgacaaatcagtttgttttaaacacattttattaaaatacatttagtttaaaaagtaaatttccaaactaccagctgaatacaactgtccagattcttgcaaggaaaaccaaatgctagagaaggccaggcgcaatggctcactcctgtaatcctagtattttgggaggccgaggcgggtggatcagtttagctcaggagttcgagatcagcttaggcaacatggtgagaccctgtctctacagaaaatacaaaaattagccggaggggaggcatgtgcctgtagtcccagctactcgggaggctacagcaggaggatcgcatgagcctgggaggcagaggttgtagttagccaagatgacaccattgcattccagcctgggtgacaggagtgaaatcctgtctcaaaaaaaaaaaaagaaatatatatatacacatatatatatatatacacacacacacacacacacacacacacgtatatatacacactttaatatatataaatatatttatatgtatataaaacacatacatatatatatgtaaaaccttttcccaagaccttgactctctgtgtatgtgtgtgtttgtgtgtatgtgtgtgggtgggtgtgagtgggtgtgttttggagttgaaggagatggctagatgatcataggacaaaaattactctaaagaactcagttacatacttcatctttcttgttttagtctaaagttcaacaaggatatgtaccaactgataaattttatcatagaaagtgactagggagacgatacctttatcaagttactggttttctgcagttaattttatttaagtccaacaggtgttgctattggccatttactggtaaatagtcatagctttatgacatataacacttctttttttgaaataataattattataattgaatcagaataataacaatgtgtttcttccttgtagggttattcccattgtgttgatgtttatataaagcagtgccaggaggtaacataacagtacactttgttggatattattttatgctaattgttgttttaaaatcatgtagaaattatatgttcactgtataaaatgtctctgctgtttagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacaggtaattttaaatagtaacaaattaaatagttcttaaagcaatatgtaattttttccctatattttaaaagtatttttaaaatttagtttacttatgtaatgaccttagaaatagtaatctagttaaggagaaaggaatcctcatgctttttaaaaaatgttttgtattcaccaagaagaaagtgctaatcaataagtatcatcagagaacatgcttgaaatttgtgtagtattcgtagtagtagtataatatattgtggtaagatagccttgaagatttttctttttttttggtccctgccttcaccaatagatgtcatttgtgaaactgaacaagaattacaagagcagtctgtagaatttttaataatatggtactaacctgaaaagggaaaacacagaaatttaatttacccccatatcactgtactttcagataacatttcctaagctgtttacaactggattaaacaacattcaataaatgtttgcttttttttttttttaacacaattcaggaattttgatagtattgtcattctctagaagtggggatgtaatgtacagcatttcacacatttactgtctaagaaaccctgttttggagtaatgcctatagacatctgaaggaacactagtgttacctggaactcagtttgggagatgctgccttaaggaattgactctattgtttgtactctcagttttgtttttttgatgcacctcacagagcagaataggccaatttaacagaaaaggtattattcctaagactgataaagatcctctacaggtaaatatgagaagtggtaaaatgtaaaaacctgttttaaaatattttatgattggtttgttttctgtaattgcctttttgattggattgtaagtcagaaaggttcaaaactgtggagtgaattttaaaagaaaaatatcttgagaagttgtagaatttaatatttacctaattaacagaatgttaacctttttcttttagagttttgtgaaagagcagttagaagaatgtaggaagtccgatgcagagcaatatctcaaaaatctctatgatctgtatacaaggtaaatttttaatgattagaaaataatagataacagattttttaaatttttttgataaaaacaaggaagtattcaggtatttttgaataagtttgtcaccagtttaccttttagcattaaatgcttagctgtatagactagttatattgtacaagactgtattgtacaacattcttaatacattaacgtcaggaattggatgttatgctttattttttctctaagcattagtgtaattacatttatctgcagtcaaaactttagaaactgcaaaaggaagtgatgtaatcttaacaaatgacaatttcagctctaaatcttctgtaggaatttgtcttgtgcttttgtaaatgtcagtgttactcttagagattgtctcagaagcttcatatggagtcttgtggggttttttttttccttgacttttcccaaccctattactcttcttcagtgtcttcattttgggagaaggtttttccaaagttaccgtaatgaggaagtccatctcaacaacaacactgttatgaccctatcttcagcaatgggaaatagaaaattagagggaaagtccacaaggacaaaacaaaagagggtgaacagacagtagatctttcagtactctgttttgggtcccatgtgatgaatggcattagacatacttgaggccaatctgccactgtcgccatttctggactagttaattgcctcacaagttcttttcctaggaatttataacagttctcaaaaccgtaaagttgttcgtaatatttcactgtatttatatgtaaccctgtagagttgatctctgcatcataagtactctcccagagtttaagaaatggtggcttaacataagtcatgaaagtcacgttgtaaaaatttgtattccttaatattgttactatacctaaaatgtatattaatctttttctccccctttttcatgaaaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggagggtgagtatttttgttaaatacttctgttaaaactgaagacattaataacttcattatatttgggcaaattatcaaatgttgactatcattagaattttctgtgaagagttcttttaatccagattgttatattattgatcaaatcttgttcttaaaccacatgttgaaatgacctaacataacatgattgaaatgtaagccgggcgtggtaactcactcctgtaatcgcagcactttgggaggccgagatgggctgatcacctgaggtctggagttcgagaccagcctggccaacgtggtgaaaccccatctctactaaaaacacaaaaattagctgggcgtggtggcagacacctgtaatcccagccattaaggaggctgaagcaggagaatcacttgaacctgggagacggaggttgcagtgagccaagattacgccactgcactccagcctgggcgacacagcaagactccgtgtcaaaaaaaaaaaaaaaagtaaagtagatatttgtcaattaaaaaataatgttttaaaactatcgagcagaacactagtaatataaaaagttccatagtttctttcatttttttttttctcgatagaataagttccaggttattgaccaggaaacgcatcttttttttgttactgttgcaggtgtgaaaaaaatagaaaatagtttgtagtttaagtaccttgaattgatgagttttgttcagagactttagcataaaaaactattaaattaataccttaatgcctacaattatttacagactagaagaaaataacttgctccaagaatagttggcatcttagctaccaggctttaactgcctggaacccagattctaaaaagagacagaatgacattggtggactcaaagtccagaatccccacatgtatatatcgaaaccagttttcttatttcccattttgttgtgtattaaataatgattagagagagttaaaattagtagtaagaggtaatacctgaaaggtagtagcaaggaagggaagaggaaaactaatgaataataggaatttgtgtgtgtgtttgtgtgtgtgtgtgtgtgtgtttacggtagtctcaagttacatatcctaagagcaaaaaaagtttaaccttccaaagataccccatataagtgtttcaggtgaccctcagtaattaagaatagctaaattatgtttaatatatcttctttaatatcatgaataaatgtgcataatcttaaaatgactatattttaaaattgttaaacttttaaaggtttctttttaaacaggactatttcgttatttagaatgccaacctatttggaatagctcactttctaaggaaacccagcaagttttactattgagtcagaattgtaaggctgaattgtaaagcaacttcagaaattagaagtccaaatctactcatttatcagatgaaaatcttccgtttagatatcagggctaactttatttcacaaaactagttattggaattagaaattaggtctcttggctattggtccatttttgttgttgatatatactaagtttggaagtactcaaagttgaaatctaagtaaaatgttttctttttttcatttgtctttatgatgtactagtattcaagatttgaaggaaagaattagacagcgtaccaacttaccacttgggccaagtatcgatactc

SEQ ID NO: 11252 - DNA, 147 bp, Homo sapiens
atactttaagttctgggatacgtgtgcagagcatgcaggtttgttacataggtatacacgtgccatggtggtttgctgcacccatcaactcctcatctacattaggtatttctcctaatgctattcctcccttagtcccccaccccc

SEQ ID NO: 11253 - DNA, 5116 bp, Homo sapiens
  misc_feature (3802)..(3802): n equals a,t,g, or c
gctgaagaatttagggagttgattctgatgtaagaagacaatggataaagtatttttcagaagtcagtacaaattggcagcaaatctaccaaaaacaaataataagagaaaaactatcagtgatggatttatcttcacatgtagcatgtactggtttaaatcagtgaataactacatagttattgaattcaaaaacttttatttagacctggtcatctattctcttaattaaatgaaatgaagtttatggagattcacttataagtcatgtgttgcttaatgacagggaaacattctgagaaatgcattgttaggtgatttcctcattgtgcaaacatcacagagtatacgtacacaaatctagatggtagcacctattacacacctaggctatatgctatagcttattgctcctaggctataaacctctacagcatgtttctgtactgaattctgtaggcaactgtagcagaatggaaagtatttatgtatctaaacatagaaaaatatatagtaaaaatacagcattgtaatcatatatgtgggccattaggtgatgcataactgtaatatctaatatttaatttattagatagttatctcaaacatttagtatctagtaaataaacttattttatattactatctaggggacttatttgaaaattactgcagaaatgatgacctggtaacatttggaagattttgttatggtgtcactgtcattttgacataccctatggaatgctttgtgacaagagaggtaagcgcggttccttcccaacgctttacccaggtgatctctctgccacatttaatttaggaagatttataaataatacagtttggcaaattcccaagggcatgacaaatggtataatttgtaaaattttcttttttgactctaaaatgtcagagtttaaagatgaatttatattcagatgtttacaagacaatttttcaaaagttcggtttgaaaattaggtttggtagatttggcttatatttctgtgagcacaaatatttatacaactgcattccaaagtgactgccagccttttgcgacagccaaactaaagttgttgcttttaaggcattcttacaaagaaattaagtatcaaggtttaaaacatgttttacaaaactgtctttttgcttagatgttttatcagtcaacatgtattaaaggcactgtagaatctacagattctaactggttttgttattttttaaaaactaaaatatcttatattccatggagaaccaaaattcaactgaaacttttagttttacagatacattttatttatgtatttatacatgtagacgtgtatatttacaactatacataacataaactaataatataaataataacaaatatataggatattatttacatataaatatattgtattgtcaaagtcagctctaaattgggttatatattccacttgtatttgtagagaaatattatctgaaagagaattcattcttttggtgtaaaattggataacatggcctgtcaggaatcccttatgctgtcagctaaaaatccactgtaccagtcggcagtaaaacatgatcttgcttcacagtgggtctttcagggaccacactgaaaagggctcagtcataggatctgttcctagaggctgtttatacagtgcaccatgtgaaagggtctaatgagataagtgaaatatctacagagctttaaatacactaaataatcagcaggcttcttgaggcaagccagggcttactttaagtcagtcccagggataaggaactgactgcacggggaaacagaagagggaaatgtttagcactgtgtatgtcctttacaactagcacttctctccctcacacatgtataactcacaggccagttctctaccttgactataaaggagaaatagactgaactaatttttttttaaatttaagagcctttcgaaactttactagctattgtcagatgcaggacatggtattattttagcttctgctcagtacgtaggttcaaatctaatctctagatcagcaagtaagaacagatggtgcattctcacgtggttgctagtaaactgcctgcctgcagacgatctgagtcacttcacctgcacaacttctgtgtttagtacttgaaacttgagtttcctttctagctgctgtggcaggaagatagaactgaatcaagatctctgccacaatagcaaatactcagcagaagaatggtgtctataactttcccttctcttactcttcattctgcacacacacacaggtacacacacaaatgtatgactgacaaaaatataatcaaactgtttcaattcataaaagcactaaaaaggctgtctacccttaacaaatatctcttactacctgcctcactaagtgatttttcactctcacaattatatcatagaggcatctgtaagaatggatcttaaataagataatacttggagagacattacaacttatgttattaatatcaccattaaattattagcaaagtcatggcagtatgtgacacatgggagatgttgcatatccaggcagcacagcttagagagatggcttctttatgatacctcaatatctgaccttctgttatttccaactctttgtctcactgttcttttgcacagggtcactacttattcagactatcttctctttatcctccataggaattgttcctgttattacctctttgctctttttcacgctcttgtctcagcctataattctctccaaatcctgtgcatgtttcaagccctacctcaaaccaaggtaggtcaagcatatttcagggatgctgtaaaggagattactgtaaggagacggctctagatacctaaagctccttctagtcctaaattctccttgatcttttttgtcctgttataaattgatctctacttgcttttttaagtttcgttgtatgcctccaaaaattaattcctgagaataggaatcatttccctgacattttatctttgcaaaccatatcataatatgggacacattaagtcagtaattttttattgctttcctgatctgagtagtcatgaaaaatggtgatgaactcttgcccatttttgttgaggaaaggcaagataaaatagacttaaattataacaaataggaattagttaatgcagaattaatttcctgttagtaaaggatattacacatccagtattaataagggaaatgtgacagctacttcttagaggccatgcaaataatctaaatagcatgtttagtttgttttagtagtaacctattggactcaagaaagaaggataagataactttccaaagtctctcctgtacttgaaagatacatgtattgaaacatcggtatgccacactataggtctgtaatataatccactgactaatagttcaacaaagaatacttgttattgatatgtgtgtctgtatgtaagtaatttggaaaatatagaacattcctagtgacttaagatttgattaatagccttgttggtagtattttatatattcctaaatactattgtaaaatactccctcaataaatcctgcatgcctttaaaagtccctctcaaaataatctgtttattcggcaggtaattgccaatgtgttttttggtgggaatctttcatcggttttccacattgttgtaacagtgatggtcatcactgtagccacgcttgtgtcattgctgattgattgcctcgggatagttctagaactcaatgtgagtacgtgcaaagatttaccccttcactctaaaattctctntaaaagataatgattacatttaacataagatgtattttccttaacaaaagtgtcacttttgaagtggaatcaaaatatgtttgtaatagtaaatattttcaatgatgattctgtgcactttgtgggactatatagttttaaagtagtggttgtttagagacatatggggtcgtcacaactgggtaggcagtgctgttggcctctagtggatagaggccagggatatacatcccacaatgtgcaggtctctcacagcaaaaaattatctgatccaaaatgtcaattgtgctgaggttgagaaaccctggtttagagtacttttgcatatctcatttactataacacataaatgttactaaaaatagctataaattaagtggatttggactttgctgaataataatatatctagtgaaatttatgagaaatatgaaaggattcaagttatatccattcacttgctatgacaaaatttctttttctttaaatatttttctttctccagatctttcttttatagtctgcactgccatcaaccaaatagaagtcctcataatatcacagttgaattaatcccagctctgtttcaactatcatgtatttaagttctgctttcagtttatcggcattttcctaccagagcaagtataaattccgttgcttctaccatcttgtcttctgtgtaaaactatttcccatttacttcccaaaatttatgttcagctctagtcaatctaattttttggcctgtgaataagccatatcaattctttccattattctttgtcctatctgctttttatttccgataatgattatttttctttcatttctgtccaaattttacaaaaactttaagatccagtgcaacttctaattcctttattcacattcactgatcatatatttattgagtaattactatgtgccacacaatagaatataaggatgaatgcaataagaaaggacctgtgcattctcacaaataaacataaaagttcaactgcaatataggtgatgaagacagaggaggccaggaacggtggctcacactgtaatctcagcatttttggaggccaaagtggatggattgcttgagcccaggagttggagaccagcctgggcaacacagtgaaaccccgtctctacaaaaaattagccgggtttggtggcatgtgcctgtagtcccagctacttgagaggctgaggtgagaggattgcttgagcccaggaggtagaggtttcagtgagctgagatggcaccactgcactccagcctgggcaacagagtgagacccggtctcaaaaaaaaaa

SEQ ID NO: 11254 - DNA, 10115 bp, Homo sapiens
ctgaacctcttctttacaacgaaatgatgctcaaggtattgtagcattttatgtgacttacttaaattgcttttctagcagacttcttccttcctcaatttcttcagttgccctctccttttaagaactacctgcttctgctttaacttttctttcaacctgtgggctacctaattaactgcatggtggctttcattactgttttacaaatgagatacatgattctattgtacaaagttaggaagggaatgaattatgacaagttcattgaattttaaccccctagttttatgtgtccattatgacgctgccagattgcatttctgttaatctatttactgtcaccaccttctgtataagataagctttttgaggcaggaaccatccagtattgacttggcagtcttgagagcttagaacagtgctggactcatagtaagaacttgtgggccgggcacagtggctcaggcctgtaatcccagcactttgggaggccgaggcggatggatcacgagatcaggggagatcgacaccatgctcgctaactcggtaaaacccggtctctactaagaatacaaaaaattagctgggcgtggtggcaggcgcccgtagtcccagctactcgggaggctgaggcaggagaatggcgtgaacccgggaggtggagcttgcagtgagccgagatcgtgtcactgtactccagcctagcgacagagcgagactccgtcttgaaaaaaaaaaattgtgaaattgatttgttcagtggctttatgttattctttaacttaaataatcactgtatttaactaaacagagatgcaaatgccatgagaaggtcaagcagatcagaagatattttggaaatagatgaacgcaaggaccacagacagctgagcagctgtgtgtttattcccctcacgtttcgttccttcaggggccagggacagccatgtgttctttggcacacagggtgctgttcaggacttccagaggattccagggctccaccttcctgtatcaccagcagcacggtctcatatggatggatggtgcaagtacctccagggctccatgtcaccaccccacctcccccactgctccccagtctcacattcctccataagacacccctgggtcagatctagccctgaagagatgaatgatcaatcactacatgcccccagctgtggggtttgtgggggtgagaagagaggtttaaaagaggtagttttgcttagagtcagggatccaatcaatatttgaaactcttaagtttaaaccctttcttcctctctctttctgcccctaaaaatattttaactgcaatttctagcagcgtgaaaatcaacattattgttattcttccaccctaatctgaaacctttgtgccaccatcctttctctctcccagccatcttctctcctgctttcgcccaccccatacacccctccacctttctatcaaagccctcagagacataaaaaatagcccatccttttgaaaatggcaagtgttccttgacttgataaacctgacatgaggctctgtaaatgggactagtcagtgtccaggttgaaggacgttcagctaggcacgggttccatctctgtagctctgtcctggcactgagctcagtatcaaagaaccccagataccccaggtcccctaatccaatagcccctcaccctacagctaagatttaaaaatgaagtatctgatgttgagagagacaaattaagttgtgcaatgatgtagtaaccagaacaagaaagggaagcaatccaatattcactaggtggtgagcagatagtgaaacctgacttaagagtggatgtttttaactctacataatagatgctctcttgtgaaaatgtgtagaaaacaaaataacagtctacatattgaagaatttgaattttaaaagaattgcagagtactccactgcttatgaaattcaagtaatcttacatgtttttcttatctagcttatgggtagaagcagaatgagcttctccagtgggatgaacacagacacttcatattcaacaagttcacactgagcccatcatcattgcttggaaggctgctcctcttcctgtgttctctctcttggccaatggcactgccatttccccatccagaacctgggatactgcagcagtcttttcactgcccctgtctacccctctccaatccattctctacacaactgcctacaggaatctttccaaaacattagttctgaccataactctacttttcttaagacagcactttggctccccattgacatcacagtctttagagtgatgtaatgttcatcattcggtcataagctgcaaatccattctccttctcacctctgtctcctgcatgcaactccacagctgaaaggagccaaactccctccactctctcacacctcccagccttggcccttgcttccacttctacctttaccctccattctcatcaccctacactattatctgatgactactcttaagttttcataaccagatcaagtatcgatgtctccaccaacagggaagagcaggcagtggttctcaagtcacatatgtaatttaaaattttctagtattttaaattttagaaaatgtttagaagaaactgatcaattaataacatgttttatttacaccatatcccatatattattatgttgatatcaatatattgaattttttttattaagatgagaggagtctcactctgttgcccaggcgggagtgcggtggcatgatctcagctcactgcaacctccgcctcccaggttcaagcaattctcccacctcagcttcctgagtagctgggattacaggtacccaccaccacacccggctaatttttgtatttttagtagagatggggttttgccaccttggccaggctgttcttgaactgctgacctcaagtgatccatctgccttggtctcccaaagtgctgggattacgggcatgagccaccacacctggtcaatgaatagaacattgattcagcatgcaatcaatatttttaaattattgagatgctttatatcctttttttcctactaagctttcaaaaatcagtctttattttactcttatgacacatctcaatttgctgcatttcaagtgctcagtagccacattagggagtagctgccatattgtacgtaagagcaccagagcacttgagagcctcctagagatcctaatgaaaacagaatcctgtgctatgcttccagaggttccatttctggggagagtctaattttggtggtctggagtggggaccagaaatgttccttttcagcaagaaccccaggcagttctgaggtacatgttcgtctgaccatttgggacttgatagctagatgcactgattgtcgagttacacctataggggtttatgttcagattccaccacctaaaagctgtgaaaattagtaacttcagttctctaggtctcagtctcctcacctgcaaaaataactacctagagacttgtgggtattaaaagggtaatatatttgagacattcagcacagtgcctggcaggtgtctcataatagcagctgtgcactgcacccgcagaaatctctatcacacagacgaggtgtcccttgcatcctcctcccacaactctctgtgcttccctccaccaccacccatcacgcaatgctgtgtcctgtgcttgctatgctgcccctcaactcaactgagaagataaactggctgctgtgtgctcccacattactctgcctcacacatagtaggtgcttagtacacatctttttttttttagaaattaaactaaatctgagcaactgggtttcttgtagtggagcaaaactctttatgcaaaagtgcctcaaggtgtcttatagaacagaagtgtgtaagtaaagtggggtgtatccctgtcctaacactcttccctttaaagtctatcacagaaagctttgccacagcaatccatggcttgaaagtgggacacctgacagatcgtgttattcagaggagcaagaggatgattctagacactctgggtgctgggttcctgggaaccactacggaagtgtttcacatagccagccaatatagcaaggtaagaagctcaaggtctacattagagataaaacccagtgcatacatatgtgttacatttactctatacttcgttttatagacagcacttgatgtacatagcactgttctatatcatttttataatttcctatgttccattatctgagttttaatagtcatccatattctttactaagtcactgtcttaaaaccatacacagtgaggcacagtggctcatatctgtaatcccagcactaccagaggccaaggtgggcagacggtttgagcctaggaatttgagaccagccttggcaacatggcaaagacccatttctacaaaaacaaaaaacataaaaattagccaggtgtgatagcacacgcctatagtcccagctactcgggaggctgagaggtgggaggatcacttgagcctgagaggttggggttgtagtaagtcaagatcatgccactgcactccagccaaggcaacagagcatgaccttgtcttaaaaacaaacaaacaaataaacagaaaaaaaatatgctaataatatctcacagtttattattattattctctggagaaaagcctggtcaagtactctgagcagagtggggatgtatgtgagagctcctgctctccctagggtgtattagagataaacagttagtccatcttccctggtatttaccccaaggagtaaataagagtaacttcagatgtgcttccttggagcacttccggatcatgatctaggatcaagcaacgacatctcctccccctttcacaggggagagctgtgtattctacaaggatgagaggtattcaatgactagggcttctatctgtggcaaaggttcaagtaagaactatgaataatgcctccaaagatgaagaataactcttgaaatggtgacttggtatactgtattcacactatcactggttgatttgcttttgttccagatctacagttccaacatatccagcactgtttggggtcagccagacatcaggctcccgcccacatatgctgcttttgtgaacggtgtggctgtaaggaggttttcacgtcttttcaactattagataatcataataattttagagtcaggaaatatctcagaaattgcccaaattctatattttacagatgaaagaactgaaagtcagacagataaagtggcttaccctctctcctatgtagtaattcagttttcatgtttttacagtaaattgatgcttttcaaacagattgtgtagcagaggaaagaagatggaaggatttagataaaaacaccctaaggtatcccaattcaaaaccttgaatataaatagcaaaaaaatataaaacccatatccagacctaatatcttctgtttttcctgttgtggggccagtttctctcaagtaatgtgttctttattcattcactcattcatccattcaacagatagttattgagaaaggaacaatggccttatagtgtctgtattttctgaaccaaaaatctgtacttctcatctgacagatgatttttatgctttttctgtgtgtcacgggaaatattctacaagatgtaacttggaaacagacatgttgggatttccgagatatttttatgatttatgggtacaatagctcaggagattgaaagttaaagccaacggtgcattccaaagcaatgtcctgaaagcagtgggaaatgcaccagtgacagcaaatagatataaaaatctatttttaaatgaacttctggatattactgttttaatataaagaaaaagaaaatggctaggagaaagaggaataagatcttaaagcagaaaataatgatttttaaaatatatagctgaaaagttaatctgagtttgacagttattgtgctattcttacaacttctctaaaagtttgaaattatttcataataaaaaggtacaaaaacgtatggcctcatatggaataaatgacattaaacttgcagtgcaacttatttaaagggtggaggaggaattgccagccacctgattctgcagctttgtttttaaaagggaatatagatctttccaggggccacagcagagggagctcaggccaccagggcaagacccaagctccttggggctcacaagctgctctccaaggtactcccttcctctggcagaggaacagcatttcccagtgcccggccatgtgattaataatcacagccaggccaggtgtggtggctcacgcctgtaatcctagcactttgggaggctgaggcgggcggataacgaggtcaggagtttgagaccaccctggccaacatagtgaaactccgtctctactaaaaatacaaaaattagccaggtgcggtggtgggcacctgttatcccagctgctccagaggctgaggcaggagaattgcttgaacccaggaggcagaggttgcagtgagccaggatcatgccactgcactccagcctaggtgacagagcaagactctgtctcaaaaaaaaaaaaaaaaaaaaaaaaaagaaaaaaaatcacagacatttctcagattttcttttctgagaatcagatcaaaagaatctcacataaaacaaggttattactaaactaagtccttagtggtccaaaagccattgcattaagggaaaatttaaggctttttgttgctgtttgtgtctgtttatacagattcactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccaatgacatgccaaagaggtatggagagaatttgccccatcaaaaggtagtcacatccccttcatctatcaatcattatctccgtagagctttctgacttagaggccggttcagaggaagatgttaacattagcacaggtagataagtcaatacaccagtcacatacgaaaccctctatccacatttaaagaagtgacttcaagagtgcaacctggaccgtgagattaattgggcctctcgttgcaaggtgattcatgtcattctggcattcatgggtgtactgagtattccttatttcattctcaaagcagaatctattctgagactagctagcgtccctcagactaatgaggacattcagaatatccttactctgactgttcatcctgcagataaaaaatggtcaaatgtcggccacatcatatggctcagtctcagatttatgttgccacttgctccagcctgccaggagagaagtaaattgaaatactaggtagtgaagtttcagtttcttcaaggcccacaattctcacagtgacttagatgagatctcagcaatcaatagctgttgcctttctggcaataattgtaatggtaccatttataaagaactcactatgtgctagcactattgtaaacatgttaatttattcaaagctcctaaaactctaagaggtagatgttattattatcaccattttattttattttttgagatggagtctcgctctgttgccaggctggagtgcagtggtgtaatcttggctcattgcaacctccgcctcctgggttcaagtgattctcctgcctcagcctcccaagtagctgggactacaggcatgcaccaccatgcccagctaatttttgtatttttagtagagacggggtttcgtcatgttggccaggatggtctcgagctcttgaccttgtgatctgcctgcctcagcctcccaaagtgctgggattacaggcgtgagccatcgtgcccggccttattattattatttttattattatatttttttgagacagtctcactctgtcacctaggctggagtgcagcagcatgatctcagctcactgcagcgtctgcctcccaggttcaagggattctcctgcctcagtctcccaagtagctgggactgcaggcacccaccaccacatccggcaaatttttgtatttttagtagagtcagtgttttgccatgttggccaacctagtctcaaactcctgacctcagatgaccctcccaccttggcctcccaaagtcctgggattacaggcatgaaccaccacacctcgcctatcaccattttgtgtaagaaaaactctacagagaagttgaataattttccccagatcatatagctaataaagtaatggagctgagatctgaacccagacagtgtgactccattatcaatgttcttgatgactacgctatcctgcctcctggtggttacggtttgtacatctccaactctgcttctttgcttttcagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtagcagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagacctagaagactgttctgtgttaactacacttctcaaaggaccctctccaccagaggtagcttcaaactctccagcatgtaataattctatcacaaatctctcctgaggcttaccaacatctaaatgactttgcatttggggagattcaatgatttggtttgtaaagcaagggtctgctgcttggttttcccaggaaaaatgaacaaagatggagagagtccagaaacagaactacatatatctggaaggagccttctcctgaaaattttgcaggacagttccacttacctaaatcaagatgaaacacacacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcattttggctctagaacccatggtcttaagcactgcaatatatcacctttcagtataaaaatatttgaatcagagttgcaataaagaatgaaa
